(12) United States Patent
Feng et al.

(10) Patent No.: US 10,883,146 B2
(45) Date of Patent: Jan. 5, 2021

(54) BIOMARKERS FOR RHEUMATOID ARTHRITIS AND USAGE THEREOF

(71) Applicant: BGI SHENZHEN, Guangdong (CN)

(72) Inventors: Qiang Feng, Guangdong (CN); Dongya Zhang, Guangdong (CN); Huijue Jia, Guangdong (CN); Donghui Wang, Guangdong (CN); Jun Wang, Guangdong (CN)

(73) Assignee: BGI SHENZHEN, Shenzhen (CN)

( * ) Notice: Subject to any disclaimer, the term of this patent is extended or adjusted under 35 U.S.C. 154(b) by 896 days.

(21) Appl. No.: 15/515,367

(22) PCT Filed: Jul. 7, 2015

(86) PCT No.: PCT/CN2015/083488
§ 371 (c)(1),
(2) Date: Mar. 29, 2017

(87) PCT Pub. No.: WO2016/050110
PCT Pub. Date: Apr. 7, 2016

(65) Prior Publication Data
US 2017/0226565 A1 Aug. 10, 2017

(30) Foreign Application Priority Data

Sep. 30, 2014 (WO) ............... PCT/CN2014/088060
Sep. 30, 2014 (WO) ............... PCT/CN2014/088068
Sep. 30, 2014 (WO) ............... PCT/CN2014/088069

(51) Int. Cl.
C12Q 1/689 (2018.01)
C12Q 1/6883 (2018.01)
A61K 35/747 (2015.01)
C07K 14/335 (2006.01)

(52) U.S. Cl.
CPC ............ *C12Q 1/689* (2013.01); *A61K 35/747* (2013.01); *C07K 14/335* (2013.01); *C12Q 1/6883* (2013.01); *C12Q 2600/118* (2013.01); *C12Q 2600/158* (2013.01)

(58) Field of Classification Search
None
See application file for complete search history.

(56) References Cited

FOREIGN PATENT DOCUMENTS

| JP | 2013183663 | 9/2013 |
| RU | 2362808 | 7/2009 |
| WO | 2014019267 | 2/2014 |

OTHER PUBLICATIONS

Holmes et al. Understanding the role of gut microbiome—host metabolic signal disruption in health and disease. Trends in MicrobiologyJul. 2011, vol. 19, No. 7, pp. 349-359 (Year: 2011).*

(Continued)

*Primary Examiner* — Olivia M. Wise
(74) *Attorney, Agent, or Firm* — Hodgson Russ LLP

(57) ABSTRACT

Biomarkers and methods for predicting risk of a disease in particular RA are provided. Sequences of DNA are obtained. The DNA may be extracted from a sample that is collected from a subject. A relative abundance of a biomarker is then calculated based on the sequences of the DNA. The biomarker comprises a DNA sequence in a genome of *Lactobacillus salivarius*. A probability of the subject having the disease is obtained based on the relative abundance.

3 Claims, 10 Drawing Sheets
Specification includes a Sequence Listing.

(56) References Cited

OTHER PUBLICATIONS

Gareau et al. Probiotics and the gut microbiota in intestinal health and disease. Nature Reviews Gastroenterology & Hepatology Sep. 2010, vol. 7, pp. 503-514 (Year: 2010).*
Qin et al. A metagenome-wide association study of gut microbiota in type 2 diabetes. Nature Oct. 2012, vol. 490,pp. 55-60 (Year: 2012).*
Said et al., "16s RDNA Analysis of the Salivary Microbiota Using 454 Pyrosequencing", Programme of the Annual Meeting of Japanese Molecular Biology Society, 2011, vol. 34, 2p-0087.
APO, Office Action for AU Application No. 2015327511, dated Mar. 28, 2018.
KIPO, Office Action for KR Application No. 20177011630, dated Apr. 30, 2018.
Junjie Qin et al., "A metagenome-wide association study of gut microbiota in type 2 diabetes", Nature, vol. 490, Oct. 4, 2012, Macmillan Publishers Limited, pp. 55-60.
Xiaofei Liu, et al., Analysis of Fecal Lactobacillus Community Structure in Patients with Early Rheumatoid Arthritis, Current Microbiology, vol. 67, No. 2, Mar. 13, 2013, pp. 170-176, Boston, USA.
Jimenez, E., et al., Lactobacillus salivarius CECT 5713, complete genome, Database Nucleotide, Jan. 31, 2014.

* cited by examiner

BIOMARKERS FOR RHEUMATOID ARTHRITIS AND USAGE THEREOF

CROSS-REFERENCE TO RELATED APPLICATIONS

The present patent application claims benefits of and priority to PCT Patent Application No. PCT/CN2014/088068, PCT/CN2014/088069 and PCT/CN2014/088060, each of which is filed Sep. 30, 2014, and incorporated herein by reference in its entireties.

TECHNICAL FIELD

The present disclosure relates to biomedical filed, and particularly to biomarkers and methods for predicting risk of a disease, in particular rheumatoid arthritis (RA).

BACKGROUND

Rheumatoid arthritis (RA) is a debilitating autoimmune disorder affecting tens of millions of people worldwide and increases mortality in the patients with its cardiovascular and other systemic complications. Despite success in alleviating the condition in many RA patients using disease-modifying antirheumatic drugs (DMARD), development of specific and more effective therapies has been hindered by insufficient understanding of factors that trigger or promote the disease. Investigation on microbiome may reveal probiotics that prevent or mitigate RA. Gut microbiota is a key environmental factor for human health, with established roles in obesity, diabetes, colon cancer, etc. Oral microbiota is relatively understudied compared to the gut microbiota. Metagenomic analysis of the role of oral microbiome in diseases has been lacking. It is also unknown that to what extent oral and gut microbial disease markers might converge in their identity or function.

SUMMARY

The present disclosure relates to biomedical filed, and particularly to biomarkers and methods for predicting risk of a disease, in particular rheumatoid arthritis (RA).

Disclosed in the present teaching are systems for obtaining a probability of a subject having a disease or evaluating a treatment regarding the disease.

In one example, a system for obtaining a probability of a subject having a disease is disclosed. The system comprises a processor and a storage medium containing program instructions for execution by the processor. The program instructions causing the processor to execute the following steps. A sample is collected from the subject. DNA is extracted from the sample. Sequences of the DNA are obtained. A relative abundance of a biomarker is then calculated based on the sequences of the DNA. The biomarker comprises a DNA sequence in a genome of *Lactobacillus salivarius*. A probability of the subject having the disease is obtained based on the relative abundance.

In another example, a system for evaluating a treatment regarding a disease or identifying therapeutic agents is disclosed. The system comprises a processor and a storage medium containing program instructions for execution by the processor. The program instructions causing the processor to execute the following steps. For each subject of a plurality of subjects having the disease, first DNA sequences extracted from a first sample and second DNA sequences extracted from a second sample are obtained. The first sample is collected from the subject before the subject receives the treatment. The second sample is collected from the subject after the subject receives the treatment. For each subject, a first relative abundance of a biomarker is calculated based on the first DNA sequences; and a second relative abundance of the biomarker is calculated based on the second DNA sequences. The biomarker comprises a DNA sequence in genome of *Lactobacillus salivarius*. The treatment is then evaluated based on the first relative abundances and the second relative abundances calculated for the plurality of subjects.

In a different example, a system for evaluating a treatment regarding a disease or identifying therapeutic agents is disclosed. The system comprises a processor and a storage medium containing program instructions for execution by the processor. The program instructions causing the processor to execute the following steps. For each subject of a plurality of subjects having the disease, sequences of DNA are obtained, where the DNA may be extracted from a sample that is collected from the subject after the subject receives the treatment; and a relative abundance of a biomarker is calculated based on the sequences of the DNA. The biomarker comprises a DNA sequence in genome of *Lactobacillus salivarius*. The treatment is then evaluated based on the relative abundances calculated for the plurality of subjects.

Also disclosed in the present teaching are methods for obtaining a probability of a subject having a disease or evaluating a treatment regarding the disease or identifying therapeutic agents.

In one example, a method is disclosed. A sample is collected from a subject. DNA is extracted from the sample. Sequences of the DNA are obtained. A relative abundance of a biomarker is then calculated based on the sequences of the DNA. The biomarker comprises a DNA sequence in a genome of *Lactobacillus salivarius*. A probability of the subject having a disease is obtained based on the relative abundance.

In another example, a method for evaluating a treatment regarding a disease or identifying therapeutic agents is disclosed. For each subject of a plurality of subjects having the disease, first DNA sequences extracted from a first sample and second DNA sequences extracted from a second sample are obtained. The first sample is collected from the subject before the subject receives the treatment. The second sample is collected from the subject after the subject receives the treatment. For each subject, a first relative abundance of a biomarker is calculated based on the first DNA sequences; and a second relative abundance of the biomarker is calculated based on the second DNA sequences. The biomarker comprises a DNA sequence in genome of *Lactobacillus salivarius*. The treatment is then evaluated based on the first relative abundances and the second relative abundances calculated for the plurality of subjects.

In a different example, a method for evaluating a treatment regarding a disease or identifying therapeutic agents is disclosed. For each subject of a plurality of subjects having the disease, sequences of DNA are obtained, where the DNA may be extracted from a sample that is collected from the subject after the subject receives the treatment; and a relative abundance of a biomarker is calculated based on the sequences of the DNA. The biomarker comprises a DNA sequence in genome of *Lactobacillus salivarius*. The treatment is then evaluated based on the relative abundances calculated for the plurality of subjects.

Also disclosed in the present teaching is a computer program product for obtaining a probability of a subject having a disease. The computer program product comprises a computer-readable storage medium having program code stored thereon. The program code is executable by a processor and comprises instructions to cause the processor to execute the following steps. A sample is collected from the subject. DNA is extracted from the sample. Sequences of the DNA are obtained. A relative abundance of a biomarker is then calculated based on the sequences of the DNA. The biomarker comprises a DNA sequence in a genome of *Lactobacillus salivarius*. A probability of the subject having the disease is obtained based on the relative abundance.

Also disclosed in the present teaching is a biomarker for obtaining a probability of a subject having a disease or evaluating a treatment regarding the disease or identifying therapeutic agents. The biomarker comprises at least one DNA sequence in a genome of *Lactobacillus salivarius* or at least one of the following metagenomic linkage groups (MLGs): MLG consisting of MLG ID NO: 2169; MLG consisting of MLG ID NO: 16600; and MLG consisting of MLG ID NO: 4643.

Additional novel features will be set forth in part in the description which follows, and in part will become apparent to those skilled in the art upon examination of the following and the accompanying drawings or may be learned by production or operation of the examples. The novel features of the present teachings may be realized and attained by practice or use of various aspects of the methodologies, instrumentalities and combinations set forth in the detailed examples discussed below.

BRIEF DESCRIPTION OF THE DRAWINGS

The methods and systems described in the present teaching are further described in terms of exemplary embodiments. These exemplary embodiments are described in detail with reference to the drawings. These exemplary embodiments are non-limiting exemplary embodiments, in which like reference numerals represent similar structures throughout the several views of the drawings, and wherein.

DETAILED DESCRIPTION

Terms used herein have meanings as commonly understood by a person of ordinary skill in the areas relevant to the present teaching. Terms such as "a", "an" and "the" are not intended to refer to only a singular entity, but include the general class of which a specific example may be used for illustration. The terminology herein is used to describe one or more exemplary embodiments of the present teaching, but their usage does not delimit the present teaching, except as outlined in the claims.

The present disclosure describes biomarkers and methods for utilizing the biomarkers to predict risk of a disease and determine an effect of a treatment regarding the disease, in particular the disease of RA. Infectious agents have long been implicated with RA. However, identity and pathogenicity of the RA-associated agent(s) have been largely unclear, a question further complicated by a recent reinstatement that human body is a super-organism hosting trillions of beneficial as well as harmful microorganisms.

RA is believed to initiate and lurk in some other body site(s) for years before the onset of joint inflammation. Investigation on microbiome may reveal probiotics that prevent or mitigate RA. Gut microbiota is a key environmental factor for human health, with established roles in obesity, diabetes, colon cancer, etc. Besides functioning in nutrient and xenobiotic metabolism, microbes in distal gut crosstalk with neuro-immune-endocrine system and blood stream to impact the entire human body. The gut microbiota is stably associated with a given individual, adding to its value in disease-related investigations. The heterogeneity of the gut microbiome in the human population suggests that treatment of diseases should be personalized according to the gut microbiome, whose role in drug activation or inactivation, immune modulation, etc. remains largely unclear. Oral microbiota is relatively understudied compared to the gut microbiota, with the Human Microbiome Project (HMP) only sampling ~100 healthy individuals for WGS (whole genome sequencing). Metagenomic analysis of the role of the oral microbiome in diseases has been lacking, despite that dental and salivary samples are more readily available at clinical visits than fecal samples. It is also unknown that to what extent oral and gut microbial disease markers might converge in their identity or function.

A biomarker generally refers to a measurable indicator of some biological state or condition. The term "biomarker" as used in the present teaching refers to a measurable substance in an organism whose presence is indicative of some phenomenon such as disease, infection, or environmental exposure. In particular, a biomarker in a sample from a RA patient or a normal person may be utilized to evaluate RA risk of the person.

Figure 1:
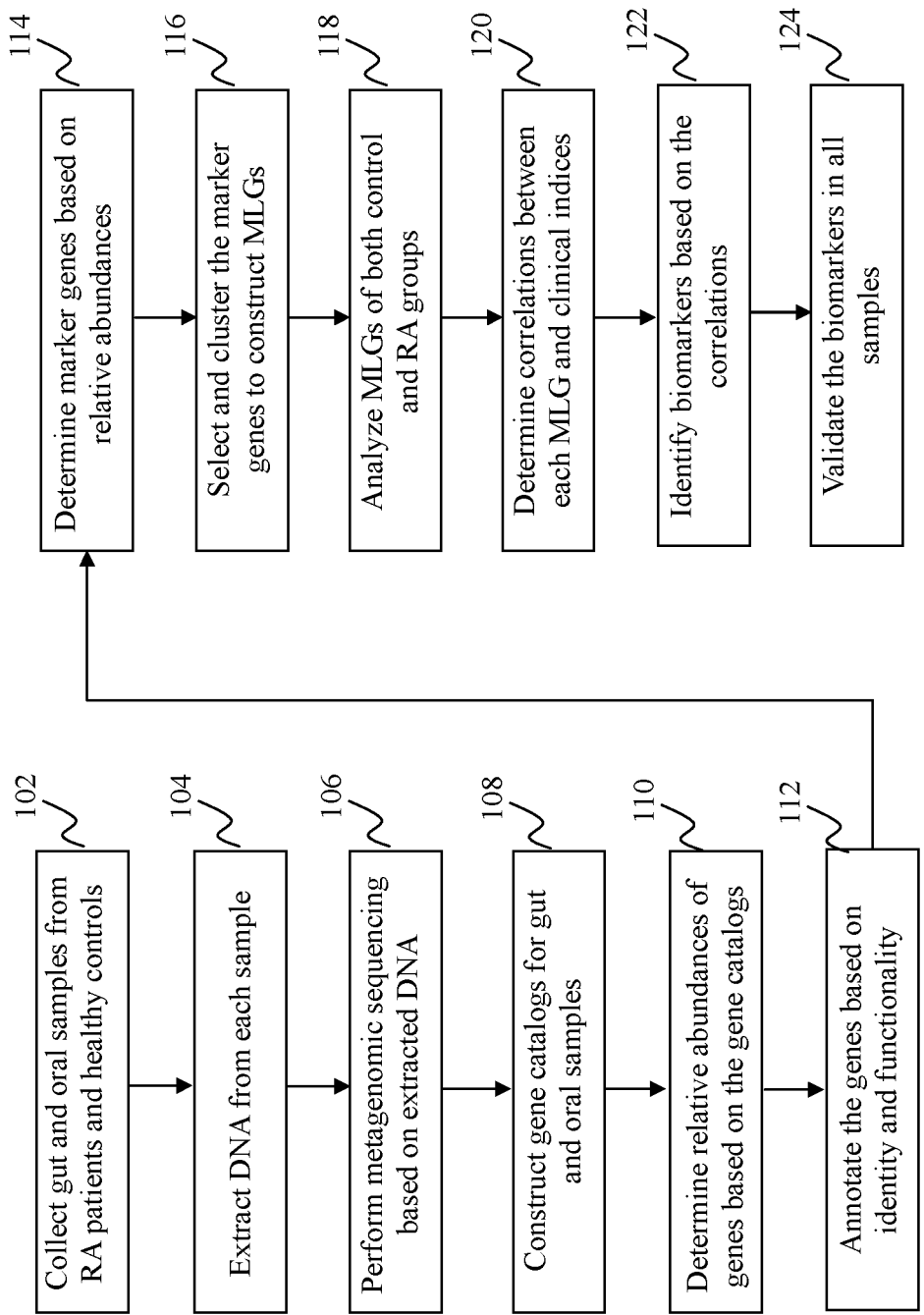
FIG. 1 shows a flowchart of an exemplary process in which biomarkers are identified and validated for evaluating RA risk, according to an embodiment of the present teaching.

FIG. 1 shows a flowchart of an exemplary process in which biomarkers are identified and validated for evaluating RA risk, according to an embodiment of the present teaching. First, gut and/or oral samples are collected at 102 from both RA patients and healthy control people. The gut samples may include fecal samples, while the oral samples may include dental and salivary samples. DNA extraction is performed on each sample at 104. The extracted DNA is sequenced, e.g. by a metagenomic sequencing, at 106. Then at 108, gene catalogs are constructed for gut and oral samples. The gene catalog for gut samples may be replaced or integrated with an existing gene catalog, while there is few existing gene catalog for oral samples.

Based on the gene catalogs, at 110, relative abundances of genes in the samples are determined. A relative abundance of a given gene in a sample can be calculated as below. First, the copy number of each gene in the sequenced data from the sample is calculated as a ratio between the times which a gene can be detected in the sample and the length of the gene. Second, the relative abundance of the given gene can be calculated as a ratio between the copy number of the given gene and a summation of the copy numbers of all genes in the sample.

At 112, the genes are annotated based on their identities and functionalities. Marker genes can be determined at 114 based on their respective relative abundances, e.g. when a marker gene shows difference in relative abundances between control and RA groups. These marker genes are selected and clustered at 116 to construct MLGs. The term "MLG" as used in the present teaching may refer to a group of genetic material in a metagenome that is probably physically linked as a unit rather than being independently distributed. At 118, the MLGs of both control and RA groups are analyzed. Correlations between each MLG and clinical indices are determined at 120. At 122, one or more biomarkers are identified from the MLGs based on the correlations, e.g. when a biomarker shows positive correlation with a predominant antibody of the mucosal immune system or with a major serum immunoglobulin. At 124, the biomarkers are validated in all samples. For example, a biomarker may be validated if it is consistently found enriched in gut and/or oral samples from the RA patients.

According to an embodiment of the present disclosure, a validated biomarker comprises a DNA sequence in a genome of *Lactobacillus salivarius*. According to various embodiments of the present disclosure, the validated biomarker may comprise at least a partial sequence of SEQ ID NO: 1 to 593; SEQ ID NO: 594 to 1536; or SEQ ID NO: 1537 to 2594, as stated in Table 2-2. A sequence listing submitted herewith includes nucleotide and/or amino acid sequences corresponding to the above mentioned SEQ IDs.

For example, referring to Table 2-2, MLG ID NO: 2169 contains at least 593 RA-associated genes identified from fecal samples. These 593 genes have the polynucleotide sequences of SEQ ID NOs: 1~593, respectively. As understood by those skilled in the art, MLG ID NO: 2169 may contain other genes in addition to SEQ ID NOs: 1~593. In an embodiment of the present teaching, at least 80% (such as at least 80%, 85%, 90%, 95% or 100%) of the genes of MLG ID NO: 2169 have at least 85% (such as at least 85%, 90%, 95% or 100%) sequence identity to the polynucleotide sequences of SEQ ID NOs: 1~593 and encode polypeptides having at least 85% (such as at least 85%, 90%, 95% or 100%) sequence identity to the amino acid sequences encoded by SEQ ID NOs: 1~593. In another embodiment of the present teaching, MLG ID NO: 2169 consists of genes having the polynucleotide sequences of SEQ ID NOs: 1~593.

Similarly, referring to Table 2-2, MLG ID NO: 16600 contains at least 943 RA-associated genes identified from fecal samples. These 943 genes have the polynucleotide sequences of SEQ ID NOs: 594~1536, respectively. As understood by those skilled in the art, MLG ID NO: 16600 may contain other genes in addition to SEQ ID NOs: 594~1536. In an embodiment of the present teaching, at least 80% (such as at least 80%, 85%, 90%, 95% or 100%) of the genes of MLG ID NO: 16600 have at least 85% (such as at least 85%, 90%, 95% or 100%) sequence identity to the polynucleotide sequences of SEQ ID NOs: 594~1536 and encode polypeptides having at least 85% (such as at least 85%, 90%, 95% or 100%) sequence identity to the amino acid sequences encoded by SEQ ID NOs: 594~1536. In another embodiment of the present teaching, MLG ID NO: 16600 consists of genes having the polynucleotide sequences of SEQ ID NOs: 594~1536.

Similarly, referring to Table 2-2, MLG ID NO: 4643 contains at least 1058 RA-associated genes identified from fecal samples. These 1058 genes have the polynucleotide sequences of SEQ ID NOs: 1537~2594, respectively. As understood by those skilled in the art, MLG ID NO: 4643 may contain other genes in addition to SEQ ID NOs: 1537~2594. In an embodiment of the present teaching, at least 80% (such as at least 80%, 85%, 90%, 95% or 100%) of the genes of MLG ID NO: 4643 have at least 85% (such as at least 85%, 90%, 95% or 100%) sequence identity to the polynucleotide sequences of SEQ ID NOs: 1537~2594 and encode polypeptides having at least 85% (such as at least 85%, 90%, 95% or 100%) sequence identity to the amino acid sequences encoded by SEQ ID NOs: 1537~2594. In another embodiment of the present teaching, MLG ID NO: 4643 consists of genes having the polynucleotide sequences of SEQ ID NOs: 1537~2594.

The present teaching is further exemplified in the following non-limiting examples. Unless otherwise stated, parts and percentages are by weight and degrees are Celsius. As apparent to one of ordinary skill in the art, these examples, while indicating preferred embodiments of the present teaching, are given by way of illustration only, and the agents are all commercially available.

The examples relate to methods for identifying and validating biomarkers for evaluating RA risk. In one example, metagenomic shotgun sequencing was performed for 212 fecal samples (77 treatment-naive RA cases, 80 unrelated healthy controls; 17 treatment-naive RA cases and 17 related healthy controls; 21 DMARD-treated cases) (Tables 1-1, 1-2, 1-3). This may be used to investigate the gut microbiome in RA patients. The data were then integrated into an existing gut microbial reference gene catalog to obtain a set of 5.9 million genes (from 481 samples), which allowed saturating mapping of the sequencing reads (80.3±2.3%, mean±s.d.) (Li, J. et al. An integrated catalog of reference genes in the human gut microbiome. Nat. Biotechnol. (2014), incorporated herein by reference).

Dental plaques and saliva were also sampled from treatment-naive RA patients and healthy controls, and performed metagenomic sequencing on the 105 dental and 98 saliva samples (dental/salivary samples from 54/51 treatment-naive RA cases and 51/47 healthy controls; 69 of the subjects having the complete set of fecal, dental and salivary samples) (Tables 1-1, 1-2, 1-3). This may show that dysbiosis is also evident in the oral microbiome, after demonstrating the dysbiosis in the RA gut microbiome. De novo assembly of these sequences led to a gene catalog of 3.2 million genes, with 76.6±1.8% and 70.7±7.3% (mean±s.d.) mapping of the dental and salivary sequencing reads, respectively.

Study cohort is described as below. RA was diagnosed at Peking Union Medical College Hospital according to the 2010 ACR/EULAR (American College Of Rheumatology/ European League Against Rheumatism) classification criteria. All phenotypic information was collected upon the subjects' initial visit to the hospital following standard procedures. 21 fecal samples from DMARD-treated patients were only included in the 212 samples used for gut microbial gene catalog construction, and were not analyzed in this example. RA patients were between 18 and 65 years old, with disease duration of at least 6 weeks, at least 1 swollen joint and 3 tender joints enlisted. Patients were excluded if they had a history of chronic serious infection, any current infection or any type of cancer. Pregnant or lactating women were excluded. All patients were informed of the risk of infertility and patients with a desire to have children were excluded. Even though some of the patients had suffered from RA for years, they were DMARD-naïve because they had not been diagnosed with RA at local hospitals before visiting Peking Union Medical College Hospital, and had only taken painkillers to relieve RA symptoms.

The healthy control group met the following inclusion criteria: 18-65 years of age; having a normal level on recently screening for liver and kidney function, routine blood test, erythrocyte sedimentation rate, fasting blood glucose, blood lipid, and blood pressure. Subjects were excluded if they had a history of chronic serious infection, any current infection, any type of cancer or autoimmune disease. Pregnant or lactating women were excluded. Subjects who had received antibiotic treatment within 1 month before participating in this study were also excluded.

The treatment was performed with methotrexate (MTX)-based DMARDs. 97% of the patients received MTX alone (7.5 mg QW initially, 15 mg (max 0.3 mg/kg) QW from 4 weeks and on; supplemented with 10 mg QW folate), T2 alone (20 mg TID), or MTX plus T2. Other drugs used on the remaining patients included Leflunomide (LEF), prednisolone (pred), hydroxychloroquine (HCQ) and etanercept, which were not compared due to the small sample size. As used in the present teaching, "QW" means once a week; "TID" means three times a day; and "T2" means *Tripterygium wilfordii* (thunder god vine) glycosides. Based on reduction in DAS28-ESR after treatment, the patient samples were divided into good, moderate and no improvement, according to the EULAR response criteria. As patients from all over China came to visit Peking Union Medical College Hospital, not all patient samples were available after treatment.

The study was approved by the institutional review boards at Peking Union Medical College Hospital and (Beijing Genomics Institute) BGI-Shenzhen.

Sample collection is described as below. Fecal samples were collected at Peking Union Medical College Hospital, transported frozen, and extracted at BGI-Shenzhen as previously described (Qin, J. et al. A metagenome-wide association study of gut microbiota in type 2 diabetes. Nature 490, 55-60 (2012), incorporated herein by reference). Dental plaques were scraped from dental surfaces using ophthalmology forceps until there was 3 µl of volume. The sample was transferred into 2000 of 1× lysis buffer containing 10 mM Tris, 1 mM EDTA (Ethylene Diamine Tetraacetic Acid), 0.5% Tween 20 and 200 µg/ml proteinase K (Fermentas) and incubated for 2 hours at 55° C. Lysis was terminated by incubation at 95° C. for 10 minutes, and the sampled were frozen at −80° C. until transport. DNA extraction was performed following the protocol for fecal samples. For saliva, 100 µl of saliva was added into 100 µl of 2× lysis buffer. The posterior pharynx wall was swabbed and added to the same tube. The samples were then lysed and extracted as the dental samples.

All available samples were analyzed (Tables 1-1, 1-2, 1-3). Some of the fecal samples were excluded due to constipation, or inappropriate sample preservation; some of the oral samples were excluded due to low concentration of microbial DNA.

Metagenomic sequencing and assembly is described as below. Paired-end metagenomic sequencing was performed on the Illumina platform (insert size 350 bp, read length 100 bp), and the sequencing reads were quality-controlled and de novo assembled into contigs using SOAPdenovo v2.04 (Luo, R. et al. SOAPdenovo2: an empirically improved memory-efficient short-read de novo assembler. Gigascience 1, 18 (2012), incorporated herein by reference), as described previously (Qin et al. 2012, supra). The average rate of host contamination was 0.37% for fecal, 5.55% for dental and 40.85% for saliva samples.

Gene catalog construction is described as below. Gene prediction from the assembled contigs was performed using GeneMark v2.7d. Redundant genes were removed using BLAT with the cutoff of 90% overlap and 95% identity (no gaps allowed), resulting in a non-redundant gene catalog of 3,800,011 genes for 212 fecal samples (containing 21 of the DMARD-treated samples), and a catalog of 3,234,997 genes for the 203 treatment-naïve oral samples (105 dental plaques samples and 98 saliva samples). The gene catalog from fecal samples was further integrated into an existing gut microbial reference catalog of 4.3 million genes using BLAT (95% identity, 90% overlap) (Qin et al. 2012, supra), resulting in a final catalog of 5.9 million genes. Relative abundances of the genes were determined by aligning high-quality sequencing reads to the gut or oral reference gene catalog. A detailed procedure for the aligning can be found in Qin et al. 2012, supra.

Taxonomic annotation and abundance calculation are described as below. Taxonomic assignment of the predicted genes was performed according to the IMG database (v400) based on an in-house pipeline detailed previously (Qin et al. 2012, supra), with 70% overlap and 65% identity for assignment to phylum, 85% identity to genus, and 95% identity to species. The relative abundance of a taxon was calculated from the relative abundance of its genes.

In one example, a relative abundance of a given gene in a sample can be calculated as below. First, the copy number of each gene in the sequenced data from the sample is calculated as a ratio between the times which a gene can be detected in the sample (i.e. the number of mapped reads) and the length of the gene. Second, the relative abundance of the given gene can be calculated as a ratio between the copy number of the given gene and a summation of the copy numbers of all genes in the sample.

Significant differences in relative abundance of a taxon between patients and healthy controls were identified by a Wilcoxon rank-sum test with $p<0.05$.

Metagenome-wide association study (MGWAS) is described as below. For case-control comparison of the fecal microbiome, removal of genes detected in less than 10% of the samples led to a set of 2,007,643 genes. 117,219 genes showed differences in relative abundance between controls and cases (Wilcoxon rank-sum test, FDR<0.3). These marker genes were then clustered into MLGs according to their abundance variation across all samples (Qin et al. 2012, supra). MLG is a generalized concept in lieu of a species concept for a metagenome. The term "MLG" as used in the present teaching may refer to a group of genetic material in a metagenome that is probably physically linked as a unit rather than being independently distributed. This may help to avoid the need to completely determine the specific microbial species present in the metagenome, which is important given that there are a large number of unknown organisms and that there is frequent lateral gene transfer (LGT) between bacteria. MLG can be used to reduce and structurally organize the abundant metagenomic data and to help making a taxonomic description. Based a gene profile, a MLG can be identified as a group of genes that co-exists among different individual samples and has a consistent abundance level and taxonomic assignment.

For constructing dental MLGs, 371990 marker genes (Wilcoxon rank-sum test, FDR<0.1) were selected from 1900774 genes (present in at least 10% of the samples). For salivary MLGs, 258055 marker genes (Wilcoxon rank-sum test, FDR<0.1) were selected from 2030636 genes (present in at least 10% of the samples).

Taxonomic assignment and abundance profiling of the MLGs were performed according to the taxonomy and the relative abundance of their constituent genes, as previously described (Qin et al. 2012, supra). All genes from one MLG were aligned to the reference microbial genomes at the nucleotide level and the (National Center for Biotechnology Information) NCBI-nr database at the protein level. From the alignments with the reference microbial genomes, one can obtain a list of well-mapped bacterial genomes for each MLG and order these bacterial genomes according to the proportion of genes that could be mapped onto the bacterial genome, as well as the average identity of the alignments.

Assignment to species may require more than 90% of genes in an MLG to align with the species' genome with more than 95% identity, 70% overlap of query. Assigning an MLG to a genus may require more than 80% of its genes to align with a genome with 85% identity in both DNA and protein sequences.

MLGs were further clustered according to Spearman's correlation between their abundances in all samples regardless of case-control status.

Correlation of MLGs from different body sites is analyzed in the same manner in the 69 subjects (36 controls, 33 treatment-naïve cases) having fecal, dental and salivary samples.

Canonical correspondence analysis (CCA) was performed on the MLG abundance profile of the control and RA samples to assess the impact from each of the factors listed (Feng, Q. et al. Gut microbiome development along the colorectal adenoma carcinoma sequence. Nat. Commun. 6, 6528 (2015), incorporated herein by reference in its entirety).

117,219 gene markers differentially enriched in RA patients or controls (Wilcoxon rank-sum test, FDR<0.3) were identified. This may help to accurately delineate features of the RA-associated gut microbiota. Metagenomic linkage groups (MLGs) were computed based on abundance covariations between the genes among samples (Qin et al. 2012, supra). The 88 MLGs that contained at least 100 genes were separated according to their direction of enrichment in canonical coordinate analysis (CCA), confirming that they were mainly associated with the RA status.

The 171 dental and 142 salivary MLGs that contained at least 100 genes were separated according to their direction of enrichment in CCA, confirming their association with RA.

Association between MLGs and clinical indices is described as below. Spearman's correlation was performed between the relative abundance of each MLG and continuous variables measured clinically, as previously described (Karlsson, F. H. et al. Gut metagenome in European women with normal, impaired and diabetic glucose control. Nature 498, 99-103 (2013), incorporated herein by reference in its entirety).

Numerical covariations were investigated between the relative abundance of the MLGs and the clinical indices using Spearman's correlation. This may help to explore the diagnostic or prognostic value of the gut microbiome for RA.

In one example, the relative abundance of a MLG in a sample can be estimated based on the relative abundance values of genes from this MLG. For this MLG, one may discard genes that were among the 5% with the highest and lowest relative abundance, respectively, and then fit a Poisson distribution to the rest. The estimated mean of the Poisson distribution can be interpreted as the relative abundance of this MLG. The profile of MLGs among all samples may be obtained for further analyses. The relative abundance of a biomarker in a sample may be calculated in a similar way.

Figure 2:
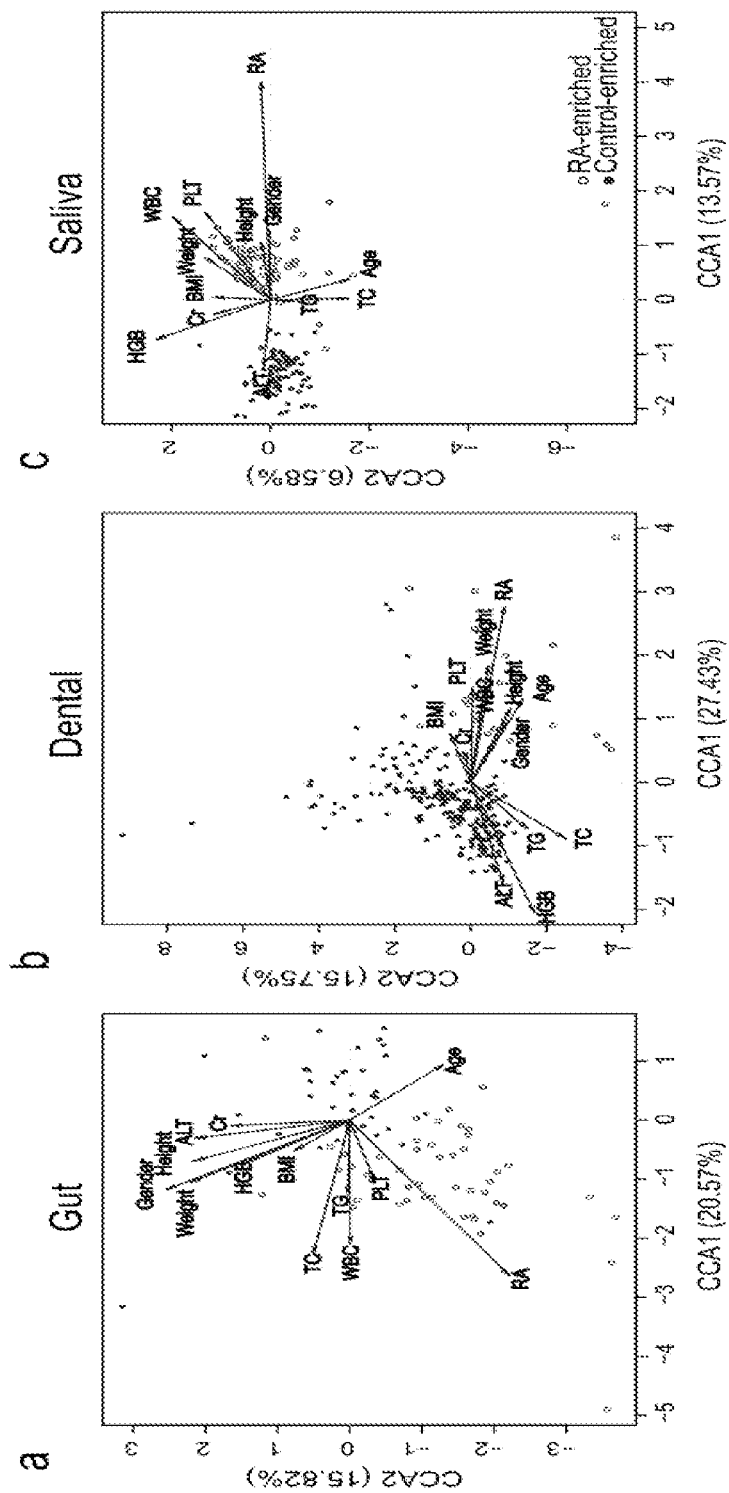
FIG. 2 illustrates analysis results for influence of phenotypes on gut, dental, and salivary metagenomic linkage groups (MLGs), according to an embodiment of the present teaching.

FIG. 2 illustrates analysis results for influence of phenotypes on gut, dental, and salivary MLGs, according to an embodiment of the present teaching. In this example, FIG. 2 shows CCA result for influence of phenotypes on the gut (a), dental (b) or salivary (c) MLGs. Categorical or continuous phenotypes missing in half of the samples were not analyzed. Solid points represent control-enriched MLGs, while hollow points represent RA-enriched MLGs. RA-enriched MLGs, e.g. *Clostridium asparagiforme*, *Bacteroides* sp. and *Lactobacillus* sp. (most related to *L. salivarius*, Table 2-1, Table 2-2) were correlated positively with the predominant antibody of the mucosal immune system, IgA, or with the major serum immunoglobulin, IgG.

Meanwhile, anaerobes such as *Lactobacillus salivarius*, *Atopobium* sp. and *Cryptobacterium curtum* were found in both the salivary and dental samples of the RA patients.

Assembly of more RA-relevant genomes is described as below. One can then assemble bacterial genomes directly from MLGs and its associated metagenomic sequencing reads using a software package in the SOAP (short oligonucleotide alignment program) family, e.g. SOAPMeta (patent application PCT/CN2012/079492, incorporated herein by reference). For *Lactobacillus* sp. (most related to *Lactobacillus salivarius*), the assembly was sufficiently complete after a single round of advanced assembly using data from a RA patient (Table 3), and showed colinearity with the *Lactobacillus salivarius* CECT (Coleccion Espanola de Cultivos Tipo) 5713 reference genome.

Figure 3:
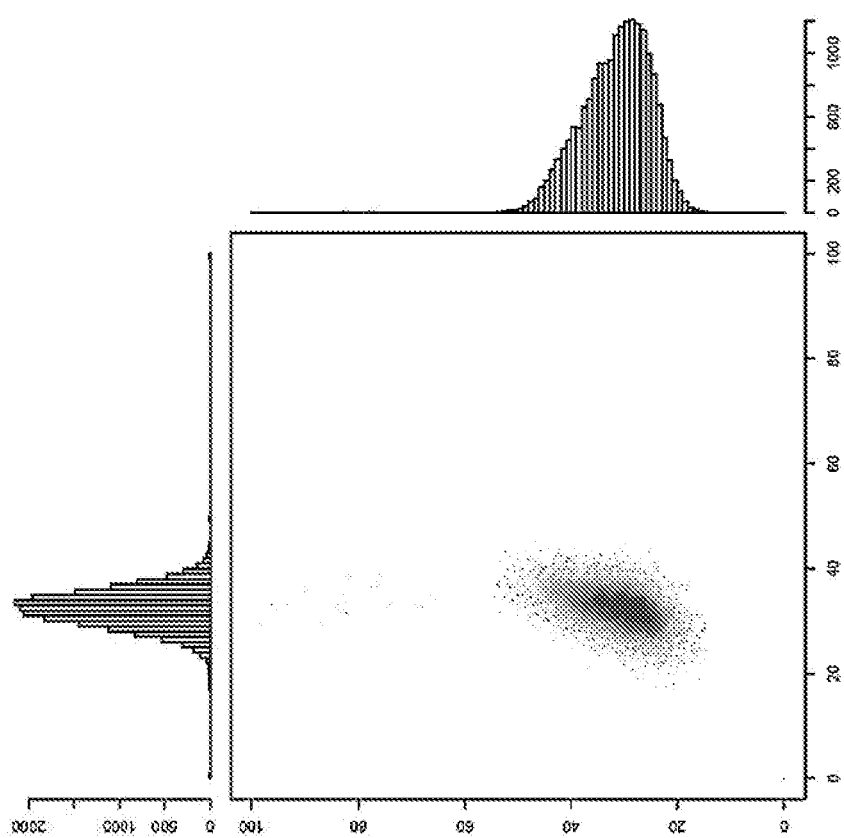
FIG. 3 shows a GC-depth graph for *Lactobacillus* sp. after advanced assembly, according to an embodiment of the present teaching.
Figure 4:
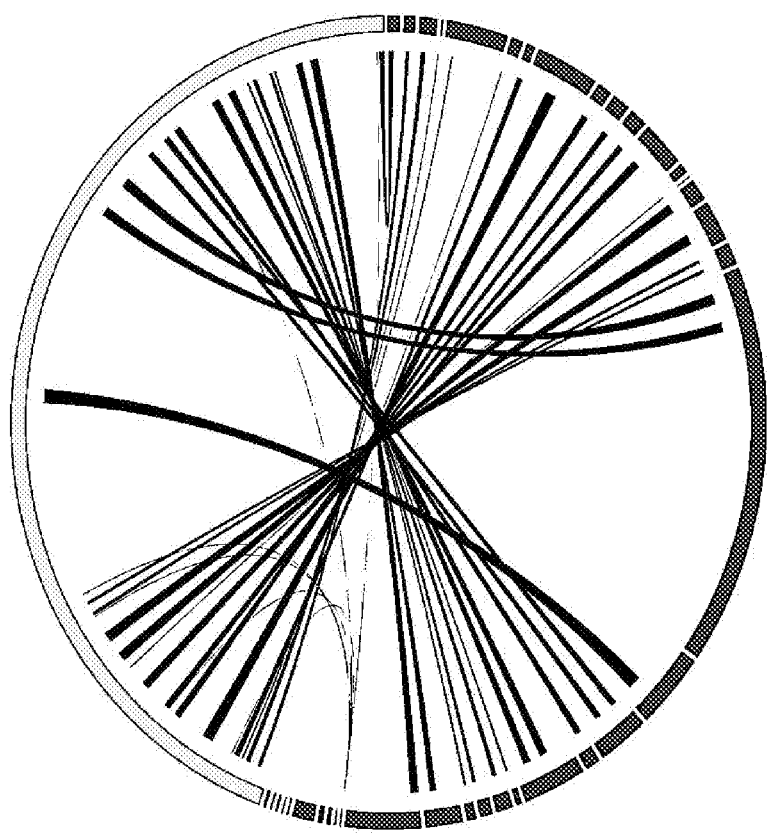
FIG. 4 shows co-linearity between an assembly and *Lactobacillus salivarius*, according to an embodiment of the present teaching.

FIG. 3 and FIG. 4 show *Lactobacillus* sp. draft genome. FIG. 3 shows a GC-depth graph for *Lactobacillus* sp. after advanced assembly, according to an embodiment of the present teaching. FIG. 4 shows co-linearity between the assembly (from sample D201) and the *Lactobacillus salivarius* CECT 5713 reference draft genome from NCBI (NC_017481.1), according to an embodiment of the present teaching. Functions encoded by the genome were largely similar to those in *Lactobacillus salivarius* CECT 5713 or other *Lactobacillus* strains, except that this RA-enriched *Lactobacillus* sp. encodes different cell wall modifications which might be recognized by the host immune system.

Concordance between the gut and oral microbiome is described as below. Despite differences between the gut and oral bacterial taxa associated with RA, *Lactobacillus salivarius* was consistently found to be enriched in the RA patients, the gut and salivary MLGs were positively correlated with IgG, and the dental *L. salivarius* showed the second highest odds ratio among all dental MLGs (Table 2-1). These results make them strong candidates as biomarkers for RA. Furthermore, *L. salivarius* was more abundant in very active (DAS28>5.1) RA cases compared to mild-to-moderately active (DAS28≤5.1) RA cases (Table 4, p=0.017, 0.036, 0.084 in feces, dental plaques and saliva, respectively, Wilcoxon rank-sum test), underscoring its potential for non-invasive prognosis.

According to an embodiment of the present disclosure, a biomarker for evaluating or diagnosing RA comprises a DNA sequence in a genome of *Lactobacillus salivarius*. According to various embodiments of the present disclosure, the biomarker for evaluating or diagnosing RA may comprise at least a partial sequence of SEQ ID NO: 1 to 593; SEQ ID NO: 594 to 1536; or SEQ ID NO: 1537 to 2594, as stated in Table 2-2. The sequence listing submitted herewith includes nucleotide and/or amino acid sequences corresponding to the above mentioned SEQ IDs.

Figure 5:
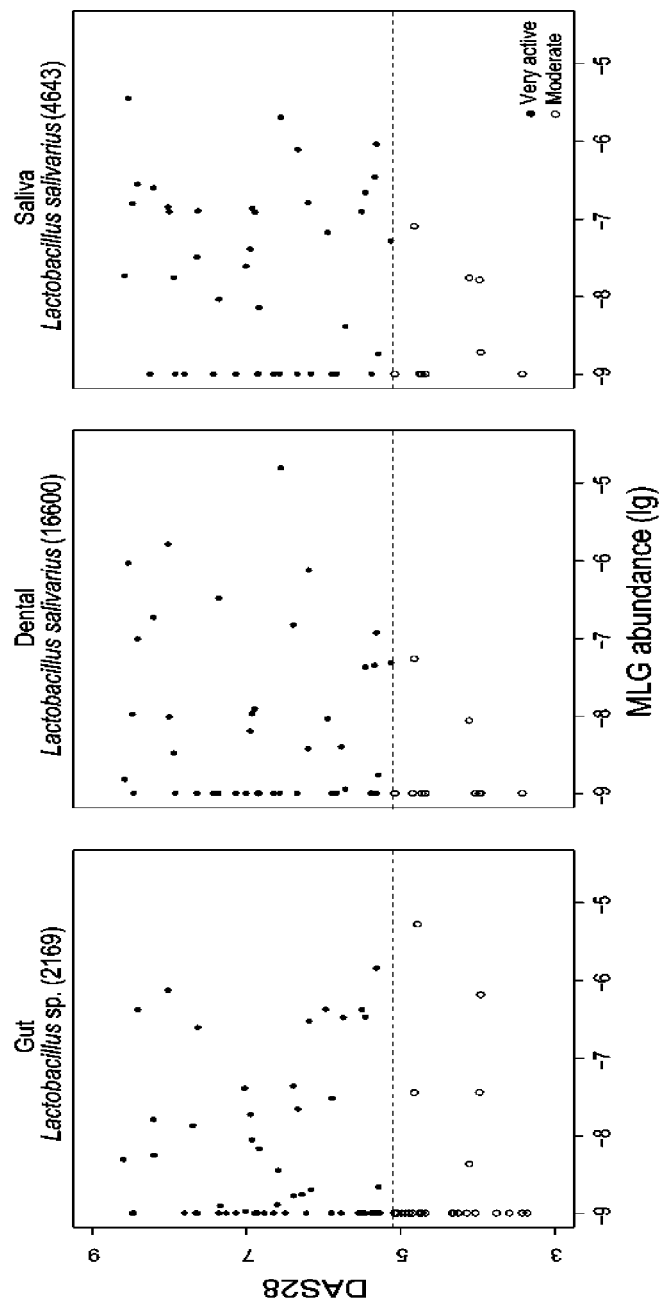
FIG. 5 shows patient stratification based on a RA-associated bacterium, according to an embodiment of the present teaching.

FIG. 5 shows patient stratification based on a RA-associated bacterium, according to an embodiment of the present teaching. Relative abundances of *Lactobacillus salivarius* MLGs in fecal, dental and salivary are plotted, and the difference between very active and moderately active RA cases is significant in the fecal and dental samples (p=0.017, 0.036, 0.084 respectively, Wilcoxon rank-sum test). MLG identification numbers are indicated in parentheses after the annotations. The disease classification followed the European League Against Rheumatism (EULAR) criterion, i.e. 3.2<DAS28≤5.1, moderate; DAS28>5.1, very active (Table 4).

One can compute correlations between the relative abundances of fecal, dental and salivary MLGs among samples (n=69). This may help to better understand the distribution of RA-associated bacteria across body sites. *L. salivarius* from the three sites (*Lactobacillus* sp. in the gut) showed positive correlation with each other (Table 5), confirming presence of the bacterium in multiple body sites.

If classification based on two sites was used to overrule the few misclassifications based on the other site, none of the subjects were misclassified except for one related control, highlighting the power of examining the microbiome at multiple sites (Table 6). Moreover, these results indicate that fecal, dental and salivary microbial markers could all be highly useful for the diagnosis and management of RA, while the dental microbiome (with probability of RA 0.94) might be more sensitive than the gut microbiome (with probability of RA 0.73).

Figure 6:
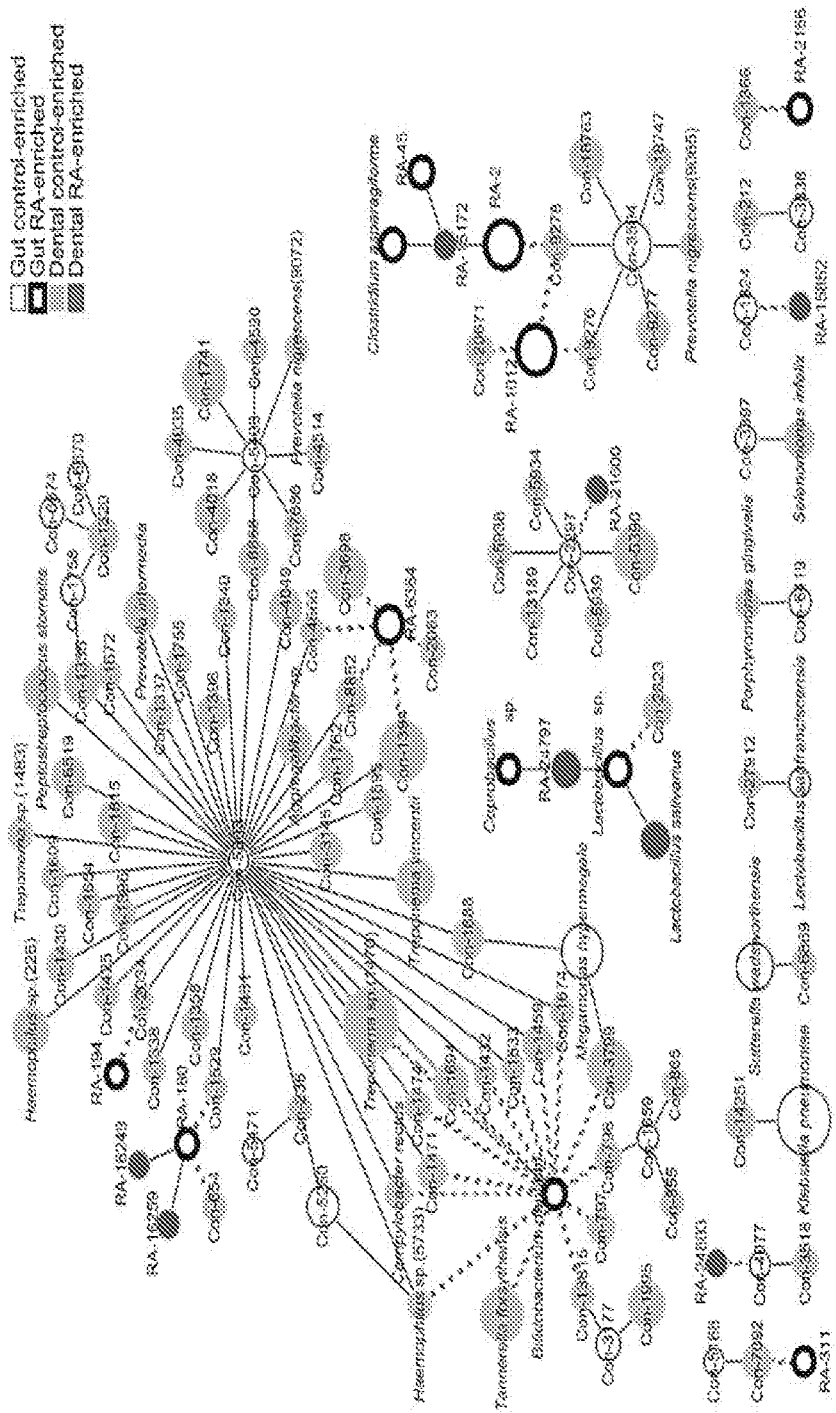
FIG. 6 shows correlations between the relative abundances of gut and dental MLGs, according to an embodiment of the present teaching.
Figure 7:
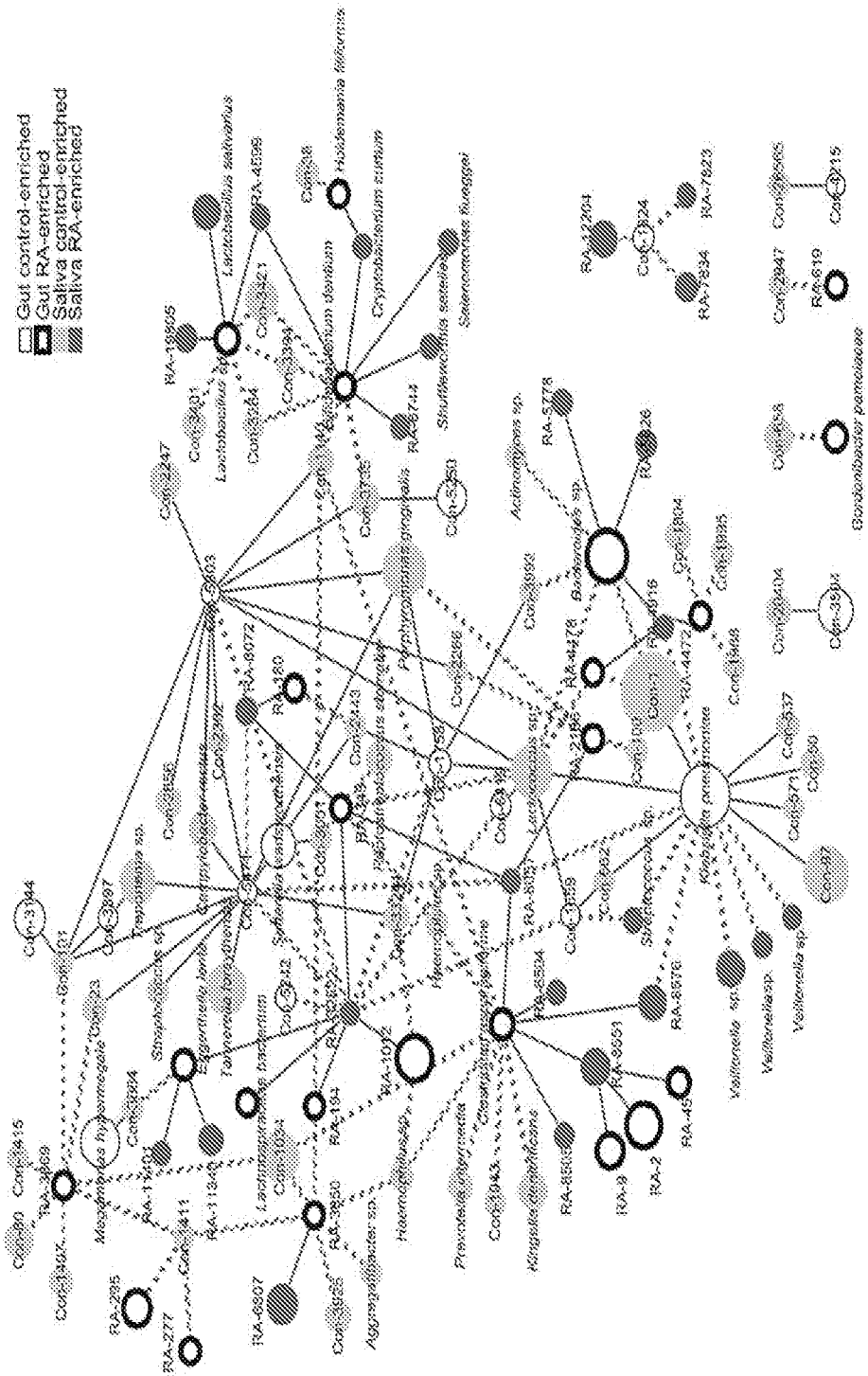
FIG. 7 shows correlations between the relative abundances of gut and salivary MLGs, according to an embodiment of the present teaching.
Figure 8:
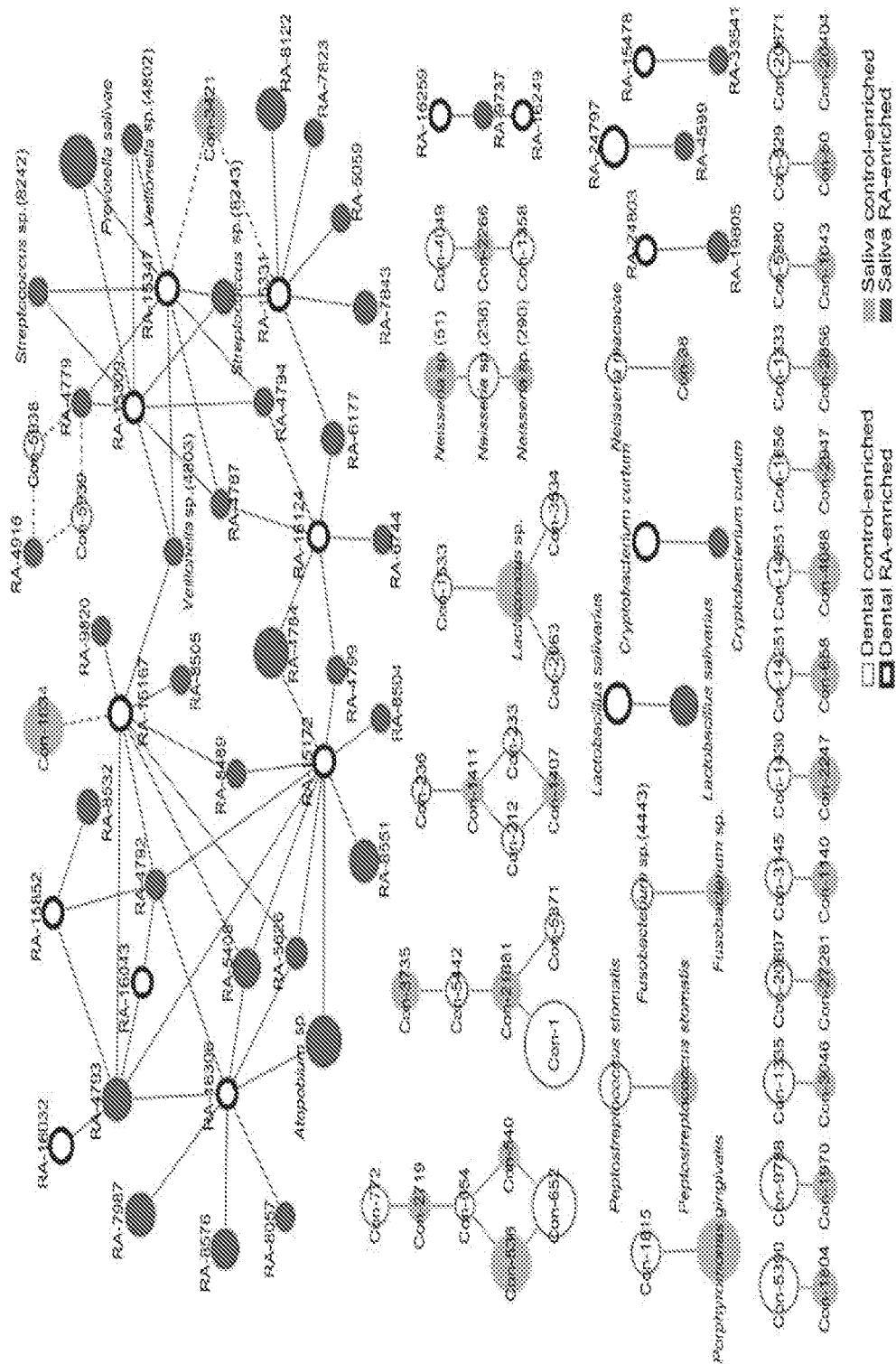
FIG. 8 shows correlations between the relative abundances of dental and salivary MLGs, according to an embodiment of the present teaching.

FIGS. 6-8 show correlation between gut and oral MLGs. FIG. 6 shows correlations between the relative abundances of gut and dental MLGs, according to an embodiment of the present teaching. FIG. 7 shows correlations between the relative abundances of gut and salivary MLGs, according to an embodiment of the present teaching. According to both FIG. 6 and FIG. 7, Spearman's correlation between the relative abundances of gut and dental or salivary MLGs (>100 genes) were calculated for subjects with the full set of fecal, dental and salivary samples (n=69). Similar correlations were observed using other measures, i.e. TIGRESS (Trustful Inference of Gene Regulation using Stability Selection), Boruta, CLR (Context Likelihood of Relatedness), Bicor (Biweight midcorrelation), MINE (Maximal Information Nonparametric Exploration). Size of the nodes reflects number of genes in each MLG. MLGs were colored according to body site and direction of enrichment. MLG identification numbers are listed in parentheses if more than one MLG annotated to the same species or unclassified species in a genus (sp.). Possible strain names are listed in Table 2-1 for all MLGs with more than 50% of genes annotated to the strain(s), even if the criteria for pinpointing a species or a genus has not been met. Solid lines (edges) represent Spearman's correlation coefficient (cc)>0.4, p<0.05; dotted lines (edges) represent cc<−0.4, p<0.05.

FIG. 8 shows correlations between the relative abundances of dental and salivary MLGs, according to an embodiment of the present teaching. In accordance with FIG. 8, MLGs were colored according to body site and direction of enrichment. MLG identification numbers are listed in parentheses if more than one MLG annotated to the same species or unclassified species in a genus (sp.). Possible strain names are listed in Table 2-1 for all MLGs with more than 50% of genes annotated to the strain(s), even if the criteria for pinpointing a species or a genus has not been met. Solid lines (edges) represent Spearman's correlation coefficient (cc)>0.6, p<0.05; dotted lines (edges) represent cc<−0.6, p<0.05.

Figure 9:
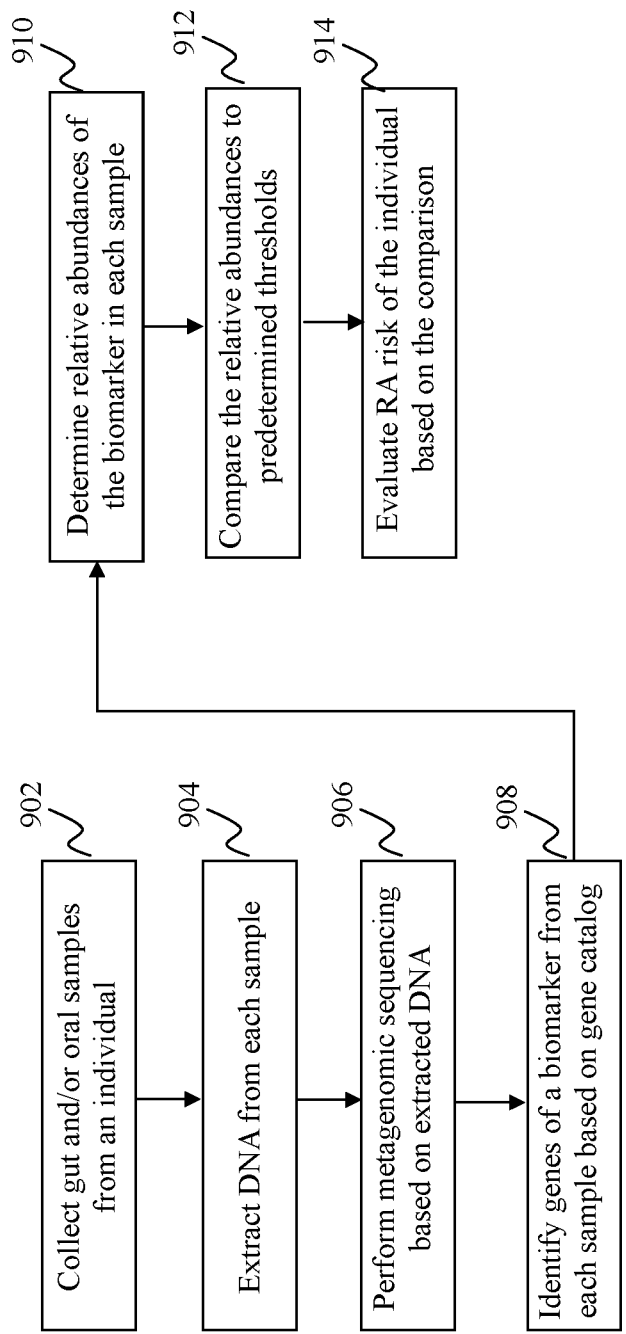
FIG. 9 shows a flowchart of an exemplary process in which a biomarker is utilized for evaluating RA risk, according to an embodiment of the present teaching.

FIG. 9 shows a flowchart of an exemplary process in which a biomarker is utilized for evaluating RA risk, according to an embodiment of the present teaching. First, gut and/or oral samples are collected at 902 from an individual to evaluate RA risk of the individual. The gut samples may include fecal samples, while the oral samples may include dental and salivary samples. DNA extraction is performed on each sample at 904. The extracted DNA is sequenced, e.g. by a metagenomic sequencing at 906, to obtain sequences of the DNA. In one embodiment, the sequences of the DNA may be obtained by polymerase chain reaction (PCR) with a primer that hybridizes to at least some of the DNA. In another embodiment, the sequences of the DNA may be obtained by using one or more probes that specifically recognize at least some of the DNA.

Then at 908, genes of a biomarker are identified from each sample based on gene catalog. For example, the biomarker may be RA-enriched MLGs, e.g. *Clostridium asparagiforme, Bacteroides* sp. and *Lactobacillus* sp. (most related to *L. salivarius*) and/or anaerobes such as *Lactobacillus salivarius, Atopobium* sp. and *Cryptobacterium curtum*. In one embodiment, *Lactobacillus salivarius* is a preferred biomarker for evaluating RA risk. The term "gene" as used in the present teaching may refer to any DNA sequence.

Relative abundances of the biomarker in each sample are determined at 910. For example, one can list genes of the biomarker among the sequences of the DNA in a sample in order of the genes' respective relative abundances. After removing the top 5% genes with highest relative abundance and the bottom 5% genes with lowest relative abundance, relative abundances of the remaining genes of the biomarker can be averaged or fit with a Poisson distribution to determine a relative abundance of the biomarker in the sample.

At 912, the relative abundances are compared to predetermined thresholds. A predetermined threshold may be associated with a type of sample, e.g. fecal, dental or salivary samples, and determined based on statistics analysis related to the biomarker. RA risk of the individual is evaluated based on the comparisons at 914. For example, as *L. salivarius* is more abundant in very active (DAS28>5.1) RA cases compared to mild-to-moderately active (DAS28≤5.1) RA cases, the threshold may be set as a relative abundance of *L. salivarius* that corresponds to DAS28=5.1. Then, RA risk of the individual is high if the relative abundance of the *L. salivarius* is higher than the threshold. In another embodiment, the relative abundances of different types of samples may be combined to evaluate RA risk.

Various exemplary thresholds of MLG relative abundance for classification are listed in Table 6, for different types of samples. When MLG relative abundance is larger than the threshold, the person is at risk of RA.

In another embodiment, RA risk can be evaluated based on a classifier that is generated based on a training set. For a given relative abundance of a biomarker, the classifier can indicate a probability of an individual having RA. The training set may comprise relative abundances of the biomarker in samples from a plurality of subjects having RA and a plurality of subjects not having RA. The classifier may be generated based on a Multivariate statistical model, e.g. a randomForest model. For example, for a certain relative abundance of a biomarker, a corresponding probability of RA can be determined based on the classifier. Then, the RA risk of the individual can be evaluated based on the probability. For example, the probability greater than a predetermined threshold indicates that the subject has or is at risk of having RA.

DMARD treatment's modification of the RA microbiome is described as below. One may compute MLGs before and after treatment (for 3 months, except for 6 samples) in fecal samples from 40 individuals (Table 1-3). This may help to examine whether the treatment by DMARD restores a healthy microbiome. Most of the patients received the anchor drug methotrexate (MTX), the traditional Chinese medicinal component *Tripterygium wilfordii* (thunder god vine) glycosides (T2), or both (MTX+T2) as DMARD. Before-treatment or RA-enriched MLGs such as BDM-3355 (BDM, Before DMARD) and *Bacteroides* sp. (with motifs similar to collagen XI and HLA-DR4/1) were more diminished after treatment with T2 than with MTX or MTX+T2, while after-treatment-enriched MLGs such as ADM-2636 (most related to *Escherichia coli*) and ADM-2944 (ADM, After DMARD) were more increased after T2. But the use of MTX or MTX+T2 may be better in other aspects, e.g. higher levels of *Bacteroides caccae* and *Haemophilus* sp. These data can indicate that different DMARD modulates the gut microbiome differently, and may suggest that surveying the gut microbiome would help optimize the choice of DMARD and auxiliary therapies.

DMARD treatment showed promising modulation of the oral microbiome as well, with some of the control-enriched dental or salivary MLGs e.g. *Aggregatibacter* sp. over-represented in patients with good response compared to those with moderate or no improvement. Control-enriched dental MLGs such as Con-16138, *Prevotella intermedia* were most abundant in patients treated with MTX+T2 compared to T2 alone or MTX alone, while RA-9938, RA-10684 and RA-9998 were most reduced in patients treated with MTX alone. Differential modulations of RA- or control-associated MLGs by MTX, MTX+T2 or T2 were also observed in the saliva samples. Notably, no significant difference in *Lactobacillus salivarius* was detected in any of the above-mentioned comparisons, indicating that the gut and oral microbiome were still not exactly healthy after treatment. Thus, both the gut and the oral microbiome respond partially to DMARD and should be managed according to the severity of RA and the DMARD of choice.

Figure 10:
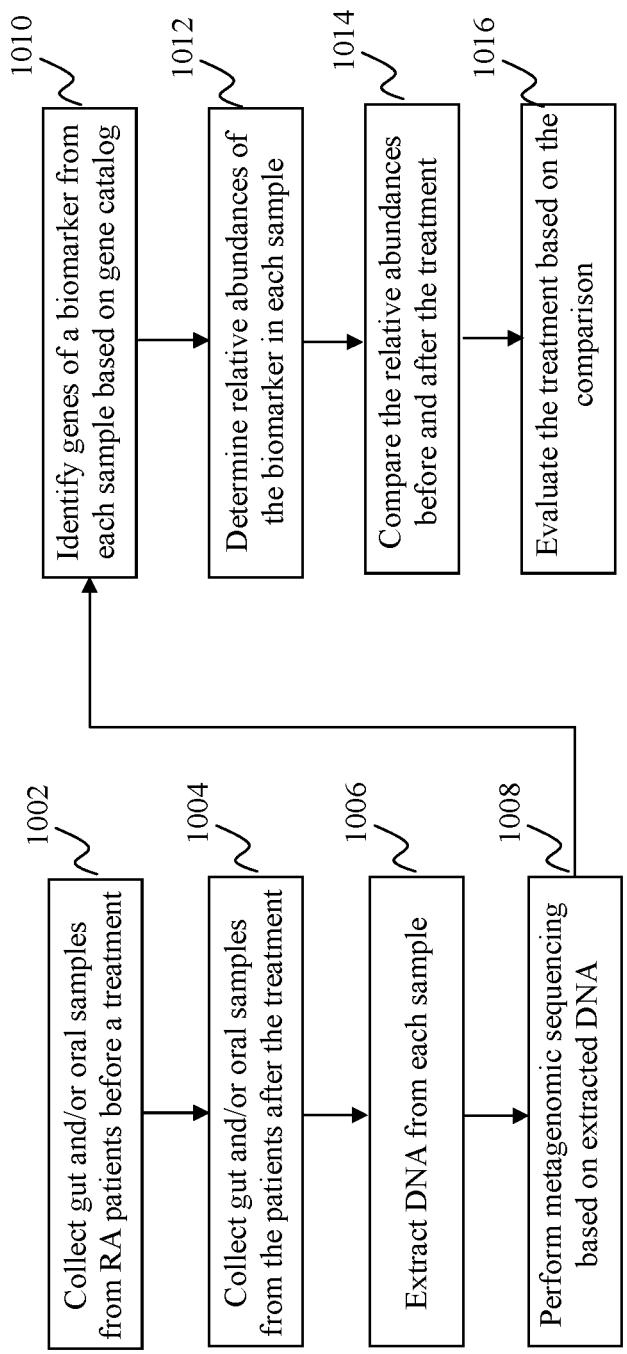
FIG. 10 shows a flowchart of an exemplary process in which a biomarker is utilized for evaluating a treatment regarding RA, according to an embodiment of the present teaching.

FIG. 10 shows a flowchart of an exemplary process in which a biomarker is utilized for evaluating a treatment regarding RA, according to an embodiment of the present teaching. First, gut and/or oral samples are collected at 1002 from RA patients before a treatment. The gut samples may include fecal samples, while the oral samples may include dental and salivary samples. As discussed before, the treatment may be a DMARD treatment like MTX, T2, or MTX+T2, or may be any treatment regarding RA. At 1004, gut and/or oral samples are collected from the same RA patients after they receive treatment. DNA extraction is performed on each sample at 1006. The extracted DNA is sequenced at 1008, e.g. by a metagenomic sequencing, to obtain sequences of the DNA. In one embodiment, the sequences of the DNA may be obtained by PCR with a primer that hybridizes to at least some of the DNA. In another embodiment, the sequences of the DNA may be obtained by using one or more probes that specifically recognize at least some of the DNA.

Then at 1010, genes of a biomarker are identified from each sample based on gene catalog. For example, the biomarker may be RA-enriched MLGs, e.g. *Clostridium asparagiforme*, *Bacteroides* sp. and *Lactobacillus* sp. (most related to *L. salivarius*) and/or anaerobes such as *Lactobacillus salivarius*, *Atopobium* sp. and *Cryptobacterium curtum*. In one embodiment, *Lactobacillus salivarius* is a preferred biomarker for evaluating a treatment regarding RA.

Relative abundances of the biomarker in each sample are determined at 1012. For example, one can list genes of the biomarker in a sample in order of their respective relative abundances. After removing the top 5% genes with highest relative abundance and the bottom 5% genes with lowest relative abundance, relative abundances of the remaining genes of the biomarker can be averaged or fit with a Poisson distribution to determine a relative abundance of the biomarker in the sample. This may be performed for samples before and after the treatment.

At 1014, one can compare the relative abundances of the biomarker before and after the treatment for each RA patient. For example, the relative abundances of *L. salivarius* in a same type of sample (e.g. fecal, dental or salivary samples) may be determined both before a RA patient receives the treatment and after the RA patient receives the treatment. Then, the relative abundances before and after the treatment may be compared to see whether *L. salivarius* is less abundant after the treatment. If so, the treatment shows some effect at least on this patient. Similar comparisons can be performed on all RA patients with collected samples.

The treatment is then evaluated based on the comparison(s) at 1016. For example, for all RA patients in evaluation, the relative abundances of *L. salivarius* before and after the treatment can be compared to see whether *L. salivarius* is less abundant after the treatment. In one embodiment, if relative abundance of *L. salivarius* is reduced after the treatment for more than a given percentage of the RA patients, the treatment may be determined to be effective. In another embodiment, if the average relative abundance of *L. salivarius* among the RA patients decreases by a given number after the treatment, the treatment may be determined to be effective.

In another embodiment, a treatment regarding RA may be evaluated merely based on the sample collected from the RA patients after the treatment. In that case, the relative abundances of the biomarker, e.g. *L. salivarius*, can be calculated for all patients after the treatment. Then, the relative abundances can be compared with a predetermined threshold to determine whether the treatment brings down the relative abundance of the biomarker to a safe range that indicates no or low RA risk. If so, the treatment may be evaluated as effective. The treatment may also be evaluated with a classifier.

In accordance with various embodiments, a biomarker, e.g. *L. salivarius*, may have different uses. The present disclosure includes but not limited to: *L. salivarius* for use as a biomarker; *L. salivarius* for use as a measurable indicator of RA; *L. salivarius* for use of evaluating or predicting risk of RA in a subject; *L. salivarius* for use of diagnosing RA in a subject; and *L. salivarius* for use of evaluating a treatment regarding a disease, e.g. RA.

In one example, a biomarker may be used for evaluating or predicting risk of RA in a subject to be tested. A sample is collected from the subject. DNA is extracted from the sample. Sequences of the DNA are obtained. Then, a relative abundance of the biomarker is calculated based on the sequences of the DNA. The biomarker may comprise a DNA sequence in a genome of *Lactobacillus salivarius*. A probability of the subject having a disease can be obtained based on the relative abundance. The risk of RA in the subject may be evaluated or predicted based on the probability.

In another example, a biomarker may be used for evaluating a treatment regarding a disease, e.g. RA. For each subject of a plurality of subjects having the disease, a sample from the subject is collected after the subject receives the treatment. DNA is extracted from the sample. Sequences of the DNA are obtained. Then, a relative abundance of the biomarker is calculated based on the sequences of the DNA. The biomarker may comprise a DNA sequence in a genome of *Lactobacillus salivarius*. The treatment may be evaluated based on the relative abundances calculated for the plurality of subjects.

In yet another example, a biomarker may be used for evaluating a treatment regarding a disease, e.g. RA. For each subject of a plurality of subjects having the disease, a first sample is collected from the subject before the subject receives the treatment, and a second sample is collected from the subject after the subject receives the treatment. A first relative abundance of a biomarker is calculated based on the first sample. A second relative abundance of the biomarker is calculated based on the second sample. The biomarker comprises a DNA sequence in genome of *Lactobacillus salivarius*. The treatment may then be evaluated based on the first relative abundances and the second relative abundances calculated for the plurality of subjects.

According to an embodiment of the present disclosure, a biomarker for evaluating a treatment regarding a disease, e.g. RA, comprises a DNA sequence in a genome of *Lactobacillus salivarius*. According to various embodiments of the present disclosure, the biomarker for evaluating a treatment regarding a disease, e.g. RA, may comprise at least a partial sequence of SEQ ID NO: 1 to 593; SEQ ID NO: 594 to 1536; or SEQ ID NO: 1537 to 2594, as stated in Table 2-2. The sequence listing submitted herewith includes nucleotide and/or amino acid sequences corresponding to the above mentioned SEQ IDs.

Although explanatory embodiments have been shown and described, it would be appreciated by those skilled in the art that the above embodiments cannot be construed to limit the present disclosure, and changes, alternatives, and modifications can be made in the embodiments without departing from spirit, principles and scope of the present disclosure.

TABLE 1-1

Samples used for gene catalog construction

| Group | | case | control | total number |
|---|---|---|---|---|
| Samples used for gene catalog construction | fecal samples | 115 (including 21 from DMARD-treated patients) | 97 | 212 |
| | dental plaques samples | 54 | 51 | 105 |
| | saliva samples | 51(including 4 from DMARD-treated patients) | 47 | 98 |

TABLE 1-2

Sample information of training sets (chosen from samples used for gene catalog construction in Table 1-1)

| Group | | case | control | total number |
|---|---|---|---|---|
| Training sets | fecal samples | 77 | 80 | 157 |
| | dental plaques samples | 50 | 50 | 100 |
| | saliva samples | 47 | 47 | 94 |

TABLE 1-3

Sample information of test sets

| Group | | case | control | total number |
|---|---|---|---|---|
| Test sets | fecal samples | 17 | 17 | 34 |
| | fecal samples | 40(DMARD-treated patients) | — | 40 |
| | dental plaques samples | 37(DMARD-treated patients) | — | 37 |
| | saliva samples | 24(DMARD-treated patients) | — | 24 |

TABLE 2-1 fecal, dental and salivary MLGs

| | gut MLG | dental MLG | salivary MLG |
|---|---|---|---|
| MLG ID | 2169 | 16600 | 4643 |
| P-value | 1.16E−03 | 2.13E−04 | 5.72E−04 |
| Enrichment (1, case; 0, control) | 1 | 1 | 1 |
| Gene number (>=30) | 593 | 943 | 1058 |
| Case occurrence | 0.44 | 0.48 | 0.61 |
| Control occurrence | 0.21 | 0.18 | 0.28 |
| Abundance mean in all cases | 1.40E−07 | 3.67E−07 | 1.91E−07 |
| Abundance mean in all controls | 8.50E−08 | 4.79E−09 | 4.72E−08 |
| Abundance mean in cases that contained the MLG | 3.16E−07 | 7.63E−07 | 3.14E−07 |
| Abundance mean in controls that contained the MLG | 4.00E−07 | 2.71E−08 | 1.71E−07 |

TABLE 2-1-continued fecal, dental and salivary MLGs

|  | gut MLG | dental MLG | salivary MLG |
|---|---|---|---|
| Odds Ratio (95% CI) | 1.09 (0.78, 1.52) | 222562231.41 (0.02, 2859615161906952192) | 1.93 (0.73, 5.07) |
| MLG annotation (95% identity for species, 85% identity for genus) | Lactobacillus sp. | Lactobacillus salivarius | Lactobacillus salivarius |
| Possible strain 1 | Lactobacillus salivarius CECT 5713 | Lactobacillus salivarius CECT 5713 | Lactobacillus salivarius CECT 5713 |
| # genes annotated to strain (65% identity) | 504 | 897 | 988 |
| Fraction genes annotated to strain | 0.850 | 0.951 | 0.934 |
| Average identity (%) | 98.78 | 99.81 | 99.81 |
| Possible strain 2 | Lactobacillus salivarius ACS-116-V-Col5a | Lactobacillus salivarius UCC118 | Lactobacillus salivarius ACS-116-V-Col5a |
| # genes annotated to strain (65% identity) | 499 | 750 | 818 |
| Fraction genes annotated to strain | 0.841 | 0.795 | 0.773 |
| Average identity (%) | 98.69 | 98.92 | 98.99 |
| Possible strain 3 | Lactobacillus salivarius HO66, ATCC 11741 | Lactobacillus salivarius ACS-116-V-Col5a | Lactobacillus salivarius UCC118 |
| # genes annotated to strain (65% identity) | 490 | 741 | 809 |
| Fraction genes annotated to strain | 0.826 | 0.786 | 0.765 |
| Average identity (%) | 98.64 | 98.98 | 98.97 |

TABLE 2-2

SEQ ID of the fecal, dental and salivary MLGs

| MLG ID | SEQ ID NO: | gene number |
|---|---|---|
| mlg_id: 2169 | 1~593 | 593 |
| mlg_id: 16600 | 594~1536 | 943 |
| mlg_id: 4643 | 1537~2594 | 1058 |

TABLE 3

Statistics of the Lactobacillus sp. assemblies.

| Assembly | scaftigs | Total length (bp) | gaps | Average length (bp) | N50 (bp) | N90 (bp) | Max (bp) | Min (bp) | GC content (%) |
|---|---|---|---|---|---|---|---|---|---|
| Before | 42 | 1916673 | NA | 45635.07 | 109309 | 24416 | 332613 | 622 | 32.59 |
| Loop 1 | 46 | 1929732 | 333 | 41950.7 | 109513 | 24424 | 327455 | 225 | 32.62 |
| Loop 2 | 48 | 1960062 | 707 | 40834.6 | 109613 | 24415 | 660567 | 203 | 32.66 |
| Corrected | 46 | 1929666 | 0 | 41949.3 | 109513 | 24424 | 327432 | 225 | 32.62 |

TABLE 4

Relative abundances of Lactobacillus salivarius MLGs in fecal, dental and salivary samples

| Relative abundances in fecal samples | | | Relative abundances in dental samples | | | Relative abundances in salivary samples | | |
|---|---|---|---|---|---|---|---|---|
| fecal-Sample | Abundance(lg10) | DAS28 | Dental-Sample | Abundance(lg10) | DAS28 | Saliva-Sample | Abundance(lg10) | DAS28 |
| D98 | −9 | 7.79868052 | D100 | −9 | 3.42175802 | D100 | −9 | 3.421758017 |
| D93 | −6.611867753 | 7.6226307 | D102 | −9 | 4.8480466 | D104 | −5.453765687 | 8.529890674 |
| D90 | −6.191158497 | 3.96041196 | D104 | −6.040186126 | 8.52989067 | D108 | −6.806143016 | 8.473621894 |
| D86 | −8.057385587 | 6.92415126 | D108 | −7.980872312 | 8.47362189 | D113 | −9 | 4.729856872 |
| D82 | −9 | 7.13190469 | D113 | −9 | 4.72985687 | D114 | −9 | 6.853552298 |
| D80 | −9 | 6.76503311 | D114 | −9 | 6.8535523 | D117 | −9 | 7.920189059 |
| D79 | −9 | 4.0279844 | D117 | −9 | 7.92018906 | D118 | −6.042913878 | 5.312956797 |
| D77 | −7.366135759 | 6.39025936 | D118 | −6.934469737 | 5.3129568 | D121 | −9 | 6.642354428 |
| D73 | −6.383737346 | 8.40886812 | D121 | −9 | 6.64235443 | D122 | −6.91342831 | 7.996274077 |
| D69 | −9 | 5.37571817 | D122 | −8.016378923 | 7.99627408 | D124 | −9 | 6.340241035 |

TABLE 4-continued

Relative abundances of *Lactobacillus salivarius* MLGs in fecal, dental and salivary samples

| Relative abundances in fecal samples | | | Relative abundances in dental samples | | | Relative abundances in salivary samples | | |
|---|---|---|---|---|---|---|---|---|
| fecal-Sample | Abundance(lg10) | DAS28 | Dental-Sample | Abundance(lg10) | DAS28 | Saliva-Sample | Abundance(lg10) | DAS28 |
| D64 | −9 | 5.54410235 | D124 | −9 | 6.34024104 | D126 | −8.389174221 | 5.713773541 |
| D60 | −7.445724768 | 3.97640265 | D126 | −8.948624905 | 5.71377354 | D130 | −7.289872807 | 5.123969264 |
| D57 | −7.796649862 | 8.19776002 | D130 | −7.319871381 | 5.12396926 | D132 | −6.917376771 | 6.888682261 |
| D55 | −6.528149782 | 6.18476371 | D132 | −7.914671086 | 6.88868226 | D133 | −6.112482915 | 6.330335876 |
| D53 | −7.734095793 | 6.94704402 | D144 | −8.481614523 | 7.94002895 | D135 | −9 | 6.155991353 |
| D44 | −6.382198292 | 5.50022386 | D145 | −7.353369588 | 5.33562662 | D144 | −7.761404179 | 7.940028946 |
| D41 | −6.133536313 | 8.01285296 | D147 | −4.810120267 | 6.54878405 | D145 | −6.463645065 | 5.335626622 |
| D33 | −9 | 8.46060172 | D15 | −9 | 7.0018003 | D147 | −5.698438864 | 6.548784045 |
| D31 | −9 | 5.31457462 | D150 | −9 | 7.42699601 | D15 | −7.613225033 | 7.001800303 |
| D29 | −9 | 5.07110729 | D157 | −8.403261181 | 5.77013589 | D150 | −9 | 7.426996005 |
| D264 | −7.876604295 | 7.68636877 | D158 | −6.48957812 | 7.3559855 | D158 | −8.036378515 | 7.3559855 |
| D255 | −9 | 3.35880461 | D166 | −9 | 4.68402861 | D166 | −9 | 4.684028613 |
| D246 | −9 | 5.50895943 | D172 | −9 | 6.56338253 | D172 | −9 | 6.56338253 |
| D235 | −9 | 5.36245034 | D177 | −8.062208673 | 4.11058331 | D173 | −9 | 4.753267564 |
| D226 | −9 | 3.75826991 | D178 | −9 | 5.89379791 | D177 | −7.764858329 | 4.110583305 |
| D225 | −9 | 5.26730818 | D179 | −7.377381185 | 5.45372598 | D178 | −9 | 5.893797906 |
| D220 | −8.256023129 | 8.19234 | D182 | −9 | 7.6346388 | D179 | −6.666584727 | 5.453725981 |
| D219 | −9 | 4.33281686 | D185 | −7.268685456 | 4.82480113 | D182 | −7.495572436 | 7.634638802 |
| D218 | −9 | 4.9372116 | D188 | −9 | 6.83496525 | D185 | −7.098613687 | 4.824801134 |
| D216 | −8.891583288 | 6.59381524 | D190 | −8.76674422 | 5.2882132 | D188 | −8.143731806 | 6.834965253 |
| D213 | −9 | 4.25625778 | D23 | −9 | 7.36348085 | D190 | −8.742451499 | 5.288213199 |
| D212 | −9 | 4.89075966 | D25 | −9 | 6.85099036 | D25 | −9 | 6.850990358 |
| D210 | −8.979008268 | 7.00624114 | D29 | −9 | 5.07110729 | D41 | −6.853197457 | 8.01285296 |
| D209 | −9 | 4.31299239 | D31 | −9 | 5.31457462 | D43 | −6.797317376 | 6.197520423 |
| D208 | −6.483913355 | 5.745 | D33 | −9 | 8.46060172 | D44 | −6.910799717 | 5.500223864 |
| D206 | −9 | 7.25794987 | D41 | −5.796743841 | 8.01285296 | D51 | −9 | 6.847803418 |
| D205 | −9 | 7.6508574 | D43 | −8.428210194 | 6.19752042 | D53 | −7.390874351 | 6.947044019 |
| D204 | −9 | 4.1459103 | D51 | −9 | 6.84780342 | D57 | −6.60695896 | 8.197760021 |
| D202 | −9 | 7.63088447 | D53 | −8.198886903 | 6.94704402 | D60 | −7.791470779 | 3.976402649 |
| D201 | −5.283022546 | 4.78379104 | D55 | −6.129609376 | 6.18476371 | D62 | −7.180662842 | 5.942224198 |
| D197 | −9 | 5.04328483 | D57 | −6.738165176 | 8.19776002 | D69 | −9 | 5.375718166 |
| D196 | −9 | 5.45729602 | D60 | −9 | 3.97640265 | D73 | −6.556695801 | 8.408868116 |
| D195 | −7.523916323 | 5.88705343 | D62 | −8.039281704 | 5.9422242 | D82 | −9 | 7.131904686 |
| D194 | −9 | 5.07491254 | D69 | −9 | 5.37571817 | D86 | −6.868622111 | 6.924151262 |
| D191 | −6.376571261 | 5.96637345 | D73 | −7.012094288 | 8.40886812 | D8_N | −9 | 5.073854483 |
| D190 | −8.662513207 | 5.2882132 | D77 | −6.835456013 | 6.39025936 | D9 | −7.736997083 | 8.574788032 |
| D188 | −8.169182242 | 6.83496525 | D79 | −9 | 4.0279844 | D90 | −8.720697158 | 3.960411962 |
| D187 | −8.31142368 | 8.59106614 | D82 | −9 | 7.13190469 | D93 | −6.901748442 | 7.6226307 |
| D185 | −7.45074993 | 4.82480113 | D86 | −7.974661284 | 6.92415126 | D94 | −9 | 5.82920269 |
| D184 | −9 | 3.58951489 | D89 | −9 | 5.377 | D98 | −9 | 7.798680516 |
| D179 | −6.478104047 | 5.45372598 | D8_N | −9 | 5.07385448 | D99 | −9 | 8.242071089 |
| D178 | −9 | 5.89379791 | D9 | −8.822539013 | 8.57478803 | | | |
| D177 | −8.36954905 | 4.11058331 | D90 | −9 | 3.96041196 | | | |
| D174 | −8.450552033 | 6.58470347 | D94 | −9 | 5.82920269 | | | |
| D173 | −9 | 4.75326756 | | | | | | |
| D169 | −7.394270982 | 7.01915442 | | | | | | |
| D168 | −8.77581245 | 6.38421883 | | | | | | |
| D166 | −9 | 4.68402861 | | | | | | |
| D163 | −9 | 4.9850232 | | | | | | |
| D159 | −8.762169575 | 6.28026633 | | | | | | |
| D158 | −9 | 7.3559855 | | | | | | |
| D157 | −9 | 5.77013589 | | | | | | |
| D153 | −9 | 6.21962859 | | | | | | |
| D141 | −9 | 6.49456205 | | | | | | |
| D138 | −8.908362017 | 7.33999124 | | | | | | |
| D135 | −8.697956283 | 6.15599135 | | | | | | |
| D134 | −9 | 4.75253438 | | | | | | |
| D133 | −7.661497584 | 6.33033588 | | | | | | |
| D132 | −9 | 6.88868226 | | | | | | |
| D121 | −9 | 6.64235443 | | | | | | |
| D118 | −5.847384965 | 5.3129568 | | | | | | |
| D114 | −9 | 6.8535523 | | | | | | |
| D113 | −9 | 4.72985687 | | | | | | |
| D108 | −9 | 8.47362189 | | | | | | |
| D102 | −9 | 4.8480466 | | | | | | |
| D100 | −9 | 3.42175802 | | | | | | |

TABLE 5

Spearman's correlation and best matched strain for *Lactobacillus salivarius*-like MLGs from the gut and oral sites. (Strain information as in Table 2-1.)

| | Species of interest *L. salivarius* | | |
|---|---|---|---|
| MLG ID | gut 2169 | saliva 4643 | saliva 4643 |
| MLG ID | dental 16600 | dental 16600 | gut 2169 |
| Spearman's cc | 0.5634221 | 0.8238949 | 0.7096382 |
| p-value | 4.65E−07 | 3.51E−18 | 8.73E−12 |
| MLG ID | gut 2169 | saliva 4643 | saliva 4643 |
| # genes | 593 | 1058 | 1058 |
| Possible strain 1 | *Lactobacillus salivarius* CECT 5713 | *Lactobacillus salivarius* CECT 5713 | *Lactobacillus salivarius* CECT 5713 |
| Genes annotated to strain (65% identity) | 504 | 988 | 988 |
| Fraction of genes annotated | 0.850 | 0.934 | 0.934 |
| Average identity (%) | 98.78 | 99.81 | 99.81 |
| MLG ID | dental 16600 | dental 16600 | gut 2169 |
| # genes | 943 | 943 | 593 |
| Possible strain 1 | *Lactobacillus salivarius* CECT 5713 | *Lactobacillus salivarius* CECT 5713 | *Lactobacillus salivarius* CECT 5713 |
| Genes annotated to strain (65% identity) | 897 | 897 | 504 |
| Fraction of genes annotated | 0.951 | 0.951 | 0.850 |
| Average identity (%) | 99.81 | 99.81 | 98.78 |

TABLE 6 classification results of fecal, dental and salivary MLGs in the 69 samples

| classification | gut sample | dental sample | saliva sample | combination of 3 sits samples |
|---|---|---|---|---|
| threshold* of MLG relative abundance for classification | >1.175e−9 | >5.326e−9 | >8.095e−10 | gut sample >1.175e−9, dental sample >5.326e−9 and saliva sample >8.095e−10 |
| total number over the threshold | 26 | 17 | 32 | 13 |
| RA number in total number | 19 | 16 | 23 | 12 |
| probability of RA (RA number/total number) | 0.730769231 | 0.941176471 | 0.71875 | 0.923076923 |

*When MLG relative abundance is larger than the threshold, the person is in risk of RA.

SEQUENCE LISTING (2594 sequences)

SEQ ID NO: 1 - DNA, 1101 bp, Lactobacillus salivarius
  isolated from gut, Lactobacillus salivarius
atggcattaacagcaggtattgttggcttacctaacgttggtaaatcaacattgtttaacgcaattacaaaagcaggagcagaaatggcaaactatccatttgctacaatcgatcctaacgtagggatggttgaagtaccagatagtcgtttagcaagaattgatgaaattattcctgctaagaagattgtacatacaacttttgaatttactgatattgcgggaatcgtaaaaggtgctagcaaaggtgaaggtttaggaaacaagttcttggaaaatatccgtcaagtagacgcgattgttcatgtggtacgtgcttttgacgatgataatattacacacgtggcaaacaaagttgatcctttggaagatattgatactatcaacatggaattaactttagctgacttggaatctgtaaataaacgttatgctagagtagaaaaagttgctcgtactaaggataaagatgctgtggctgaatttgcagttttacaaaaaattaagccagttcttgaagaaggtaagccagttcgtagtattgaattcaacgatgaagaaaagaagattgttaagggcttattcttattgacttctaagccagtattatatgtggcaaacattgccgaagaagatatggcagatccagaacaaagcgaatactaccaacaagttaagaagttcgcagaagatgaaggttctcaagcattagctgtatctgcaagaactgaagaagaaattgctgaacttcctgatgatgaaaagcaagaattcttagaagctgaaggtgtagaagaatcaggtttagaccgtttaattcgtgcttcttacaagttattgggtctagcaacattcttcactgctggtggtaaagaaactcgtgcatggacatttaagcgtggtatgaaagcacctcaagttgcaggggttatccactctgactttgaacgtggatttattcgtgcagaaaccgtttctttcgatgatttggataagtacggcagtatgcaagctgttaaagaagctggtagattgcgtcttgaaggtaaggaatacgaagttcaagacggtgatattatcgaatttagatttaacgtctaa

SEQ ID NO: 2 - DNA, 1188 bp, Lactobacillus salivarius
  isolated from gut, Lactobacillus salivarius
atggctaaagaacattacgaaagaacaaaaccccatgtaaacatcggtacaatcggacacgttgaccatgggaaaacaactttaacagcagcaattacaaaggttttggctgaaaaaggtttggctgaagcttctgactacgcttctatcgacgctgctccagaagaacgtgaacgtggtattacaatcaacacagctcacgttgaatatgaaacagaaaagcgtcactacgcacatatcgatgctccaggacatgctgactacgttaagaacatgatcactggtgctgcacaaatggatggtgctatcttagttgttgctgctactgatggtcctatgccacaaactcgtgaacacatcttacttgctcgtcaagttggtgttgaatacattgttgtattcttaaacaagtgcgacttggttgacgatgacgaattacttgacttagttgaaatggaagttcgtgatttattatctgaatacgacttccctggtgacgatattcctgttattcgtggttccgctttgaaggctcttgaaggcgacaaagatgctgaagcacaaatcatggaattaatggacacagttgacgaatacattccaactccacaacgtcctacagacaagccattcttaatgcctgttgaagatgtatttacaatcacaggtcgtggtactgttgcttctggtcgtatcgatcgtggaacagttaaagttggtgacgaagttgaaatcgttggtttgaaggatgacgttgttaagacaactgttactggtgttgaaatgttccgtaagacacttgacgaaggtgaagctggcgataacatcggtgctttacttcgtggtgttgaccgtacacaagttgaacgtggacaagttttggctaagccaggttcaatccaaactcacaagaaattcaaaggtgaagtttacgtattgacaaaggacgaaggtggtcgtcatacaccattcttctctaactatcgtccacaattctacttccacacaacagacgttactggtgttatcgaattaccagaaggtgtagaaatggttatgcctggtgataacgtaacatttacagtagaattgattgctccagttgctattgaaaaaggtcttaagttcacagttcgtgaaggtggccgtacagttggtgctggtgtggtttctgaaatcgacgactaa

SEQ ID NO: 3 - DNA, 1128 bp, Lactobacillus salivarius
  isolated from gut, Lactobacillus salivarius
atgagtaaggaattactaaacgcattaaatgccttagaagttgaaaaaggtgtaaagaaagaaattgtgattgaagcattagaagcagctttagtttcagcttataagcgtaattatggtcaagctcaaaatgtggaagttgaatttgataagattgcaggtaatatccatgtttatgctgttaaagaagtagtaaatgaagtgtatgattctcagttagaaattagtttgaaatctgctcttgaaattaatagagcttatgaaattggtgatactatccgtgaagaagttacaccaaaagattttgggcgtatagcagcacaaactgctaaacaagtaatcatgcaacgtgttcgtaaagaagaaagagaagttatttataatgaatatgttcaatatgaacaagaaattgttacaggtgaagtagaacgtagagataataaatttgtttacgttaatttaggtagaattgaagctgttttgtcacgtcaagatcaaattccaggtgaagaatacaagtcacatgataaaattaaggtatacatttataaagttgaaaacacatcaaaaggacctcaagtatttgtaagccgttctcatccagatttgttaagacgtttatttgaacaagaaattccagaaatttttgatggtactgtagaaatagtttcaatttctagagaagccggtgatcgtgctaaagtagctgttcgttctaatgaagatggtgtagatcctgttggaacatgtgtaggaccaagaggtgaacgtgtacaagctatcgtaaatgaactaaaaggtgaaaacatggatattgttgaatggcgtgaagatccagcagaatacattgctaatgctttgaatcctgctaaagtattagacgttcgttttgatgataaaaatgagcatgcttgtacagttgttgtaccagatgatcaattgtctttagcaattggtaaacgtggacaaaatgcaagattagctgcaagattgacaggttataaaattgatattaaatcagaaagcgatgctgctgatttaaataacgtggaagctgataataatgatattgatgatgaagatcaattgatgtcagactcttcttccaatatgattgaggaggaataa

SEQ ID NO: 4 - DNA, 2025 bp, Lactobacillus salivarius
  isolated from gut, Lactobacillus salivarius
atgaaagtaaaaagaaaaatcttttggggagctttaataactctagggatagtttatggtgatattgggacatcacctttgtatgtaatgaaagctctaattatggatgctggaggattaaatgggctaaccgaagattacataattggatgtctatcactggttttttggactttaatgttaatgacaacaataaagtatgttttaatagcgttgagggcagataatcacggtgaaggtggaatttttgccttatatgcattggtacgtaataagaaaaaatggctgatattaccggcgttactaggtggtgcggctttattagcagatggaactttaacacctgctgttactgtaacgagtgctattgaaggtttaaagggtatttcgattggttctcagccgtggataaatacacagttagaagttaatctagtaacatttgtaattctattagtactatttttgattcaacgatttggtacaagttttattggtaaagcttttggaccattgatgttgttatggttctcatttctagcaatttttggaattgttaacttaattcatgagccactggtattgagggctttgtcacctcattatggattaatgttgttgttttctcctgctaataaagtaggaatatttattttaggaagtgtcttcctggcaacaaccggggcagaagctttatattctgacatgggtcatgttggtaagagaagtatatatttaacttggccatttgtttgtggggcattagtattaaattattttggacagggagcatatttgattaaaaatcttggtaattttaaaactactggtgatatttttaatccgttttatgagatgctaccttccagtgtctatttatttggcgtactaatttcaacgattgctgcaatcatagcctctcaagctttaattactggatcattcacattagttgaagaagcagtcggattgaaattactacctaaaatgaaagtagaacatccttctttatccagaggtcaaatttatattcgtacgataaattggtcattatgtatttgtactctgttagttttggtatactttagaacttctgaaagaatggaagcagcttatggtttagcaattacaattacaatgcttatgacaactattttgttatcacaatatcttaaggataaagtaaatgtagtgtttaatgggattttcttagctgttttcttgtcagttgaattgatattcttaatctctagtttaactaagtttacacatggtggttacgtaactctattaatcacgcttctgatactattaattatggtaatttggtattttggtaataaattacgtgattatctaagtgatgaagaagaatgggtatcgttaagtgattataaagatgtattacaggaactatcaaatgatgataggattccactttatatcagtaatttagtaatgttgactaaagtagataaaagaacttataaagttaaaagagaaacactgtattcaattttagataagtctcctaagaaagccaaagtatattggtttgtaacagttaatactactagtgatccatatacaaattattatacagttgatatgatgggaacaagaaacattgttaatctacaactttatttaggatttaaaatggatcatcgcgtaaacctttatttgagacaagtagttgaagacttaatcgaaaatgatattatcgatgaacaacctcaaaagtatacaactatgcctggaagaaagataggggatttccgctttattatcattcaagaactactatctccaaatacaagagtaagaggatggcaacatttacttatttctgccagaatctttattcaaaaccatagtactaacccaattcaatggtttggacttgaatttagtgaggttaaggttgaaaaggtaccattgctattgaagaaacgaagaataccagcaatggaacaaagaatgattttgaatcctaaagatgtaaaacgtagtacaaaagaataa

SEQ ID NO: 5 - DNA, 963 bp, Lactobacillus salivarius
  isolated from gut, Lactobacillus salivarius
ttggaatactttgtagttgtcaatgaatatgccaaaaatggtaatgctaaacaaatctggcaaactattcattcagaattagtgacacaaggagtcaaatttacttacaaaaaagttaatgaaaatgctgttgaagttgctaaaaatttcactttggatttagctgaaagaaaaaagagtaaaattgtcgtcctagttgtaggcggaaatggaactttagtcgatgttttaaatggtatcaagcaagcacaacgctttgatctaccaattggtctagttcctgccgggattgaaaatggattcgctaaagcaattggactttctctcaatcctgtcgttgctttaaagcaagttatcaatacaacagataagacacactatacaattggtacttaccaagaaactttacgaaacactcaaggttacttcttgaacaattttggtataggcatggatgcctttattacaagtatttataatcgtaagaagaaacgtaaattcttccgtcgaggttttcttccattccttactagcagtataagcgcttattataatcaagaacctttttcggctacggttagagttagtgactcctatagatttttcaaacatgtctatatcatgaatgttgctaatcatccttattttgaaggagatgtttcactctctcctcaagctaacattaaagataagaaacttgacttgatcgtcactgaaaatatgaatttcatccgtttctttatgttgattgtaagtttatattttcataaacaacttaatttgaagtcattccatcgcttcaaagatgatcaaattcatttaactattaaatcattggaatttctacagattgatggtgaagaacatggtagccagtattttgacattttcttcaaaactactagctatcccttctggtttaatctatctagtgttccctttaaagaaagacgcaaaaaataa

SEQ ID NO: 6 - DNA, 1791 bp, Lactobacillus salivarius
  isolated from gut, Lactobacillus salivarius
atgcaagaagcaaaaaagaaaacttcacttaaagcgaaggttcaaaagttaggtacatcgctatctagtatggttatgccaaacattgctgctattattgcttggggtttaatcacagcaatttttatggaacaaggttggttccctaatgcacatatcgctaaattgatcactccaatgttaacttatttattgccattattaatcggttatgttggtggacgtatggtgtacgaagaacgtggtgccgttgttggtgccatcgctacaatgggggtagttgttggtgctaaggttccaatgttcttaggggctatgatcatgggacctcttggtggttggtgcattaagaaatttgaccaattattccaagataagatcagatcaggttttgaaatgatttataacaacttctctagtggtatcttaggaatgttgttagctattttaggaacttatgtagttaacccattagttgttgcaggtagcaacttcatgagtaaaggtgttgacttcatcatctctattcacatgttgccattagctaatatctttattgaaccagctaaggtattgttcttaaacaacgctattggtaatggtatcttagttccattaggtattcaacaagcatcaactgctggtaaatcagtattgttcttacttgaatctaacccaggtccaggtcttggtattttgttagcattcatgttctttggaaaaggatcagcaaaaggttctgcaccaggtgctgcaattattcacttctttggtggtattcatgaaatttacttcccatacattttgatgaaaccagcattgattttagctgcaattgcaggtggtgtatctggtacatttactttccaacttttaggagctggtttaaaagctgctgcatctcctggttcaattatcgctattcttctaatgactcctaagggatcatatctagctgtattatcaggtgtgttcgtagctgcagtagtatcattcttggttgcttctgttatcttgaaacatgataaatcaactggcgacgatttagcagaaaaacaagctgaaatggaagctatgaaagctgaatctaaaggtaaagaaatgccatcaagtcaagcagcacaagattctgttgatagttacgcagatgttaagaagattatctttgcatgtgatgccggaatgggttcatctgcaatgggtgcttccttattacgtgacaaagttaagaaggctggtatcaaagacatttctgttacaaataccgctgtaaaccgtctaaaagatgaacaaggattattagttgttacacaagaagaattagctgaacgtgcattacaaagaacaccaagtgcaatgcatgtatctgtagataacttcttgagcagtccaaaatacgatgaaattgttgcaaacttaaaggctctatctcaaattcaagataaaccacaagcaacagaaaatacagtaaaaactgcagaagcaggtgacttaggtaatgtagactttactaaggttgaagaagtaaacttcattcgtcatgaccaacacattggtacagtaacaatggctacaagcttgttcagtgatagcatgaagaaagctaacaagcaaacaccagttaaggctgtaagaattaatgaacttgaagattctgataagcacttagtaattgtaacagcagccgctaagaagaatttggcagttcgttacacagacattcaaactgtagttgtagatgatttattaacagacaagaagttacaagatgttgtagctaaattgaaataa

SEQ ID NO: 7 - DNA, 861 bp, Unknownn
  isolated from gut, unidentified
atgctgccattaataagacgaaatttaaaattatttttccgtaatcgagctggagtatttttttctttgttaggagccttaatttcttttggactatttattatttttttgaagtctaacatgttagattcgtggaaacaattgcagcatccagccagagtacttgatctttgggtaattggcgggacattggccgtggccagtattactacgactttaagtgctttatccagaatggtgtcagaccttgaatatcgggtttttgatgatttgattttaactggtttaagtcgcttgaaaattcgactcagttatgttttggcagcaacaattattggaactctattgcaaatagcactttttttaataatggttagttatttttcttgggttgatggcatcagtattcctggatatatcacttttcaagtgttgatagttacaattttagcatcattttcagcaagtgtgctgaatttcactttagtttatcggatgaaaaatattgatactgttggtaagttttcttcaatcgttggggcagcttcaggattcttagtgggaatttatattccaatcggtgtcttgccaacttttgcgcaaaatttagtcaagttaacaccaggggcttatgtagcagcaatctatcgtcagctgttgatgcatgatatactgaaaaacgttcaaccaaatattttgcataatttacaaaaaacactgggaattggaattaatttaaacggtaatctaaccacaaaattgcaaaactttgcaatagttaccggtgtaaccgtaattttattaataattatcttgattaccaacaaatatgatcaaaataaatctgttagtacggagtga

SEQ ID NO: 8 - DNA, 708 bp, Lactobacillus salivarius
  isolated from gut, Lactobacillus salivarius
atgatcgaagataacaaatcagtatgtgaaatgatgtccatgttttttgaaaaagaaaaatgggatgtagaatatgcttatgatggtatttctgcagtagaaaaatttaaagaaaaatctgatgagtgggatatgatcacacttgacttgaatttgcctggaatggatggaatgcaagttaatgctgaaataagaaaaatttcaagtactgttccaatcataattttgactgctagagattctgaaagtgatcagattttaggcttagaaatgggagcagatgagtatgtttccaagccattttcaccaataacattaattgcaagaattaaagctcttcatcgccgtgctcaaatttctgcattaggaagcaacaaacagaacaaggtagatgatgatttcgatgttaaaacagatcattttaaactaaattctagtactagagaagcttacttgaatgacaataggattgatggtctaacaccaaaagaatttgacttgttaagagtattagcaaaaaaaccacgtcaagtattttctagagaacaattattgcaattggtatgggattatgaatactatggtgatgaaagaacagttgatgcacatattaaaaagttaagacaaaaaattgaaaaagttggtccacaagttatacaaactgtgtggggtgttggatataagtttgatgatacagaggcagaataa

SEQ ID NO: 9 - DNA, 768 bp, Lactobacillus salivarius
  isolated from gut, Lactobacillus salivarius
gtgggctttatgattgaaaatgaaaccattaaacatcaactaaatcatcgtgcaattagagtttttaaagatcaaactttatcggaagaacagttaacgactttatatgaagtagctagacatacagctactagtatgtttatgcaacagtttagcatcttacatattactgatgaagagaaacgtaaacaaattagagaaataacaggtcaaaaatacgtaggggccaacggagatttatttatttttattatcgatttatatcgaaatcaacaaattcgtaaacaaatgggaaatgatgatggacgtttgcatacaatggatattttcttccaagcattgcaagatacaatgttagcagtccaaaatgtaattaatgctgctgagagtatgggacttggaatagtacctttaggaacggttaatgatgatcctaaagcaatgttaaaagtattagatttaccagaactcacatatccagctttaggcttacaagtcggtgtaccagatcaagaaccacaattaaagccaagacttccattagaatttacaacttttgaaaatgaatatccacgtaattttgaagttagtgagttgaaagattatgacgaaatagtacaaacgtattatgatttacgcgatgctaatagaagaattgattcatttactaatcaaattagcggaaaaaaattgaatacacatcaaaataaacgtgatgatattgtagaagctattcatagtcagggattagcgctagattttaattaa

SEQ ID NO: 10 - DNA, 243 bp, Unknownn
  isolated from gut, unidentified
ttgacggttaataattttttacaggctcaaatcaaagaacaatcagcttttattgagctacttaaacagcagttagaggttaaggccatgcaattaattatggccaagattcttgatgaaattcttaagtccgaagcgactgagcagattaaagctagggcttatgaacgttcggatgaacgtaccaattcacggaatggttatcgagtttgtcagcttaccacacgagtagggacactttaa

SEQ ID NO: 11 - DNA, 1023 bp, Lactobacillus salivarius
  isolated from gut, Lactobacillus salivarius
gtgaaagtagatgagttgcgcaaagaaatagaaaataatagtctaaaaaatgtatatttagttttaggggaagatacatatcttaataataaagttaaagaattattttggaactatattcctgaaagtgatagggaatttaatgccgcaatttatgatatggaaactacttcgattgcaaccgcaatagtagatgcaatttctgctcctttttttagtgaaaaaagattggtgattattactcatccatattttttaacaggggatacaaagaaacattctatcgaacaagatgtaaatgaattgataggatatttgcaaaattcttctccagatactttgttagtagtattagcaagttatgagaagttagattcacgtaagaaagtagttaaagagttaaagtcaaaagctgaaatagtgaatacttcctcattgaatgaatctgagataagacaatatcttataaaatattgtgatgagaaaaaagttataattgaaaaaagagcaatagacagattaattcaattaaccaatgctaatttctctaaaataatgaatgaactttctaaactaataatagcaactgttaatactaaaaagattacaattagtgaggtagatggattagttacaaaatcgctggaacaaaatgtttttgacttggtagattttgttcgtgataaaaagataaaagaagcatttgaattatatcatgaacttttagaacaaaaagaagagccaataaaaataaatgcgatcttaattggacaatttagattacttttacaagttaaaatattacagaagcatagttatgatcaaggaagtattgcctcaactttaaaagttcatccctttagagtgaaattagctatgcagaatgctcgtaaatttagcaataatagtttgaaatctgcttacttaggtttggccgaaatagaagaaaagttaaaaacaagtagtcagaatccagaattgttgtttcaattatttttgacaaaatatgcgtataaaaaataa

SEQ ID NO: 12 - DNA, 1293 bp, Lactobacillus salivarius
  isolated from gut, Lactobacillus salivarius
atgaaattagtaggaattatcggttcaattgctgatgaatcatacaaccgcaaattaatgctatacatagcaagtcatttcaaggaaacaatcgatattgaaattcttgatattagagatgttccaatgtttagagcaggaatggaaatgggaccagctgtagaatatttaaataagaaaatttctacagcagatggtgtaattattgcaactcctgaacataatcatacaactacagcagctttaaagagtgtaattgaatggttatcttctagcgttcatccatttgcagataagccagtattattggtaggtgcttcttacttcgaacaaggttctggtagagcgcaattagatttacgtcaaattctagaatctccaggggtaaatgctttggtaatgccaaaggatgaattcttattaggaaacgttaaatcagcttttgatgaaaatggtaacttaaaagaagcaagaactgttggcttcttagaaagtgtcatgggcaacttcttgaagtggatcaaagttttgaaagctatgaagaagaataacgatgtaaaaggtgactgggaatcagaagacttaactgcatctcaagaaattgatacaactgtcaaaggtgtagatatgaaggctgaagattgggtagaacaagctgctgctaagactaatgcagttgaaggtgatacttatgttaagttagacagaggtcttttgacagttaaccaacttaactggttcttgaatacaatgccagttgaattgacatttgccgatgataataaccaatttatctactataatcgtatggatgaaaatcctaaagatatgttagcacctcgtcaacctaagcaagttggggatccgttagaatcagttcacccagaacgtgctttgaaaggtgtaaaacatgtagttcatacacttcgtacaggtgaaacagatcttgtaagtatgccagtaccatttatcaataaggttaatgaaaagcatgtaatgcactattataaggcaatgcatgatgaagatggtcgctaccgtggaattaatgaatgggtagttgatatttggccagtagttgaatcttatttgaagatgacaggtcaaaaattggtggctgatgaaaatgcaaaggtagatgcaacatccggagcttctgagaaaaaagaagaaccagtagctactcctgaaacagacgcaacatctggcgcatctgaatcagaaacaaaggtagaagaagttaaagttgctgaaccagaagtagatgcaacatcaggtgcttctgaatcttaa

SEQ ID NO: 13 - DNA, 1458 bp, Lactobacillus salivarius
  isolated from gut, Lactobacillus salivarius
atgaaaaagtttattacatttttaagtattattagtagtttaatctttctttcattttttattaaaccacagttagttcatgcggatgaaaaaacatatacaatagctactgatgtaacatttccaccatttgaatatgcaaatgatagtaataaatatgtcggcattgatattgacttgataaatgctatagctaaagaagaaggatttaaagtggacctgaagccaattggttttaacgctgctttgcaatccgttagtgctggacaagttgatggaatgatcgcaggaatgacaattacagatgaacgtaaacaaaaatttgatttttcgaaaccatattattcatctggtattgttatggctgtaaaacctgacagtagtattaaaagtttgaaacagctacgcggaaagaaagtagctataaaaacggggacttcaggtgcggattatgctaattctataaaagataaatatggattcaagactgtaacttttgatgattcagataatatgtataatgatgtagaaaatgggaattctgttgcatgctttgaagatagtgctgttttagaatatggtattagcacaggtttaggattaaaaatagtaactaaaccagctaattctggtaattttggttttgctgtaaaaaaaggaacacaccaggaattgatgaataaattcaatgatggtttagataaacttaagaaaaatggaaaataccaaaagataattgaaaaatatacaggtaaaagtgcaatttcagctactaaagaggctaatgaaaagaaaagtaaagatagtcatactgtcttaggactattaaaacaaaataaaaaggcctttttagacggaatagtagaaactttaaaattgacagtagttggaattataggtgcaactatttttgggattctaataggaatgttaggtgttgtgccaaacaaatttgctcaaggtatttctacaacaataatttatatttttagaggacttccattgttagttctagctttgtttatttacaatggtattcctagtttaacaggatcaaaaattccagcatttatcgccggaattattacattaactttaaacgaaggtgcatatactgcagcctttgtgaagggtggaatcgaggccgtagataaaggtcaaatggaagcagctagaagtttgggactttcgtttggcaaatccatgagaaaagttatcttacctcaaggtgttaaaattatgattccatctttcattaatcagtttataattacattaaaggatacttcaattttatctattataggtatattagaattaactcaaactggtaaaatcattattgctagaaacttagaaggttttagaatttggggcattatagcaataatgtacctattaataattacaattttaactttattatccaaatggattgaacggaggataaataactaa

SEQ ID NO: 14 - DNA, 1110 bp, Lactobacillus salivarius
  isolated from gut, Lactobacillus salivarius
atgttaggtgaatttagtgttttatttgaagctcccttagagaaagttaaaattgttacagatgatagtgggggcttacgacttagacctcaagaaaatgaagaaacaaaacaaatagttataataaagaaaaatggaaaagttagagttaagagatatagctatagattagaaattaatggtgatcgaaaattttttgatcggacatttaaatttgatgaagaaatcactcaaaagattttagcaagtataagggattgtttcaataatagagaaggtaacattataggtttagatgctagaccttggactttggatgtaactgatgaaaatggtagaaagaaccaattagtaggtatagtaaatggagacaaatctgttagcaagatttcaagttatattcgagaagagttagacttggattatttatggttatttgatggtaaagatattagggatgaaataaaaaaagttattttagaaactagacataatttaagtgatacgatcaagatagaaaaattaattataactgctaaagaagataaaattgaatacagtcaaaaagatgacaaaggaatgaaaagcgctaagacgtatgtaattcctaataaggtgaaagaacttttagaaaattattcttttactaattcatttaatagaatcttaggcaatcctaaagatgttattgagccagaagaaaagcgggattaccaattaataattgaaaatagtcaaaatgatcgaaagatttatgtgggaacttatgataaatattctcttccaacagattggggagattttattaaagatataacaaatataatttcacaagaagatgaaacagagatttttaaatcaagtgtttataataggagattacgcagaaaaggcgaatatattatttgtggtgtattctttgaaggtggatataaagaatataattatttgactgatgatgagagtattcaagttggcgatgaggttgaaatcccagttggtgttgataatcatgtagtaaaagctaaaatagctgatgtaaattattattataaggaagaagcaccatatccaattgaaaagacaaaaaagattctaagaaaagtttga

SEQ ID NO: 15 - DNA, 789 bp, Lactobacillus salivarius
  isolated from gut, Lactobacillus salivarius
atgcctaaaattttaaagaagaaaaaaacggctcctgaaattgtagctgctgcgcgtggattaaaaaaagtaactgccaatgaattgatagatggaatttttgatgatttttttgaacttcatggtgatcgcaagtattcagatgatgaagcaattataggtggaattgcattatttaatgggattcctgtaacagttattgcaacggataaaggtggtactcctgaagagagaatagcgaaacattttggatgtccagaaccgtcaggatatagaaagtccttacgtttaatgaaacaagctgagaaattcaatcgaccaatcgtaacttttgtaaatacttcaggtgcttatcccggacgatctgctgaggaaaatggacagggtgaagctattgctagaaatttactagaaatgagtgatctaaaggtaccaattatttcatttatttatggtgaaggaggcagtggaggagctttagctttggcatgtggagatcaagtttggatgttagaagatagtatgtattctattttatcacccgaaggatttgcttctattttatggaaagatagtaaaagggcagatgaagctgcagaagtaatgcagttaactcctgaggctttattaaaacaagaaattattgaaggaataattccagaatctaattcacatcgaaaagtttgcaaagagataaagaaaatattggcacaagaattaaaaaatctaacttcacttacaaagtttgaacttgtaaaaagaagaaaagagagatatagaaagttttag

SEQ ID NO: 16 - DNA, 831 bp, Lactobacillus salivarius
  isolated from gut, Lactobacillus salivarius
gtgattcatttgacaagtgtagaatgggaaaaagttaaggactattctgaaatcatatttgaaagggcaggtcaaattgccaaaataacaatgaatagaccagaaaaacataatgctttcactccagtaacggttgctgaaatgattgaagcattcacaatttgtcgcgatgacagtacaattggagcaattattttaacaggagctggtgataaagcatttagttcgggtggagatcaaacagttcgtggaaatggtggttatgtaggaccggataaaattgcaagattaaatgtactagatttacaacatctaatcagaattatccctaagccagttattgcaatggttaaaggttggtctgttggtggcggtaacgtcttacagttagtttgtgatttaacaatcgctgctgataatgcaatgtttggtcaaacaggacctaaagttggtagctttgatgcaggttatggttcaggatatttagcacgcgttataggacataaacgtgctaaagaagtatggttcttaaatcatttttatacagcacaagaagcatatgaaatgaactggataaataaaattgttcctttggatgaagttgaatcagtaactttggattggtgcaacgagattttacaaaagtcaccaactgcaattagatttattaaagctgcaatgaacgctgatactgacggtttagctggtttacaacaatttgcaggcgatgcaacgatgctttactatacaacagacgaaggaaaagaaggacgcgatgcctttaacgaaaaacgtaaaccagatttccagcaatttcctaagttcccttaa

SEQ ID NO: 17 - DNA, 567 bp, Lactobacillus salivarius
  isolated from gut, Lactobacillus salivarius
atgacacaaaaaagaaatttatcaaccgaaaaaataatagaagcagctaaagtgattataaataaagaagaggctgagaaattaagtttcagtaaggttgctggtgtattaggggtacattctcaggcgatgtatccatattttgccgataaagaagaactaaaaattgcagtaattaatgattttttagatagtttaactgaacaaataaaagaagaattgcaaggaatttctggaaaagaagctctacgtatatatggtcgtaaactacatgaattattattgatccagccgcgattaacgcgtttggcttttggtggaattgattatagtcaaaaagaagaagcaagaaatcattttaaagatttagtagaattattggaaaacttgattgaaccatttgctaaaaatgatgttgatattataaacagagcacgattatatcgagctgtgatatttgggtatgttcaaaatgaactgtggggcttattcaaattagtactagttccagcacaaacgagctttgaatttactttagaagaagcaatagcgacaattactgcgtag

SEQ ID NO: 18 - DNA, 801 bp, Lactobacillus salivarius
  isolated from gut, Lactobacillus salivarius
atgataccttttaaagctgtagcaattgatatggatggaacctttttaagagatgataaaagctatgataaaaaattattttctgagttattaaataagatgaaagaaaaagatattcattttattgtagctagcggtaatcaatttgaaagaacgagattagattttactgaatattggaaagatatgtccttcgttgccgaaaatggaatgtacttggtagatgatggaaaagatctgagctatgaacaattagaccgaaatttagttgaagagttagtagactttatggcacaaaggccagaattaacaccagctttatgtgggaaagaaaatgcatatctagaaaagaattcagattcaaaatttgttaagatgatgaaatattatttacctaagcataaaattgttgatagtttcgagcaacttcctgatgatgtatttttcaaatttacagttgatgttcctaaagaaaaaactttatcaacggttgatgaaattaacaaaaaatttgcaggaagagtttttgctacttcaagtggttttggaaattttgatttaatcttgccacatgtcaataaagctgtcggattagaaaaaatgctagcaagttggaatttaaccttagatgatttagtagcttttggcgatggtggaaatgatttagagatgttaaaagctgcaggacttagctatgcaatggaaaatggtagcgatgaagtgaaaaaggtagctgataaaatcgcccctaataataatgattcgggagtattgaaagttttagctgactatttaatgtaa

SEQ ID NO: 19 - DNA, 1425 bp, Lactobacillus salivarius
  isolated from gut, Lactobacillus salivarius
gtgaaaattcaaaaaaaattatctgcttgtactagcattttagttggaaaaaaagcgatggccgacaattcaactatcatcgctcgtaatgaagatgcgaaaactgcttggcctaaacatcttactgttcatgagcataaagaattcgaagaagagcaagtttttgtatcaaacgataacaagtttacaatgccacttcctaaggttagatttagatactctgctactcctgaatggactgataagtttggcttattcgaagaagatggaattaacgaatatggtgtagcaatgagtgctactgaaagtgcctactccaatccacgtgtacttggtgctgatccactcgttgaaaatggtattagtgaagaagcaatggtaactgttgttcttccatatattaagtctgcacgtgaaggtgttgcacgtctaggaagcattatcgaaaaatatggtactagtgaaacaaacggtgtcctcttctctgatgaagatgaagtttggtactttgaaagtggtagtggtcatcattgggttgcacaacgtattccagatgattgctatgcagtagtagctaatcaattagctatccaaaaagtcgatcttgatgatcctgataatttcatgtattccaagggtattgtacaatttgtataccaaaatcattttgaagttgattttgataattttaacttccgtaatgtctttggtacacatgaatatagcgatgaaatttatagcactcctcgtgtatggtacggtcaaaaatacctttctggtgataatgatcaagatccaatgagtgaagaattacctttcattcgtaaagctaatcgtttactccatttggatgatattgcctatgtattaggttctcactaccaaaatacaccatatgatccattaaacaatgataatgctgatggtcataagttccgtcctattagtttagctgccactcaagaatcacatattctacaaattagaagtggtatgccagttgatgtacgcggtattcaatggttatcaatgggtgtgactgctcaaagttcctatattccattctatcctgcagctactgatgtccaccctgcatataaagtaggtagtgaaacctatgatgataagtctgcttattgggtatacaaattagctggagtgctagttgatgcgcattacaaagaattcggtaaaatgttaaaagatactcaaaaagaagtttcaatcttacttaacaataaagttcatgaaattgacgctaaggcccttacgctttctggtcaagaactaagagattacctaacaacagaaagtattgcttgccaacaaattggacttgataaatacaatgaattgatagctaaactaattacagcttcaaccgctttatctccattatcatttaaagttgatgtcaatctttaa

SEQ ID NO: 20 - DNA, 1089 bp, Lactobacillus salivarius
  isolated from gut, Lactobacillus salivarius
atggaattatggcatacagatctaaaaggaatttcaattgttatttctatgttaggtttaggacatttgattactgttttattagcgggttggttttcggataaatttggtagaaaaaatactataattatcggaacaatttccaacatcatatttttgataggtttattaataagtagaaatatttggatggcgtcaatttgtagtttatttttaggcaatgccaattcatttaatgattctggtagctatcctttattaacggaaaaatttccagagaaacctgctagtatgaatgccttagtaaaagcttcaatgtcattatcgcaaacgatcttaccgttagtaattgcagctgtacacagtgcatacattattattccagctatggcagtgatgctaggattacttctattaaaagtgagtgtaactaattttggtaaaaatgaaacaatagttaaagaaacagttagtgaacaaaaagaaatcttggaaacttctacaaataagccttctgttttgattgatggggtaggaatggtaatattaggatttactttatcatttatattttatatgtactcacaatatgcaccagtatttgcagaaaaagttattggatcaacaccagttttttctaaaacgttaatttcatggtatgctatttcttctttaatctcggtatttatcacatcgactgtagttagaaaggtacatccatttaaagtgttattgacatattcaattgttgctgcagcgatgttagctgtgatggttgttcatccaactccaacaattgcacgtttgacaagtatcgcaattggtttctttgcggcaggcggtatttggcaagttggtctaacaattttatctcgttattttccacgagaaaaagggagagttacaggatactatagttttgcggctgctttaacatattttgtgggtccgattgtgtctacttttatcttagatgatacagcagccagtttagttcatgtatttgttttagatgtagctgtctcagtgttaggaataatcgtaatgataattttagcagtacgttgcttcaagtataaattcatctaa

SEQ ID NO: 21 - DNA, 648 bp, Lactobacillus salivarius
  isolated from gut, Lactobacillus salivarius
atgacacctaagaaagaagattatttaaaaattatttttgaacttggtggaactaagaaaaaggtttctaacaagcaaatagcgatgagtttaaatgttgctgctggttctgtgactgaaatggttaataaattagttaaagaaggtttagctgcacatacgccatatgcaggaatttcattaactgatgaaggaattgaagtagctgaaaaattagttcgccgtcatcgtttatgggagacttttttagtagaaaaattggactatcaattatcagaagttcatgatgaagctgaagttttagaacatgtagctagtgataagttaatgaaaaagcttgatcaatttcttaatagcccacgtgaatgcccacatggtggagttattccaacagaagctggagaatatgaagaagaaagtcatgaatatttagctgaaattaaagttggagaaacggttgaagttgacagatttattgataaccatgagttgctaacttatttagatgatttggaacttaaactaggggacaagattgaagttttagaacatcttccatttgaaggaccaattaaggttaaaaggttagctgatggggctgaattaagtattggatataaagctgctcattacattttcgtgaaataa

SEQ ID NO: 22 - DNA, 1218 bp, Lactobacillus salivarius
  isolated from gut, Lactobacillus salivarius
atgcaatatacagaaataatggttcgttacggcgaactatctactaaaggtaaaaataggaaaaacttcattgatcgtttaggatttaatgtgcgtgaaagtttgcatagttttgaaaatttggtaatcaaggcacaccgtgatcgtatgcatatccaattacatggagaagattacgaagctgttatgaaacgtttgaagcaagtttttgggatccaaaatttctcaccatctattaaagttgaacgtgatatagagaaagtcaaggctactgcggtagaaatggtgaaagaaaaatttaaagaaggaatgacatttaaaatcaatactcgtcgttctgaccataactatcaatacgatacaaatgagatgaatgatattctaggtagtcatattttacgtgaagttccaggtattaaagtgaagatgaaaaatcctgatatgactttacgttgtgaagttcgtgcggatggtatttatctttcacatgaaaagattgacggtgctggtggtttgcctgttggaactgctggtaaagcaatgttgatgctttctggcggaattgattcaccagtagctggatatttagcaatgaagcgaggagtggatattgaaatggttcatttcttcagtcctccatatacaagtgaacaagctttgaataaagctaaagacttaactgctaaattgacaccatatgttggtaagataagatttattcaagttccatttactgaaattcaagaaacagttaaggaaaaagtgccatcaggatatttaatgacaattcaaagaagattcatgttgcgcttaacagaagcgattgcacaaagaagaaagggattagctatctttaatggtgaagctttaggacaagtagcatctcaaacacttgaaagtatggctgctattaacgatgtaactactatgccaattttacgtccagtagtttcaatggataaaaatgaaattattaagatagctcaagatattgatacttttgatttgtcaattatgccatttgaagattgctgtacaatttttgcaccaccagctccaaaaactaagccacgtattgataaggcacgttactatgaagaacgtttagacgtagatgctttagttcaacgagcacttgatggtattgagattacagaaattaagattggcgatactttcttaaaccaagaaaagaaagtttttgctgaattactataa

SEQ ID NO: 23 - DNA, 1203 bp, Lactobacillus salivarius
  isolated from gut, Lactobacillus salivarius
gtgcaggatagacagtcgcgagaacgtcgtgaagaagaagacgcacgaatagattggggaattattctatctgttatggttcttgcaataataggaatgctttcaatttatgttgctgcaagtcatgacactagtacaatgagtgtaccaagaacacttatttctcaagctatgtggtatgcaatagggataggtgcaattatatttattatgcagtttgatgctgaacaattgtggaaagtagctcctattgcgtatggtttaggtattactttgttagttttggttttgattttttatagtagagcttatgctttaaagactggggctaagagttggttagcttttggacctttgacttttcaaccgtctgaagtgatgaaacctgcctatattttaatgttaggtagggtggttgcacagcataatgcagagttttatgagcatactattaaaacagattggaatttgataggaaagttggctctatggacattaccggttgctgtattgttgaaattacaaaatgacttcggtacaatgttagttttctttgctattcttagtggtgtgattttagtttcaggtgtttcttggaagatactagcacctctttttggaggtgctgctttcttaggaaccgctggtattttattagctgtttatgggagaaatttattaatggcaataggttttaaagcttatcaatttgctagaattgaagcttggttaaacccatctgcatccactacgggtaatagttatcaattatggcaaagtatgaaagctattggatcaggacagttatttggtactggatttaatcattctaatgtatatgttcctgttagagaatcggatatgatattttctgttataggtgaaaattttggattcattggtggatgcattttgatttttatatatctattacttattttccaaatgattcaggttacctttgatactagaaatgaattttatgcgtatatttctacaggtgttattatgatgatcttattccacgtttttgaaaatattggtatgagtattggattattaccattaacaggtattcctctaccatttataagccaaggtggatctgctttaattgcaaacatgataggtataggattaataatgtccatgagataccataataagagctatatgtttagcagcagtaaggaatttcgttaa

SEQ ID NO: 24 - DNA, 2364 bp, Lactobacillus salivarius
  isolated from gut, Lactobacillus salivarius
atggcaaatcttcttaaacgttgggtggaaagtgataaacgagagcttaaacgcctaggaaaaattgctgataaggtagaatcatatgctgatgaatttggtgctttatcagatgatgaattaaaagcaaaaacagaagaatttaaaaaaagatatcaagatggagaaagcttagatgatttattacctgaagcttttgctgtctgccgagaaggtgcaaaaagggtactaggcttgtatccataccatgttcaaataattggtggtatcgttttgcatgaaggtaatattgcagaaatgaaaacaggtgaaggtaaaactttgactgctacaatgccagtatatttgaatgctatttctggtaaaggtgttcatgttgttactgttaacgaatatttatctgaacgtgatgccacagaaatgggagagttatacacatggttagggctgactgttggtttgaacttagctgataaatcaccagaagaaaagcgtaatgcttataattgtgatattacttattcaactaatagtgaacttggttttgattatttgcgtgataacatggttgtttacaaggaagatatggttcaacgtccattgaattttgttatcgtagacgaagttgactctattttaattgatgaagctagaacaccattgattatttctggtcaagcaacgggaacgacaactctttatactagaactgatcgttttgctaagactttgacagaagatgaagatttcaagattgatttggaatcaaagacagtttcattgacagaagatggtatccgtaaaggtgaaaaatattttggattaaagaacttatatgacccagataatatggcactaaaccatcatttggataatgctctacgtgctaattacatcatgttaagagataaagattacgttgtacgtgatggtgaagttctaattgttgatcaatttactggacgtattatggatggacgtcgttattctgacggattacaccaagctattgaagcaaaagaacatgttgaaattgaagaagaaacaaagacaatggctaacattacttatcagaacttcttcagaatgtataataaactttctggaatgacaggtacagctaagacagaacgtgaagaattccgtgaaatttataatatggaagttgtatctattcctacaaacaaaccaattgctcgtgtagacaagcctgatttgttatatcctacactaaagagtaaatttaatgcagtagtaagagatgtaaaagcacgtcatgaaaaagggcaacctgttttagtaggtacagttgcggttgaaacttctgaattattgtctaagatgttagacgatgaaggtataccacattctgttttaaatgctaaaaatcatgctcgtgaagctgaaattgtaatgaatgctggtcaacgtggtgcggtaacaattgctactaacatggctggtcgtggtactgatatcaaacttggacctggtgttcgtgaattaggtggattagctgttattggtactgaacgtcatgaatcgcgaagaattgataatcagttacgtggacgttcgggtcgtcaaggagatccaggtgttactcagttctatctatcattagaagacgatttaatgttgcgttttggatcggaacgcattaagaacttcttggaaagaatgaaagttagtgatgacgatgcagttattcaatctaagatgataagtcgtcaagtagaatcagcacaaaaacgtgttgaaggtaataactatgatactcgtaagcaagttcttcaatatgatgatgttatgagagctcaacgtgaagttatttatgctcaaagacaacaagtaattatggaagaaaagagcttgaaaccaataattatgcctatgattgaaagaactgtaaagcatacagttttgatgcatactcaaggtgataagagtgaatggaatttgcaaggtattttagattttgctgtttctgcaatggttaatgaagacactattagtttaggtgatttggtaaataaaacaccagatgaaattgttgactatttaatgaaacgtgcagaagatatctatgctgaaaaagaaaagcaattgtatgatgaaagccaaatgttagaatttgaaaaagttgtaattctaagagttgttgactcattgtggacagaccatattgatgaaatggaccaattaagacaatctattggtttgcgtggatatggacaattaaatccattagtagaatatcaacaagatggtttcagaatgtttgaacaaatggtaggtgcaattgaatatgatgttactcgtttgttcttgaaagctgaaattagacaagacataaagcgataa

SEQ ID NO: 25 - DNA, 1242 bp, Lactobacillus salivarius
  isolated from gut, Lactobacillus salivarius
atggcaaaatatgaaaatttagttactagatttttgaaatatgtaaaaacagaaactcgttcaaatgaggattcaacaacaatcccttcaactcaaacacaagttgaatttattaaggaacttgctaatgagcttaaaggattaggactacaaaatgttcatatttctgatgaaagtggatatgtatttgctactttaccaagtaatttagaagatgatgctaatactaaagtagtaggttttatttctcacgttgatactgcagactttaatgcacataatgttcaacctcaaatagtagaaaactacgatggagaatctgatattaagttagatgaagcaggtaattttgtgttaacaacagcagaatttcctaacctaaagaattataaaggtcatgatttgataacaacagatggttcaactttattgggtgctgatgataaatctggtgtagccgaaattatgtctgcaatggaatatttgcaagcacatccagaaattaaacacggcgaaattaaagttggttttggtcctgatgaagaaattggtacaggtactgataatttcaatgttgaagacttcggtgctgatattgcctacacagtagacggtggtcctttgggtgaattagaatatgaaactttcaatgctgctcaagctaagttgacattcaaaggaaaagatgttcacacaggtactgctaagaatgtaatggtaaatgctattcaattagcaattaattatcaaaactcacttccagcagatgaagttccagaaaagactgaaggtagagaaggattcttccatttatttaaatttgatggatctgttgaagaagcacatacaacttacatcattcgtgatcatgatagaaagcattttgaagaacgtaagcaattgatgttagacatcgctgaaagaatgaatactgaactaggtgaagaacgtgtagttattgatttacaagaccaatattacaatatgcgtgaagtattagaaaaagacatgacagcagttgacattgctaaggaagctatggaagatttaggaataactcctgaaatttatccagttcgtggtggtacagatggttctaagatttcattcatgggattgccaacaccaaacctttttgctggtggcgaaaatatgcatggacgttacgaatatgtatctacacaggtaatggaaaaagctacagatgtaattttagaaatcgttaagttattagcaaaataa

SEQ ID NO: 26 - DNA, 1635 bp, Lactobacillus salivarius
  isolated from gut, Lactobacillus salivarius
atgaaaagaattaaagcaattattactggaatatttataagcttaaccgcaattttgttagttgcatgtggtaaatcaactggtgaaaattctaaacaagttttaaatctaagtacaactggaccattggataccattgatatttctaagtctacaggttatggtcaaactgggaatgtttttgaaagtttttatcgtttaggtaaagatggcaaggtaactcctggattagctaaaagtggtcaagtttcacaagatggcaaaacatggacttttactttgagagatgcaaagtggagtaatggagataagattactgctcaagattttgtatattcttggaaaagaacaattgatcctaagacagcttcaccatatgcttatttgttctatgatgtaaagaatgcccaagctatcaatgaaggtaaaatgtcagctgataaattaggaataaaggctgaaggtgataataaggttgttattacgttagatagacctatatcatattttaaagtcttaatgacatatccattatttggaccacaaagtgaaaaagtggtacaaaagtatggtaagaaatatggaactaattctaaatacatggtgtactcaggaccatttaaagttaaagactggaatggtacttcggataagtggtcatttgtaaagaataatcaatattgggataaaaaagtggtaaaactacaaaagattaactatcaagtagttaaaaataccaatacaggttatcaattattccaacaaggtaagttagatttaacaccattatctagtgaacaagttaagaatctacataacaagccagaattcaagcaatactcttattcttacgttgcatatttagactataactttaatgattctaatgaagtaaatcgtaaggcactaaataataaaaatattagattagctttatcattagcgattgacagaaagacacttacaaagaaagttttcggcgatggatctaatgtaccaactggttttgtagcatctgatttagctactaatccaaaaacaggtaaagatttcgctgcagaacaaaaagtagataatacagttgattacaatgagaaattagctagagaatattggaaaaaaggattacaagaaattggtgaaaagaatttgaatttcacaattctagcttccaatgaaatggctaataatgatgctttaactcaatatctacaatcacaatatacaaaggtattgccaggaattaaggtttccgtacaaaatattcctggaaatagcgcattatctaaagctcgtaaaggtaactatgacatttatgtatctggttggggtggagactttaaagatccaatcactttcatgcaaattccagttacaggaacttcatacaattatggaaagtactctaataaagagtacgatgctttaattgaaaaagcacaaaatgaagatgccaatgatgctaataaacgttgggaagatttagttaaagctgctcgactctttaatgctgatcaaggggtaacacctctatatcaacaaacaacatcttatatgcaaaataccaaagtaaagggtattattcaaaatactgcaggtacacaatggaactacaaatacgcttatattaaatag

SEQ ID NO: 27 - DNA, 2265 bp, Lactobacillus salivarius
  isolated from gut, Lactobacillus salivarius
atgaagagaatatttgaagttgatccatggaaagttatttctcatgaactaaagcctgaagataaacgattacaagaaagtatgacaagtattggtaacgaatatatgggtatgcgtgggatgtttgaagaaaaatattctggcgatacacataaaggtatctatttaggtggagtttggttccctgataagacagttgttggttggtggaaaaatggttacccacattattttggtaaagttataaacgctgtggactttgtatctgttgatattaaagtaaatggtgaatccattgacttagctaaagatagttattctgattatgaagttagtcttgatatgaagaaaggtattttaactcgtagctatgtagttgataaagatggagctaaggtaaaggtaacatctactcgttttgtaagtattgcatttaaagaactatatgctaataaattaacttttgaaaatctgggctcagaacctgtaactttagaagttgattctgtaattgatgcagatgtatacaataaagatgcgaattatgatgaacaattctggaatgttttgagtaaacaagtatctgctaaagatggaagattagttgcacaaacaattccaaacaattttggtacacctcaatttactactgagatggcaatgcatcatgttactgacatggaagctaaaggcttaggtaaagaagaagacaagcaagttgttaatacttttgctaaagaattggcagctaatgaacaagtaacatttgaaaaacgtgtaattgttacaacatctcgtgactatgcagatgagaaagacttagatgaagcaacaagtaaattattagattcacaagcagaaaagacatttagtgaattattaactgcccatgaagaagcatgggataagagatgggaaaaagctgacgttaagattgaaggcagtgacgaagcacaacaaggtattcgtttcaacttattccaactattctcaacatactatggcgatgatgctcgactaaacattggaccaaaaggctttactggtgaaaagtatggtggtgcaacttactgggatacagaagcatttgctgttccactttacttagcattggctgataaagaagttactcataatcttcttgaataccgtcataatcaattaccaggtgcataccataacgcacaagaacaaggtctaaaaggtgctttatatccaatggtaacgtttaatggtattgaatgccataatgaatgggaaattacttttgaagaaattcatcgtaatggtacaattgcatatgctatttacaactatacacgttatactggcgatgaagaatatgtgacacatgatggatttgatgttttgacaggtattgcacgtttctgggcagatagggtgcattactcacaacgtaagggattatacatgattcatggtgtaacaggtcctaatgaatatgaaaacaatgtaaataataactggtatacaaacatgcttgctaaatggtgcttaaattatactaatgaaattgcagataaggtttctgatgaaaaattagctgaattaggacttactgaagaagaacgtaacaagtggcatgaaattgcagataatatgtatctaccagaagacaaggaattaggaatctttgtacaacatgatacattcttagataaagatttaacaccagtagctgatattcctgctgatcaattaccattaaaccaaaattggtcatgggataagattttaagatcaccatatatcaagcaaggtgatgtaatgcaaggaatttggtactttatcgataaattcccagaagatgttaagaaacgcaactttgaattctacgaaccattaacagtacatgaatctagtttatctccttctgtacacgcaattattgctgctgatttgcacaaagaagataaagctgtagaaatgtattctagaactgcacgtcttgatttagataactacaacaatgatactaatgatggattgcatatcacatcaatgactggttcttggttagctattgttcaaggatttgctggtatgagagtaattgatgatgaacttcaattctcaccatttgtaccaaaagattgggaaggttataacttccgtattaacttccgtgacagattacttgaagttactgtaaataaagaaggttcatctattaaattgctaaaaggcgatgatttaacaattaagttaaatggtgaatctttgacattaacaacagaaaagtag

SEQ ID NO: 28 - DNA, 2073 bp, Lactobacillus salivarius
  isolated from gut, Lactobacillus salivarius
atgcgatatgatattaaagacgtgacttttaaagtcagaaaggagaagagcatgccaaagaataattataatgatgactcaattcaagttctaaagggtctagaagctgttagaaagcgtcctgggatgtacataggctctacagattcacgtggattacatcacttagtatatgaaatatttgataacgcagttgatgaagcactatctggttatggcaaagaaattaacgttattattcataaagatgattcaataacagtagtcgataatggacgtggaatgccagttggaatgcattcaatgggaattccaacagtagaagtaatttttaccgttttacatgcaggtggtaaatttggccaaggcgactataaaacttcaggcggactacacggcgttggtgcttcagtcgtcaacgcactctcctcaaagttaactgtaaatactgttcgagatggaattgaatatgaagaagattttgttaacggtgggcaacctgtaggaactttacgtaaaattggtaaagctaaacgtaaaagtggtacaaaagtaacgtttaaacctgatgataatattttttcaacaacaaaatataattttaatactttagcagaaagattaagagaatctgctttcttattaaagggtgtaaagattactttaacagatgaaagaaccgacccatatactgaagaagaattcttatatgcggaagggattaaagaatttgtagaatatttaaatgaagataaagatgtattaggtcctgtcatgtactttgaaggtaaaaaagatggtatcgaagttgaagttgcaggccaatataatgatggatattctgaaactataatgtcatttgttaataatgttcgtactaaagatggtggtacacacgaagcgggaatgaaagctgcatggactaaagcttttaatgaatatgctagaaaaattaaccttcttaaagacaaagataagaatcttgaaggtagtgatgttcgtgaaggactttcagcagttgtttctgttcgcattcctgaagaattactacagtttgaaggacaaactaaaggaaaattaggaactcctgaagctcgtcaaattgttgatagtgttgttaatgagcaattaggttatttcttaatggaaaatggtgattttgcccaagagttagttcgaaaatctattaaggcacgcgaagcacgtgaagcagctcgtaaagcacgtgatgaaagtagaaatggcaaaaagagacgtaaaagcgaacgcctattatcgggtaagttaacccctgcgcaatctaagaatgctaaacgtaatgaattattcctagtcgaaggtgattctgccggtggttcagcaaaacaaggaagagatagaaaattccaagcaatcctaccattacgaggaaaagtattaaatacacaaaaagccaaattacaagatatcatgaagaatgaagaaatcaataccatgatttatactattggcgctggagtaggtgcagagttcaacattgatgatgcaaattatgataaagttattatcatgactgatgctgatactgatggtgcacatatccagacattgttattaacgttcttctataagtatatgcgaccaatgattaatgcagggagagtatacatcgcattaccaccattatataagattgaaaaaactgttaagaaaaagcgcgttattaagtatgcatggactgatgctgaattagaaagtgctactaaagaactaaaaaaaggatacactttacaaagatataaagggttaggagaaatgaacgctgatcagctttgggaaacaactatgaatccggaaacaagaacgttggttcgtgtgagaatagatgatgatacaatagctgaaaaacgtgttacaactctaatgggtgataaagtagagcctcgtcgtaagtggattgaaaaaaatgttaaatttactttagaagaagatggaagcttgttagatacagttgtcgctgaaggagctcatggcgaaatttctgacgataagttaaaggatacagaggctttatttgataaaaatgattattaa

SEQ ID NO: 29 - DNA, 501 bp, Lactobacillus salivarius
  isolated from gut, Lactobacillus salivarius
atgaaaactaataatttagttaatacacaccaacttaccttacttgcagttattgtggccgctaatgtcgctattgctcgtgtttttttgatacctattcctatgacacatggaaatatcaatctctgtgatactggtattttcctagcagcttggctttttggttctaaaaaaggcggtgttgttggcggacttagtggatttttgttagatctgatttctggttatcctcaatatatggtgttttcattaattgttcatggactagaaggctttatcgttggtaaattgaccgaagataagaaaatttctgccaaatcacttatcatttctttaattgccggtgtattatttatggttttaggatatttagtttctgattctcttctttataagttctccactggtatcatagctgttcctatgaatgtcatccaaggattagttggggctcttgtagcggtccctctattctggagattaagaaaattagtaaagtag

SEQ ID NO: 30 - DNA, 630 bp, Lactobacillus salivarius
  isolated from gut, Lactobacillus salivarius
atgggaaaatttcaagtattagatcatccattaattcaacacaaattatcaattattagagataaaaattgtggaacaagagaatttagacaatgtgtaaatgaaatagctgaattaatggtttatgaagtttctagagatatgcctttagaagatgtagaagtagaaacaccaattacaaaagcaactactaaacgactagctggtaaaaaagtggtagtagttccaattttacgtgctggtattggaatggtagatggtatcttggaattaatcccagctgctaaagtaggtcatataggcatgtatcgtgatgaagagacactacaaccacatgaatattttgtgaaaatgccagatgacttagaaaatcgtgaaatgataattgttgatccaatgttagcaactggtggttcagcaatcatggctgttgatgcactcaaaaagcgtggtgcaaaatctataaaatttgtttgcttagttgctgctccagaaggtgttaaagcatttcgtgaagcacatccagatgtagatatttattcagcttcattagatgaatatctaaatgaagacggatatattgttcctggattaggtgacgcaggtgatagattatttggtactaagtaa

SEQ ID NO: 31 - DNA, 963 bp, Lactobacillus salivarius
  isolated from gut, Lactobacillus salivarius
atgagaacggaaatattgaagaaattcagagatgaggaaacttatatgagagatgaaattagagaaaaaattcagaaaaattcaaaagcaacttatcaagaaatatttggaaagttgctagtatcaataagtattattatcattttgctgattgtaagtgcaatctttggctttattttttcaaaaggaattgcaacatttacggaaaataatgctcaagttaaagatttttttacaggtactaattggaatccaagtatgaatgaaaaaggacatccgcaagtaggagcattaccaatgattttgggatcatttggtgtaactttactggctgcaatttttgtaacaccttttgctataggaacggctttgtatataacagaattggcttcaaagaagatgaagaaaattttacagatcgttattgaattattagtaggaattccatcagtagtttatggatttatcggattaaacgtggttgttccttttatcagagaaaattttggtggtacgggatacggtattttagctggagcagtagttttgtttgtaatgattttaccgacagttacttcattaacagtcgacagtttaaaagcagtacctaagcattatcgttctgcttcattggctttaggtgctactccatggcaaacaatgtttcatgtgactttaaaagctgctacttcgggtattttaacagcaatagtttttggaatggcacgagcttttggtgaagcattagcggttcaaatggttataggaaatgcatcattaatgccaactagcttattgaatccagcatcgactttaactagtgttttaactatgggaattgggaatactgtaatgggcacagttggaaataatgctttatggtctttagctttagtgttattagcaatgtctttgatctttaatttaattgttcgattgattggaagaaaggatattaagtaa

SEQ ID NO: 32 - DNA, 2961 bp, Lactobacillus salivarius
  isolated from gut, Lactobacillus salivarius
atgcagtcgactaaccaaaaaataaagaatgcaattttgaattcttttttggacaaaaatacatttgagcaaaatgatgaatatgctgccaaattaattgctaataccaaagatgaaacaatgtataatcgtatcttggatgaagttcaatattgtaaatcttttacatttgcggtggcttttattgagagtggtattcttaattctttaaagacagttttgaaagatctgaatgttcaaggaagaatattgacatctacatatctatactttaataaacctcagatgtttagagaattattaaagctaccaaatgttgaaataagagtctatgaacagaatcatggtaaatttcatgcgaaaggctatctatttcaacatgaaggctatcattctgcgctagtgggaagttctaattttactgctggtgctttaaaagtaaataaggaatggaatttactttttacttctcataataatggaaaactcacagaagacatagcttcagaaatagaggaacaatggaaaggagctagcaaattaactcctgagtggattgatgagtatgagaaaaaatacaagattcaaaataaacctgcgataaaagttgtttctcaatcggtagatgaagataacagtaattactctataattaaaccaaataagatgcaaaaagaggcattgaaaaatctacaaaaactaagacttttgagagaaacaaaaggtctgatcatctctgcaacaggaactgggaaaacatatttagctgcgttagatgtgaaaaattataaccctaaacgctttttatttgtagctcatagagaacaaatactaaagaaatccttagatagtttccataaagtactaggtggagataaaaagacaaattatggaatattatctggaaatactaaaaatactgatgcaaaatatttatttgcaacggttcaaactttaagtaaagctgaaaatttgaaccagtttaaaagagatgaatttgattatattttaattgatgaagctcaccatgttggaagtaaaatatatggaaagttactagactattttactccagatttcttgttaggaatgacagccacacctgagcgaagtgatgataagaatatttatgaattatttgattataatgttccttatgaaattagattacaagaagcattggaagaagaaatgttagtaccctttcactatataggtgtatctgattatacatataacggcgaagttattgatgataatactaatttgaaatatctagttagtgaagaacgagtaaaatatgttgtggaacaaagcaagtattatggttatgatggcgatgtactccatggtttagtttttgttagcagaaaagaagaagcagatgaaattgctaagttattaaccaaaaatggatatccagcacaaatgttaagtggtgaagatagtcaagaacaacgtgaacaagctattgaaaaactaaaaaatggagaattaacatatctagttacagtagatatttttaatgaagggatagatattccttttataaatcaggtaattatgatgagaaaaacagaatctgtaatagtatttgttcaacaattaggtcgaggtttaagaaaagctcaaggaaaagaatatttaacggttatagatttcattggtaactacaagaataattatttgataccagtagcgttgacaggtgaccaatctaggacacgtgaaggcattagagaacacgttgaaactggacaaatagaaggtttatcgacaattaattttgaattagttgcgaaaaaacgaattttgaaacagttgagaggaaagaaaaatctctttactttagaaataaaaaaggattatcaagaattaaagagacgtttgaataaaacaccattgatagccgattttataaagaataacatggttgcttcacaagctattttgtctattttgaataaaaaaggtaattataatgattttcttcttaaggttgataaagacgctgcttattcatgggaaaatgattatttagataagacccttacttttattacatcagaatttttaagtggaaaaagaatacacgaattattgttattgcaaaaacttttagacaatggtgtgagttctagatcagagttggaaaaactagtagttgataatggaagttactgtaatgatgatgtattgaatagtgtggaaagaattctaactctagagtattacaaacctaagagttatgatgataagaatgataaagagaaaaataaaacagaattcgctaaattaggtgggcaaacattaattgaaatcggtaataataaggaatatcgtttcaataaagagatctctgaattgttagaaaaggatcatggctttaaaaagctctttgtagatgttattaaagctggattattgaatgctcgtgaatatgataaggaaaatatctttacgatagaaaaaagatacactagatcagacgtcaatagattattgaattggcagaggaaaataccagctcaaagtatagggggatacttcattgaaaatggttattgtccaatttttgtgacttatgtgaagagtaatgatatagagaattccatcaagtatgaggatagatttatatctaatagcaaaattcattgttatacaaaaaatggaaggaaattaggaaaaggtgaaacattaaagatgtttgccggagttagtgaagggaaccccaaattaacatatttgcttttcgtaaagagatcagatgctgaagatgatgatgagtttgtttacttaggaacaggtaaagtaacagctgattctctgaaacaagaatatagagaaatagataaaaaaggtaagttagtaaatacaccaattgtttcgtatgatcttaagttagacataccagtatcacttgcaagatacagaatgttaacggaaagaagtaatgagtaa

SEQ ID NO: 33 - DNA, 1248 bp, Lactobacillus salivarius
  isolated from gut, Lactobacillus salivarius
gtgtatctagcgataaatattgttggtgtacttgtttttttagcgattggttggcttttatctaaggatcgtaagcaaattaattggcgtgccatcgctgtaatggtattatttaacttatttttggcatggttcttaacaagtttttcaatcggacgtgcaattgttgatggagctgcagctggatttaatgaattaatgaaagttgcctatgtaggtatcgaatttgcggttcctagcatggttaaagttaagcaaatggactggtttgtttctgtacttctaccaattttgatgatcgttcctttattcgatatcttgacatatattggtattttaccttgggttattaaatggataggaagaggactttcttggttgacaggacaacctaaatttgaatctttctttgctattgaaatgatgtttttaggtaacacagaagctttggctatttcaagtttgcaattaaagcaaatgaaggctgaacgtaacttaactttagctatgatgtctatgagttgtgttactgcttcaattattggtgcatatactcaaatgatgccaggtagttatattttaactgctgttccagttaacgttattaatgccttaattgtaacatctatgttgaatccagtaacagtgactaaagaagaagatacagttgctacaatgaaaggatcagcagctgctgaaactgaagtgggcgatgttgatgctgaaggtaatgcagtaaaagaaccattcttctcattcttaggtgattctatcttaggtgctggtcgtttggtattaatcattgctgctaacgttattgcttttgttgctttagccgcattaattgataagcttttaggatatattaatccatggttatctttagaacatattttaggtattgtaatgttcccatttgcatggttaacaggtttgaatgttcaagactctttccaatttgctcaatacatgggtatgaagttggtaacaaacgaatttgttgtaatgggtaaggttacaggcacaattagtacacacgcatttaatcctcattatcgagcaatgttaacagtatttttaacatcctttgctaacttctcaactattggtatgattattggatgctttaaggggattgtaaataaggaaaagaatgatttaatttctaagaatgttggttatatgttagtttccggtattctagtatcacttctttctgctgctatggttggtttgttcgtttggtag

SEQ ID NO: 34 - DNA, 867 bp, Unknownn
  isolated from gut, unidentified
atgaagctaacaacaacggacttaacaaaaagatatggtcaaaaaacggtagttaaaaatctgaatcttgaaataccggctcaatcgttagttgcctttctagggaataatggtgctggcaagtcgacaacaatttcgatgctgattggtttgttgaaaccaactgctggtcaaattaattttcttgatgagcataatcaaccatgccaacccaaaattggagtagtttttcaaaatagtattcttgataatgaattgactgtcaaagaaaatttgtattttcgggcaatgatgcagggaaaacagtcggttgctaatattggaaaagtgacagaggttttgggattgagcaacttccttgagcaaaaatatggtagtttatccggtggtcaaaaacgacgtgttgatattgcgcgtgccttattgaatgaccccgactttctatttttagatgagccaactactggattagatattcaaactcggacggtcatttggcagctgttaaatgatctgcgtcaaaaaaataatttgactatttttttaacaacacattacttagaagaagctcatgatgctaatctggtttatatcgttaatcaaggggcagtcattgcttgtggttctgcagcagaaataattgcagcaaatactgagaattatcttgagattaggacatctcacaagtttgcctttcaagctaattgtgaaaaagttggtcaagatcagtatcgtataatcgatcttccaatttcagctgcgattgattttctagcacagaatcgagcagtaattgagcaatttgagtatcatcatggcacacttgacgatgcatttatgaatttaactggaaaggagctgcaataa

SEQ ID NO: 35 - DNA, 2553 bp, Lactobacillus salivarius
  isolated from gut, Lactobacillus salivarius
ttggtagatttaccaaatagaattaaagacgttgatttatctaaagttatgcgtacatcgtttttagactatgcgatgagtgttattgtagctcgtgctttgcctgacgtacgcgatggtttaaaaccagttcatcgtcgtatcttgtatggaatgaatgaattaggggttactcctgataagccatataagaaatccgcacgtattgttggtgatgtaatgggtaagtttcatccacatggtgactctgcgatttatgaatcgatggtacgtatggcacaagatttcagttatcgttatatgttagtagatgggcacggtaactttggttctgtcgatggtgatggtgctgctgcgatgcgttatacagaagctagaatgtcaaagattactctagaaatgctccgtgatatcaataaagatacaattgatttccaaccaaactacgatggaactgaaagagaacctgttgttttaccagcacgttttcctaatttgctagttaatggggctacaggtattgctgtaggtatgacgacaaatatcccgcctcacaatttgggagaagttatttccgggattcatatgttaatgaaaaatcctgatgtaactacagctgatttgatggaggcaatccctggaccagatttccctactggcgcaattgtaatgggaaaatctggtatcagaaaagcatacgaaacaggtaagggtactgttactttacgtgccaaagttgaaattgatgagcaagctaatggaaaacaacaaattgttgtacacgagttgccatacatggtaaataaagctcgattaattgaacgtattgcagaattagcacgtgaaaagaaaatcgaaggcattactgatgttaaagatgaatcagatcgtgaaggtatgcgtgtaacgattgatgttcgtagagatgttagtgcttcagttgtattaaataatttgtataaattaacattaatgcaaactacttttggttttaacatgttggccattgttaatggaacaccaaagattcttagcttgaagcaaattctacaatactacttgaaacaccaagaagaagtaattcgtcgtagaactgagtttgaattaaagaaagctaaagcaagagctcatattttagaaggattacgtatagctttagatcatattgatgccatcattaatatcattcgtggttctcaaagcccagatgtagctaaagatagattgatgaatgaatatcaattaagtgataaacaagctcaagctatcttagatatgcgtttagtacgtttgacaggacttgaaagagacaaagttgaaaacgaatattcgaagacaatggcagcaattgcagactatgaagatattctagctaagcctgaaagaatcgataagatcatttatgaagaactactagaaattcaagaaaaatttggtgatgaaagacgtactgaattgatggttggtgaagttttaagtattgaggatgaagatctaatcgaagaagaaaatgtagtagttacattaacacataatggctatattaaacgtctaccaactagtgattttaaggcacaaaatcgtggtggtagaggtgttcaaggtatgggagtccatgacgatgacttcattgaacatttattgacaacttcaactcatgatgaattgctattctttacaaatgttgggaaagtataccggatgaaggcatatgaaattccagaatatggtagaacagctaaagggattccggtaattaatttattggacatctctgcaaatgaaaaaattcaaacagtgataaatattcctgcagataaagttcaaactgacaaggaaatgtatctgttctttatcacacgtcaaggaacggtaaaaagaacttcagttaatgaatttggaaatatccgtaaaaatggtttgaaagctataactttgcgtgaaggtgatgaattaataaacgtcttagctacagatgattctaagaacataattattggtactcatcaaggttatgctgtatcttttgatgaaaaagatattagatcaatgggtcgttctgccgctggtgttagaggtatccgtcttcgtgataatgactatgttataggttctgcaattcttgaacctgaaagtaaagtctttgttatttctgaaaatggctacggtaagcaaactgctgctagtgagtatccaattaaaggccgtggtggaaaaggtataaagacaacaaatatcactgaaaagaatgggccattggcaggactaacaactgtaaatggtgatgaagatatcatggttattactgataaaggtgtcatgatacgctttaagattagcgatgtatctgaaacaggacgagcaacattaggtgtaagattaattaatttaggtgctgattcaatcgtatcgacaatgacaaaagttgagccagaagacgaaaacgaaaatagtgaagaaacaactcaagaagtaagcactgaaattagtgatgatacaaaagatagcgatgttgctagattattagatgctgctcaaaaagatggtgaatag

SEQ ID NO: 36 - DNA, 576 bp, Lactobacillus salivarius
  isolated from gut, Lactobacillus salivarius
atgaatgagaacgacaaaatgaagataaaagaagtaattgttgttgaaggaaaagatgatacaaaacgaattcaaatggcagttaatgctgatactttagaaacaagaggatcggcaataagcgacgaaactttagatcaaattgaagacttatatgataaacgtggagtaattgtttttacagatcctgatttttctggagaaaagatacgtaagataattacagaagctgttccaggagtaaaacatgcatttttgacaaagcatgatgcggctcctagtcataaaggtagtttaggtgtagaacatgctagccctgaagcgataagagaggctcttgcccatctatatacagaagtacctgatggagagccactaatctcaagagaagatttagcagtagcaggattaacatctggaccacaagctaaagaatatcgcagaagattaggtgaatatttaagaataggctatacaaatgggaaacaattgtataagcgcttgaaattattccaaataacaccagatgagtttaaaaaagcactagaatatataaagaatgaagataactattaa

SEQ ID NO: 37 - DNA, 1203 bp, Lactobacillus salivarius
  isolated from gut, Lactobacillus salivarius
atggctaaacttattgtttcagatttagacgtaaaaggtaaaaaagttcttatgcgtgttgactttaatgttcctattaaaaatggagtaattggtaacgacaaccgtattgttgctgctttaccaacaattaactacattattgaacacgatggaaaggctattttattctcacacttaggacgtattaagaaagaagaagataagaaagaattatctttacgtccagttgcagaacgtcttgcagaattattaaacaagcctgttacatttgttcctgctacacgtggagcacaacttgaagatgctatcaacaatatgaatgatggtgacgttcttttagttgaaaatactcgttttgaagacttagatggtaagaaagaatctggaaatgatccagaattaggcaagtactgggcatcattaggtgatgtatttgtaaatgatgcatttggtacagctcaccgttcacatgcttctaacgttggtatttctgaagctatgaaagctgaaggtaagcaagctgctgcaggttacttacttgaaaaagaaatcaagttcttaggtaacgctgttgacagtccaaagcacccatttgttgctatcttaggtggtgctaaagtttctgataagattggtgttattaaccacttattaggaaaagctgataaagttatcgttggtggtgggatgacatatacattctacgctgctaagggtatcaaaatcggtaactctttagttgaaaaagataagatcgaattagctaaggaaattatggaaaaagctggcgataagctagtattacctgtagacaacgtatgtgcaaaagaatttaacaacgatgcacctagtgaagttgttgaaggtgatattccagatggctacatggctctagatattggaccaaaatctgttgaattatttgaagatactttgaaagatgctaagacagttgtatggaacggacctatgggtgtatttgaaatgagcaactttgcaaaaggtacacttgaagtaggtaaattcttaggtactttaagcgatgctacaacaattgttggtggtggcgattctacagctgctgtacaacaattaggtgttgctgacaagttaacacacatttctactggtggtggtgcttcccttgaatatctagaaggtaagacattacctggtatcgctgcagtttctgataaataa

SEQ ID NO: 38 - DNA, 1059 bp, Lactobacillus salivarius
  isolated from gut, Lactobacillus salivarius
gtgacgaatttggaaacaacaaagattacacccaaagttttcattgatcgtgttttaggcggtactgccatcgggattatagttggtttaattcctaatgctgttcttgccgctatcctcaagatgttcggcactaatccttttgccgtacatttaggacaagcagcaattattttccaattaggaacacctttaattattggtacattgattgctcaaaagtttggctttgatggcatgaagatgactgtagttggtggagccgcatttgtaggttctggcgtaattaaatactttccagcgttgaataagacaggagcttacgtaggtgctggaacaggtgatattattaataccatgttaacagcagcaattgcggttggtttaattctgttaataggtgataaatttggatcagtagcgatcgttctaacaccaattgtagtaggaaccggtgctggattaattgggttctatatgtatccatatgttacagcgataacttccgcaattggtaatgtgattaacacatttacagaattacaaccagttttaatgtgtattttaattgcctgctcttttgcagtgttaattatctctccaatttcaacagtagcgattgcaatggctatccaagttaacggcttagctgctggtgctgctgcaatgggagttgctgcaacaacacttgtacttgtagtaaactcatggaaagttaacaagccaggggtaacaatcgcgattgccttaggtgcgatgaagatgatgatgcctaacttatttagacgtccaattatcttagtaccatgtttctttacagcaataatttctgcagttcctgtagctttgatgtcaatttcaggttctcctgcttccggtggttttggtttagtaggtttagtaggaccattagcatcaattgaaaaaggcttaggcgttgtcgcagcattgctagcatggttagttattccagttattgcgtcacttgtcggtcaattcttatttgaaaaagtatttaagttatatgaccgcaaagatgtttttgaatttttaggttag

SEQ ID NO: 39 - DNA, 1185 bp, Lactobacillus salivarius
  isolated from gut, Lactobacillus salivarius
gataacgaggaggattatattatggataaaaaggtaattaatgataaatttacagaaatttttggtgaacaagctgaagctacattcttctcaccaggacgtattaatttaattggtgaacatacagactataatggtggtcatgttttcccatgtgcaattagcttaggaacttatggtgctgctcgtaaacgtgaagataataaattacgtttttattccgctaactttgaagatttaggaattatcgaaacatcgcttgatgatttaaagtacgacaaaaaagataattgggtaaattatgctaaagggatgatttatttcttaaaggaaacaggtcatgatgttgataaaggaatggacatctttattgaaggaaatattcctaacggttctggcttatcctcgtccgcttcattagaaatgttaattggtgtaattgcccaagaattatttaacttagatattgatcgtgttgacttagttaagttaggaatggaaacagaaaataaatttattggtgtaaattctggtattatggatcaatttgcagtaggaatgggtaaacaaaaccaagcaatcttattagatactaatactcttgaatattcatatgcaccagtagatatgggaaataacgtaattgttattatgaatacaaacaaacgtcgtgaattagctgattctaagtataatgaacgtcgtagtgaatgtgaaactgcagtaggtgaattacaagctaaattagatattaagactttaggtgaattagatgctcaaacttttgatgaatattcttacttaattgaagatgaaaatcgtttgaagagagcacgccatgctgtatgggaaaatcaacgtacaatgcaagcacaaacagcattagaagaaggtgacctagaaaaatttggtcgcttagtaaatgcatcacatgtttcacttgaacatgattatgaagttacaggaatcgagcttgatacattagcacatactgcttggaaacaagacggtgtacttggagctcgtatgactggtgctggctttggtggctgtggtatcgcaattgttgataaagacaaagttgaagcatttaaagaaaatgtgggtaaggtttatacagaaaagataggttatgctcctgcattctatattgcagaaattgcagatggaacaaaagtactttaa

SEQ ID NO: 40 - DNA, 1407 bp, Lactobacillus salivarius
  isolated from gut, Lactobacillus salivarius
atggtagttggagattttgcaatagatttagatacagttgttgtaggtgctggacctggtggatatgtagctgcaattcatgctgcagaactaggtcaaaaagttactgtaattgaacgtgaatatattggtggtgtatgtttgaatgttggatgtattccttctaaagctttgattgaagctgcacatcattaccaacatgcaatggattctcaagaaatgggacttcaagttacagctgctaagctagacttcgataaaacaattgagtggaagaataacgttgtagctcgtttaacaggtggggttgcttccttatttaagaaacataagattgatgttatctggggaaatgcatatttgaaagatagtcatagtttacgagtaatttctgatgatgataaggctcaaacatatacatttaataacttgattattgcaacaggtagtcatccaatcgaaattcctaacttcaaatttgaaggacgtgtacttgattctacaggtgctttgaacttaacagaagttcctaaagaattagttgttgtaggtggtggctacattggttctgaattagcatctgcttacgctaacttaggctctcatgtaaccatccttgaaggtggagatatgattttagctaactatgaaaaagatttagttaaagttgtagaacatcacttcagtgaacagggtgtagatatttatactaatgctatagctaagaatgcagaacaaacagataaagatgtaactgttactttcgaagtagatggcgaagaaaagaaaattacagctgattatgtcattgtttctgttggtcgtcgtccaaacacttcaaatatgggcttagaacaagctggtgtaagtgttgatgaacgtggtttaattcctgttgatgcacaaagtcgttcaaatattcctaacatttacgctattggtgacgtaacgaagggatacgcattagctcataaagcttcttacgaaggaaaggttgcagcagaagctatttctggcaaaccaacagttattgattaccatgcaatgccagctgtatgttatacagatacatccattgcaacaacaggtttgacattagctgaagcaaaggaaaaaggctttgacgctaagaaagcacaattcccatttgcagctaatggtcgtgcaatttcaatgggtgaaacagatggatttatccgtttagtatttgaaaaagaaacaggtgtcttattaggtgctcaaatggttggtagcaacgctagtgatttaattagtgaattaactttggctattgaatgtggttcaacagttgaagatgttgcattaacaattcatccacatccttccttaagtgaagctgttatggatactgctgatgttgccattggattcccaacaaatatttaa

SEQ ID NO: 41 - DNA, 336 bp, Lactobacillus gasseri
  isolated from gut, Lactobacillus gasseri
atggaaacatggaataatcttcaggattgtgccaaagccgtcgatatcttgtcgattggccaatatggctttaatctggtgaaaatcccatcatcatggctccatatggacgtcggcttatcatttctacatgatacatcgcccctagttaataaaatcggccggacaatcgatcaatttttgcttcttgctatatctagaatcattgatattgtatactacggttatagtatgatcaggtttactactggcgatatgactggtcttcttggtattataagattagttatgtttagtaatgattatcaaaagaaggagatgatttcttatgattga

SEQ ID NO: 42 - DNA, 1359 bp, Lactobacillus salivarius
  isolated from gut, Lactobacillus salivarius
atgtttagtaagataggtcaactaatctttgacaatgaagctgttgctaagacttctgactttactatgggtttagaaattgaaatgcaacgtgttgatgataccggacatctaagccaggagccttatccgtcagctattggagatgagaaaactaacccttggattacaaatgatttcttagaaacaatgtctgaggttgtaacacctgcagctagtcacgcacttgatgcaatgcattatctttacgccatcaataatgtgctacgttctgcattagctccaggagaactactctggccactttcaatgccgcctaaattgcctaaagataaaagtacaattcaaactgctaaaatgggaccagtaaaagaagcttatttcaaggaattcatcaagcgtcacggcttttccaagggtactccatgtggtgcccatattaatttgagtattgatgatcatatcattgacttggttttaaagaattttcctgagcgtttcaaaaatagaattgaagtccagaactatctttatactgttttagctcaaggctttatgcgctatcgatggcttattacatatctttttggtgctagtccaattgctgaagccaactatttcgacaaagaagatgaacttccccatcctattagaagtattcgtcagagttcttatggctttggtactcgatttagtggctgctttgtcgatgttcaaaaatatgttaaacgtattgaagaaggacttaaacaaggagtattgattgctgaccatgatttccatagccccgttcgttttaaagggactaaagatttcagagatcttcctaaaaaaggtgttcaatatcttgaattaagaatgttggatcttgaccctagtagttctgtgggcgttagaactggcactcttcgctttattcgtctactctctagttatttcatcatgcaccctgctttaaaggctgatgatgtcgaccaagttctcggtaaagctgatgaaatgaatgaagatgtatcagtagaattacctactgaccaatgtaaatatcaaaataaggctcgtgcttttatcaagagtcttgaacgttttgcgaatcaaatccagttaggaccagaatatcaagaaattcttgaagatttagaagatagagttgaaaatcctaagacaactcctagtgctaaattattaagctacgttgaaaataattctttagaaaaatatgcgttaagacgtgccaaacactatcaagaagctgctttagaatctatctatcaatttaaaggctttgaagataacgcacctatgtctgcagaagatttaaaacgtgaattattctatggtaattgggaagtgcaataa

SEQ ID NO: 43 - DNA, 2499 bp, Lactobacillus salivarius
  isolated from gut, Lactobacillus salivarius
atggttatggctatggaagaaaggtatacaccaagtgctaaacaagtattagttcttgcacaacaacaagctaattacttcaagcatcaagcaataggaacagagcatttgcttttagcactaacaatggagaaaaatggcgtagctgctaaagtattacaaagttttgtagtaactgaagtagatgtgcgagaagaaattgaacatatcgtaggatacggtaatttacaacgtagaggcgctgatacttatttaccatattccccaaggactcgttatgtattagagcgtgctagagaacatgctaaactttttaatgttgaaaaggtaggaacagaacatattttgttagcattattagaagatgataaaactatttcttcacgtattctagcagctctgaatattgatttacgtaaggtgaaaaatattacctatcgtacaatgggtgtagatgcaacaacagctaatagaacacgtaagaaattagcgttatcagaaaagaaacaggataatggtacacctacgttagatgaattagcacgtgatttgacagaaatggtgcgtaaagatcaaattgatccagtagttggtagagataatgaaattaagcgtgttgttcaaattttaagtagaaggacaaagaataatccagttcttttgggagaaccaggtgtaggtaaaacagctgttgcagaaggattttcacaaaagattgtaaatggtgaagttcctgataatttgaagaataagcgtgtaatgatgcttgatatgggatctttggttgctggaacaaaatatcgtggtgaatttgaagatcgattaaagaagattattgaagaaattcgtgaagatggcaatgttattttattcattgatgaaatgcatactctaataggcgcgggtggtgctgaaggcgcaatagatgcttccaatattttaaaaccagcattagcgcgtggtgaagtacaagtaataggtgcaacaactttaaatgaatatcaaaaatatgttgaagctgatgcagctttggaaagacgctttgctagtgtgacaattaatgaaccaactccagaagtagcgttgacaattctaaaaggattacgtcctaaatatgaaaaacatcatcaacttcaaattacagatgaggcattagagagtgcagttaagttaagtaaaagatatattgcttcaagatttttacctgacaaggcaattgatttaatggatgaggctgctgctagagtaagaattaataattcacaaaaagtggacaaagtttctgcaataaagaagaaattatcagagctttcccaagagaagacagaagcgttgttaaaagaagattttgaaaaagctgcagaaatcagaaatgaagaattaaagattcaagaaaagcttgaaaagcaaatccaacgtgacaaagatgaagaggatagcaataactatcgtgtaaaagttacggctgaagatattgcagaagttgtttctgaatggactggtgttccagtaactcaaattaatcgttctgaaggagaccgactaattagattagaaaagatattgcataatcgagttataggacaagatgaagctgttaaagcagtaagtaaagcgataagaagagcaagaagtggtttgaaggatcctacaagaccaattggctcatttatgttcttaggtcctacaggtgtaggtaaaactgaattagctaaagctttagcagaagctatgtttggctcagaggattcaatgattagaattgatatgagtgaatatatggagaaatacacaactagtcgtttaattggatctcctcctggatacgtaggatatgatgaaggcggacaattaactgaaaaggttagaaataatccttattcagtagtattattagatgaagttgaaaaagctcataatgatgttttcaatatcttgttacaagtattggatgatggatttttaactgattctaaaggtagaaaggtagacttcagaaatacaattatcattatgacatctaacttaggtgctacagccttacgcgatgaaaaatcagtaggttttggtgcaaaagatgtcagcgatgattatgaagcaatggcagcaaaagttagagaaacattgaagaagacttttagaccagaattcttgaatcgtcttgacgaaactgttgtattccattcgcttaataaagaagaaattcatcaaattgttaaattgatggctaagaatattatagataggattaaagaacaaaatattaatctgaaaattacccctgcagcaatagatatagttgcagaagctggatttgatgctgaatatggtgctcgtcctattagacgtgtccttcaagataagatagaggacttactaagtgaagaattattagcaggtaatatcgaaactggagcaacagtaacaataggtgctaaaaaaggtgaaataacgataaaagttaagaatccagtagctgcagaaaaaataaatagttaa

SEQ ID NO: 44 - DNA, 1203 bp, Unknownn
  isolated from gut, unidentified
atgaataaaatttcacctcgtttaacattatttgcactggctattaatgcttttgcaataggttctactgaatttattagtgttggattacttccaatgatcgttaaaagtttcaatattagtttatctcaagctggactaactgtttcattgtatgctttaggcgttactattggcgcacccttgttaacaattttaactggtaaatggagccgccattccctaatgctgggaatcatgactttatttataataggtaatttacttgcagcttttgctccagtttttgctattttactattgggtagaattttagctgctttagctcatggaatattcatgtcaatttcaacagttatagctgctgatgtagttgaaccttctcgtcgcgctagtgctattgcaattatgtttactggactaactgttgcaactgttacaggtgttcctttggggacttttattggtcaacaaacttcttggaatatgtcttttatcttcatcgctaccgtgggactcattggtttaattgctgattattttttaattcctaaatctttaccaattcctggaaaagtagatttgcatggttttattcgtatctttactaataaacctttagttctatcattcctgattactgcttttggctatggaggaacttttgcagcatatacttatctttctccattactagaaggagtaggattttcagcaaacgccattgtcattattttagttatttatggagtaatggtcgctattggcaatactttaggaggtcgttttgctaatactaaccctcttaattctttgataaagatgtttgaattgttaatgactaccttacttttcctttttgttgcagttttggctaataatgggatactaacattactagcaagtatattacttggtttattcgcctttatgaacgttccgggcttgcaattatatgtagttcaattagctgaaaaatatgtacctaatgatattactctggcttcagctttaaacattgccgcttttaatatcggtataacactaggatcatttatcggttccagtgtgactgatactttatcagttatatacacacccctatttggagccatagtcgtgattatcgctattgtactaattctattcattagaaatgatcgtcaatctatctctgatgtaattcctgaagaaaataaataa

SEQ ID NO: 45 - DNA, 1641 bp, Lactobacillus salivarius
  isolated from gut, Lactobacillus salivarius
atgggaggaatttatatggcaacgccacaagaaattttaagaaatccatttttaaataaaggtacaggcttctctaaagaagaaagagaagaattaggcttagtaggattattgccaagtcacgttcaaacaatcgaagaacaagctgaacgtatctatgaacagtatagctcaaagacatcaagattggaaaaaagaatttacttaatgtccttatttaatactaatagaacattattcttttatctaatgggacaacatttaagagaatttatgccaattgtttatgatccagtagttgctgaatcaatcgaaggatacaatcatttatttatgcgtcctcaagaagcagcatttatttcaatcgataaacctgaatcaattgaaacaactttgaaaaatgtagctgatggtcgtgacattcgcttaattgtagttactgatgctgaaggaattttaggtattggtgactggggtgttgatggtgttgatattgctattggtaaattaatggtttacacagctgcagcaggtattaacccagcacaagttttaccagtttctattgatgcaggtactaacaacaaagaattattggatgatccattgtacttaggtaacaaacatgaacgtgtctatggtgaaaagtactacgaattaattgataaatttgtagctgcagttcaaaaattattcccagaatcaatgctacattttgaagactttggtcgttctaatgcggacgttattttaaataagtataaagataaaatcttaacattcaatgatgatattcaaggtacgggtattgtttgtttggcgggtgtcttaggtgctttaaacatttcaaaacaaaaattcacagatcaaaaattcttaacttttggtgctggaacagctggaattgggattgctcgtttaatgtttgatgaaatgaagcgtcaaggcttgagtgaagaagaagctaagaaacacttctatcttgttgataaacaaggattattatttgacgatacagaaggattaactgaaggtcaaaaagcatttgttcgttcacgcgatgaatttgaaaatgctgatgaattaacaaacttagaagctgttgtaaaagcagttcatcctacagttatgattggtacttcaactcaaccaggtgcgtttactgaaagtgtaatcaaagaaatggctgcacatacagaacgtccaataattttcccaatttctaacccaactaagttgattgaagcacatgcagatgacttgattaagtggactgaaggtcgtgctttagttgcaacaggtattccatcagatgatgttgaatataatggggtaacttataagattggtcaagctaacaacgctttgatttatccaggtgtatgttttggtgcaatggcagcaagttctaaagtgttgaatgaagaaatgatttcccaagcaagtcatgctttaggtggaattgttgatcctgatgaaccaggtgcaccagttttaccaccaattgataagttacaagaatttacaacaacagttgctgaaactgtagctcaatcagttattgatcaaggtttgtctaaagaaaatgtgacagatgctaaaaaagcagtagctgacatgaaatgggaaccacgctattaa

SEQ ID NO: 46 - DNA, 1722 bp, Lactobacillus salivarius
  isolated from gut, Lactobacillus salivarius
atgactaaggttttaaacggtatcgcagctagtgatggtattgcagctgctaaagcttatatgctcgttcaacctgatttatcatttgaagaaaaaactattgataatccagatgctgaaatcgaacgtttaagtgcagctgttgaaacttccaaacaagaactcgaagtcattaagcaaaaagctactgaaaatctaggtgctgaagaagcacaagtttttgaagctcatttgacaattttatccgacccagaattatttggacaaattaacgataaaattaagaatgacaaagtaaatgctgaagctgctttgaagagtgtaactgatatgttcattcaaatgttcgaagcaatggaagataatgcttatatgcaagaacgtgctggtgatattcgcgacgttactaagcgtgttatgggtcacttgttgggagtatctattcctaatcctgcattaattaatgaagaagtagttattgttgctcatgacttaactccttccgatacagctcaattggatcgtaattttgttaagggattcatcacagatattggtggacgtacttctcactctgctattatgtctcgtacattagaaattcctgcagttgtaggttctggtaatgctacaagtgaaatttctgaaggtcaaatggttattattgacggcttagatggacaagcattagtagaaccaactgacgaagaattagaagattacaaggctagagcaaaagcttttgctgatcaaaaagcagaatggaaattattgaaggatgctaagtcagttacagcagatggtaaagaagttaaattagctgcaaacattggtacacctaaagatgttgaaggtgcaaatgataatggtgcagaagcagtcggcttattccgttctgaatttctttacatggatgcttccgaattgccatctgaagaagatcaatttaaggcatacaaagctgctgttgaaggtatgaatggtaagcaagttgttgttcgtacaatggatattggtggagataaggaattgccatatcttccattaccagaagaacaaaatcctttcttaggatatagagctattcgtatttctttagatcgccaagatattttccgcacacaattaagagctttgttgcgtgcatcccattatggtagcttagctattatgttcccaatgattgctactgtccaagaatttaaggatgcaaaagctatctttgaagaagaaaaagcaaaacttgttgcagatggtgttccagtatctgatgacatcgaagtaggtatgatgatggaagttccagctgctgcaatggttgcagataagttagctaagtatgttgacttcttcagtattggaacaaacgacttaattggttattctatggctgctgatcgtggtaacgaaaagatttcttacctatatcaaccatacaatccttcaatcttaagattaattaagaacacaattgaagcatcacacaaagaaggtaaatggactggtatgtgtggtgaaatggctggagatcaagttgcagttcctatcttattaggattaggtttagatgaattctcaatgagtgctacttcaattttgaagacacgtagtttgttgaagacactagattctaagaagatggaagaattagctgataaagcagttaatgattgtgaaacagctgatgaagttgtagaacttgtaaatcaatacacaaaataa

SEQ ID NO: 47 - DNA, 1431 bp, Lactobacillus salivarius
  isolated from gut, Lactobacillus salivarius
atgaaacttttatttgccggtagtgaatgtgcacctttctttaaaacaggtggcttaggcgatgtaatgggggcattacctaaaacaattgctaaaacaactgataatgacgtaagagtggtacttccattctttacaggaatggctgaagaatacaagagccaactatcatttgtaacaagtttttatgtaaaagttggctggcgtgatcaatattgtggtgtgctaaagttagaaatggataacgttacttactactttattgataacttgtattattttgatagaccaggcttgtatggttactatgatgaaggcgaacgttgggccttcttccaacaagcaattattgaaatgttagaaaaaattggattcattccagatatcttacatgtaaatgattatcacactgcatttattccattcttattaaaagaaaaatatggatggattaatgcatatcaaaacattaaaacagttttgacaattcataacttacaattccaaggtgagtatggtcgtgaagtattgggagaattatttaatttagatgcttcatattacgatgatggaactgttcgttttgatactgctgttaatttcatgaagactggtattctgtatgctgataaggtaaatacagttagtccaacttatgcaagtgaaattcaaactgaagcctttgggcaagggttagatgaaattttgagaatgcataattggaagttaagaggaattctaaacggtattgattacgaaagaaataatcctgccacagataaaaatcttgtcgcaaattattctgctaaaaagttaaagggtaaagttaaagataagttagctttgcaaaaggaatttggtttacctcaacgtaaagatgttccagtgattgcaatggttagtcgtttaacagctcaaaaaggattccaactagttgtttcagaaatgcaaaacttagttcaatttgatgttcaagtgatagttttaggaactggcgatgctaattttgaacatgactttagatactttgcagatacttatcctgacaaagttggagctgctattacatttgatgttggattggcccaaagaatatatgcaggggcagatatgttcttaatgccatcagcatttgaaccttgtggattatcacaaatgatttcaatgcgttatggtacattgccaattgttcatcaaattggtggcttgcaagacagtgttcaaccatttaatcctgtaactggtgaaggaacaggatttggtttccacgatttttctggcttctatatgatgcaagaaatccaagaagcattacgtttgtatgcagagccagtagcatggacaaaagttgtaaagcaagctatgtcacaagattttagttgggaaacagcgagtcaagaatatctaaatatgtataatgaattagtctaa

SEQ ID NO: 48 - DNA, 966 bp, Lactobacillus salivarius
  isolated from gut, Lactobacillus salivarius
atgaaaaagacaataataagtggctttataatttccattattggcgctattttattagcaattggctttgggcttaaaggaaataaaagtattgtttttgaagatttaaaacctgttattgcagatagtactaaagttactcaagctcatacctataaagacattaacaaacttgatatagatgttaaagatgttagtgtggaatttagagaaggaaagaactattctgtaagatacgaaggtgcaaaatctagctccccaacggtaaagaagtctggtaatcaactacaaattaaaggacgcttaagtagtcatagcataagatttaatggaatgagcatgtatgatgattattatcgaaattctgatcgaaataagatgataattactttaccaaaggatagtaaattagatgaactaaatcttaaattatctgattctttattatcacaggttaatatgacaggaattgaagcagatcaagttaaggcatctattcatgatactaaactagatttaagagatgctaattttggaaatgtagaattatctgcaggtgattcagatattagtatgaccaatacggtgttaagtaatggtaagttagacttaaatgacacagatgtacgcttaaatggtggatcattgatgcaagttgcaatgaatattactgacggagatgtggattacaataatttgtctattcaaggtggtaacttacgtaataatgatggtgacattaagatgagtaatacacaaattcaaggtggatacaagatagatgatactgacggagatatactagtttctcgtgtaacagttgatggctatcgagttcaaagtaatgatggcgacgtaagattatttgaacaaacaacaagtaatggtaatgttttagagaagaattctaactcagataatgtattagatatcataagtaatgatggcgatattactgtaaattaa

SEQ ID NO: 49 - DNA, 990 bp, Lactobacillus salivarius
  isolated from gut, Lactobacillus salivarius
atgaaaaaaattttgatgatgtcagtacgtgaagatgaaaaggaagctattgaaaattggagtgaacgacatcctgatgtggaagttggaattgatgaaggtgagctacatgctgatacagtagctaaagttaaagggtatgatggtgttgttattcaacaaagaagtttagttgaagatgaagtatacgctgaattgaagaatctaggattaaagcaaatttctacaagaactgctggatatgatgtaattaatgttgatttagctcataagaatggtttgaaagtaacgaatgtacctgcatattcaccaagatcagttgcagaattagccttagcacataccatgcgattaattcgtaatttagaattgtttgatgaaagagctgaggaacaagattttagatggattggacttaaaggaaaagaaatccatactttgacaattgggataatcggtgctggtagaattggtggtactgcagctaaattgtttaatgctttaggtgctaaagtaattgcttatgatattaagccaaatccagaattaaatgaggttttgacttataaatctttaaatgaagtgctacaagaatcagatgtcataagtttacatgttgacttgaatgaaacaaccaaaggattaattggaagtgaagaattagcattaatgaaaccaactgcatttctaattaatgaatgtcgtggtcctgttgtagatacagatgctctaatcgctgctttaaaaaataagaagttagcaggagcagctttagatacacttacaggtgaagagaatttctttaattttgacttacgtggtaagaaattaccaagtgaacaattaaaggaattaagagcgatgaataatgttattttgacaccacatgttggtttctatactaatgttgctgttcaaaatatggttgatattagtttagatgatgtattagctattatttcagagaaaagaagtgaccatgaaatttaa

SEQ ID NO: 50 - DNA, 462 bp, Lactobacillus salivarius
  isolated from gut, Lactobacillus salivarius
ttggaaagttggatatttctagggctaattttattgattgcgtatctgggaaagaattcctcgctattaattgcaggagcagtagtaatagtaatcaagcttttcccatttctatcgcaaaaattatatccagttattcaagcgaagggaattaactggggtgtaacaatcatttcagttgcaattttaattcctatcgctactggacagattcaatttaaagatttgattaatgcgatgaaaactccagctggttggattgcagttgtttgtggaattttagtagcaattttatccaaacatggagttaacttgttatcatcaactccacaagtaacagtagctttagttattggaacaatcattggagtagtattcttaaaaggtgtagctgctgggccagttattgcagccggaattacatattatttagttacacttttaaatttgagttttagctaa

SEQ ID NO: 51 - DNA, 1092 bp, Lactobacillus salivarius
  isolated from gut, Lactobacillus salivarius
atgtatagaattatagcatctctatttgcaacaatgattctatcagctattttgactccgtttataagattgttagcatttaaagtaggagctgttgacaatccaaatgctcgtcgtgtaaataaggttcctatgccgacaatgggtggattagctatttttctagcatttaatgtgactaattttcttttattgagaaagcaatacccaatcgaacaattgtgggcattattgttagcagaatgtataattttagctactggaataatagatgatatttatgaattaaaacctagacaaaaaatatatggaataactttagcagctttagtagtattttttattgctaaaattaaaatgacaactattacattgccatttttaggtacagtaactttagggtggttaagtttaccaataacactaatatggattttagcaattactaatgcagttaatttaattgatggattagatggattagcaactggagtagcaattattgctttatctaccagtgcagttacagggtacttctttttaaatgtaactaatacttttatatcaataatgatgtttacgttagtagcagcattgataggatttttgccatataattttcatcctgctaagatatatttaggtgatacgggatctttatttataggtttcatgatctcggtttttgcattatatggtttgaagaatgcgacatttattacaataataattccagttattattttaggagtaccaataactgatactgtctatgcaattttacgaagaattttaaataaaaaaccaatttcacaagctgataagcatcatttgcatcatagactaatgcaaatgggattgagtcatagacaaaccgtattagttatttatggaatagcattgattttttcatctatttcattgctatatcctatttctagtttttggggctctgttttattgacagtggctacactattgggattagaaatttttgttgaggttattggattagttggtgaatcacgacgtccattattgaattttataaaaaaaatagttctcttgtctgaaaataaaatagaaaaataa

SEQ ID NO: 52 - DNA, 1011 bp, Lactobacillus salivarius
  isolated from gut, Lactobacillus salivarius
ttgttaatcacaaaaatttataaaccaagtgagtttaatgaagctgcaaaagaattacgtctaggagaacttgtagcttttccaacagaaacagtatatggattaggagcagatgctactaatgaacaagcagtaaagagggtttatttggctaaaggaagaccatcagataatcctttgattgtgactgtatcatcactagagatggtaaaaagatttgttccatcgttaagtaaagaggtaggaaagataatagaaaaattctggccaggttcattgacaattgtactaaaaataaaagatggtagtttatctaagacagtaacaggtggtttgaaaactgctgcgtttagaatgcctaaaaatgaaactacattaaacttgataacagcattaggtaatcctattgtaggcccttcagcaaattcttcgggaaagccaagtcccacgactgctcagcacgtttatcatgatttagagggaagaattgcaggtattttagatgatggacctactgatgtcggtgtagagtcaacaattattgatatgagtacagaaataccaacaattttaagaccaggagcagtaacagcagaagaaattgaaaaagtcataggtaaagaagtatatagtgataaacataaagttaaagaaaatgaaatacctaaagctccgggaatgaaatataagcactatgctccatcagcacaagtgttaatagttaataaagataattggaatagtgcactacagtgggcaaatgaaaataaaaatcaggtaggaatattagctgatgatgaagtgttgagtaaagccttagaaaataaaacttattcattgggaaaaaatgtagaaagtgcagctaagaatctttttgcagggcttagatattttgatgatgataatcagattaagtatattttagccgaagcgtttcctgaagaaggtgtcggtttagcatatatgaatcgtttaaaaaaatcagccggtaatcaattttataataaatag

SEQ ID NO: 53 - DNA, 804 bp, Lactobacillus salivarius
  isolated from gut, Lactobacillus salivarius
ttggaagatcaaggaatgaaaatcagcgttttagcaagcggaagtactggtaatgctacatatattgaaacacctaagagtaaagtactagtagatgcaggtttatctgggaaaaagatcgaagaattgatgaattcaattggtagaactttgaaggatgtagatagcttattagtaacgcatgaacatagcgatcatatcaagggtgtaggtgttttggccagaagatatggcatgaatatttacgctaatcaaggaacttgggacgcaatgagtgtgaaaattggcaaagttcctttggagcaaaagcatatttttgatatggggaagactttgagtattggcgatgttgatattgaaagttttggtgtatcacacgatgccgctgaacctcaattttatgagttacatcacggaaaatcttcatttgcgattgttacagatactggctatgtcccagatagtgtagctggtgtgattaataatgctgaagcttatctatttgaatgtaatcatgatacagaaatgttgcggatgggaccatactcctggtcattgaaacaaagaattatgagtgatacagggcacttgtcgaatgatgatggggctgcagctttgatggatgttttgggaaatagtactaagaaaatattcttgggacatctaagtcaggaaaataatgttaaggcattagcgcatgtcacagtagaagatatcatgaaagaacacgatttagcggttggtcatgactttgaaatttgtgatacagatcctaaacaagccactccattaatccaattataa

SEQ ID NO: 54 - DNA, 1098 bp, Lactobacillus salivarius
  isolated from gut, Lactobacillus salivarius
atgcaaaaagaagttgcaaataaaaaaatcgatgagttgctacatgagctcccttattatatgaatgattttgttattgtaaaaaccgctgatgaatattctcctaatactattcttgaatacttgaagaatttccatcaatttttgatttggttgattgaaaatcattatgttaacgaaaataaaactagtgacatcgccccagaatcgcttgataagcttacagttcgtactgctactgaatacaaatcttatcttttacgccgaaaaaagcaaaataaaaaagctcttgataaaaatggtcataaagaagagtctactgagactctatctaaagtaactattcagcgtaatatcactgctttaaaagtgatctttaagttcttaagcagaagtgctaataactctcaagagaaaccttttttaacacacgacgttatgcaaagtattgataatgtggctgataagcaaactctacaagctagggctgatgccttagaagaaaagttatttttagatgatgaaactgatgaatatctacaatatatcaaagaagtttatcctcagtcattatctactcaagctaagaaattctacaatcgcgatgttgaaagagatttagctatcaatgctttaatgttaggatccggtctccgtttatctgaagttgttaatatcaatattgaagatttagatttcgaaaacaatcgagttgctgtacttagaaaaggaaataaaaaagattctgtcagaattgccgcttttgcaatggaatatctagctaattatcgtgatatccgtgctagtcgttatcgtgcagataaatatgaaaaagcattcttcttagctattagtcgtggtggttccaaacgcattactggctctgctattgaaaaaatggtttccaaatactctaaaggtttcaaagtcagagttactcctcataagttgagacacactttagctactagattgtataaacaaactaataaccttgttttaactgcacaacaattaggacatagctcaactgctacaactactctttatactcatattgataatgatgaaactacagatgcattgaattctttatag

SEQ ID NO: 55 - DNA, 426 bp, Lactobacillus salivarius
  isolated from gut, Lactobacillus salivarius
atgaatagacatataattatagcaagtcattctacactggcagctgggatagcagaaacacttagatttttcgaaggagaaggattgaagttaacagttattacggcctatgtagataataaaccaattgaagatacaattagagatgtttttaaagactataatgaagatgacgaatacattattttgacagatttaatggcagggtctgtaaatcaaaaatttgtagaaaatattttcaataaagaacatgtgcatttaattgcaggaatgaatttatcccttgcaatggcaataacgatggaacctaaggattcatatatatcagaaaaaagaataaatgaaattattgaagaatctagaaaacaaattatttatgttaatgaatctttagcgatagtaggtgaggatgaggaagatgaatga

SEQ ID NO: 56 - DNA, 627 bp, Lactobacillus salivarius
  isolated from gut, Lactobacillus salivarius
atgactagaaaaatgcaaataaaaaatgaaatatggagtgcaataactcatggaattggaattatcctcagtattctagggatgattttattaattttaaaggggatagatactaattcaataacacttttttcatatatagtgtatacatgctcactagttttattatatttattttctacgctttttcattgcttgtattttacgaaagctaagagagttttccaaatttttgatcactgttcaatatttttattgatagcaggtacttatacgccgtattgcatgttggcgataaaaggtgtaaaaggattgatattaatgataatgatttggttaatgtcaatactaggtattctatatcatattttagcttctaaaagaaaacaggtatttgaaacaattatttttgtagtaatgggttggctttgtatactaggggcgaaagaattatttttatcactaggcaagataggattaggtttactagttgcaggtggaataatttttacacttggagcactggtatatagtattcctaagataaaatatgcacatgttttttggcatatttttgtaatgttagggtcaatattaatgtttatttcgatatattgttatatttaa

SEQ ID NO: 57 - DNA, 552 bp, Lactobacillus salivarius
  isolated from gut, Lactobacillus salivarius
gtgattaatagagctattctagtaggtcgtttaacaagagatcctgatttacgttacacggcttctggagctgcggttgctacatttactgttgctgtaaatcgtcaatttactaaccaacaaggtgaacgtgaagctgattttattaactgtgtaatgtggcgtaaaccagcagaaaattttgccaactttactcataagggttcattggttgggattgacggacgaattcaaactcgttcttatgaaaaccagcaaggaacaagagtatatgttacagaagttgtagctgagaatttctcattgttggaatcacgtgccgaagcagatcgttatcgtgaacaacatggaatgacacaaaataattacggaaataatgctccttcgcaaaatcaagcatcacagtttgatagcaatccatttggtgattctcaacaaaataatagttttggtggaaatacaccatcaaataatggagcagataatagtgctgatccatttgctgataatggacaatctattgatatttctgatgatgacttgccattctag

SEQ ID NO: 58 - DNA, 453 bp, Unknownn
  isolated from gut, unidentified
atggaagtacgatttgaaaaaaacattataactggcgaagaaattgaagtaatcgttaaagcaaatcgtttaactaataatgtcaagagtttaatggcttatattaatcaatttgatcagaagccacatcgaattctaccaattaaaaccaatgacagtatcataattgttaaggtggatgatattatcttagttgatgtgcaaaaaaatacgttgtcaattgaaacattgaccgctaagtatctgatacaagaacgattgtataagtttatccagaaactgcctaaagatatctttgttcaagtgtcaaaacatgcagtaattaaccttgattatttgctgtcacttgaagatagctttgctggttcgatgactgctaaaatggaaaagagtttgcgaactagtgttagccgcaagtatttaagcgatctggaagaacatttaggactttaa

SEQ ID NO: 59 - DNA, 987 bp, Lactobacillus salivarius
  isolated from gut, Lactobacillus salivarius
atgtttggtataggaatagcgatttttttattctctttacgagaaatatcttttcgtagctttgtacatgatgttaccaccttaaatttgtggtggttaggaatagcatttttgtgtatgtttctttccttagtatttgaagcgttagtcataaaaatactagttcaaaggcagattaaaagttatcctttttttgatgcgttacgcgtgccaatgttagagcaactatttaatgggataacacctttttcaacagggggacaaccggcacaattatttgcattaatgcaatcaggtttagatgctggtcgtgcaacatcaagtacattgatgaaatttattgtttaccaagctatgatagttgttaactttgtattgtgtttattaataggttttaattttattcaagaaaaaatacatgcgctaacgtggctggtagtatttggttttattatccatctagctgttatcgttagtttgctaatggtgatgtattggtacgattttaccaagaagtttataaaagtaacgttattaccaataaaatggatatttaatgataaaaaatatcaaaattggaataaagtagttgatgagaaaattgataatttctatgaagagagtttaaaattgaaatctaattggaaattattattaaaaataagtgcaataacttttgtacagttagctgtatattatattattccatacttcatcctattatcgttaggagtgacacatgttaacgtcattatggtagtttctatgcatgttttgatagtgatggttgtatctttatttccaatacctggaggagctggaggagctgaatatagcttttcggtaatctttagtagttttatcggtactggaagcaagttagttttagcaatgcttttatggagaatagttacttattattttgggatgctgagtggcttgatagcaatgttaattcaacctaaacgaattgtaacgaaaaaatag

SEQ ID NO: 60 - DNA, 939 bp, Lactobacillus salivarius
  isolated from gut, Lactobacillus salivarius
gtgagctatgtggaagatatgggaaaggaacttagtaaaagactagtagaaaataagtgggaaaaaaagtataaagaaataattgaaaaaagtttaaaagatgatgatgtgcaattgtttttacgtgaaaacaaagatagactaagccatcaagaaatattaaagggtgcaagtaagttatatgaatttgttgacttgaagcaaaaaatagcagaaggaaaagaagtttttgccccagggtattcgccacaattaactattagtgatcatcacattgaagtaacctatgtacctactaaaaaattgatagaagagagacgactaagagaaataaataatagaattaatattgtcaatcttcctaaaagtattcgtaaagcaacactagaaaattattatagagatgatgatggaagaatgatagctttaaaaaaagctatagaatttgttgcgaactatactgaaacgcctaatatctttcataaaggactatatttatctggatcgtttggagtaggaaaaacatatttactgggagcgattgctaataaattagcagaaaaggggataaaagtaactttagttcacatgccatcttttgctgtagaaataaaaaattctattggtaaaaataccactatggaaaaagttgatgctttgaaaaaatctcctgtattaatgatggatgatataggtgctgatcaattaagtagttggtttagagatgatgttctaggtgtgattttacaatatcgtatgcaagaagaattaccaactttctttagttcaaatattgctttagatgacttagaagaattttacttaacgcagaatacgagaggcgagttagaacccttgaaagctaaaagaatcatggaaagaattagatttttagttgatgaagtagttattaatggtgaaaatagaagaaataaataa

SEQ ID NO: 61 - DNA, 1746 bp, Lactobacillus salivarius
  isolated from gut, Lactobacillus salivarius
ttgaataaagcagcgatattacatataccagcaagtgagatggcttattatgaaaataaggatgaattacaccttcaattacaatcagcccacaatgatttagcggatgtaacggttttggtaggtgaagttagcggaaataataacgatagctggagatatgaaagcttttttatgcagaaaactttcgcaactagatatcatgattattgggaagtcatattaaaattaaacaaaaatgaagcacaatatgtatttaaagttacagacacttacggtaatgtaggactttatgacgcccaacgtttatgtgaagctacggaagaaaatgctaattcaccacatggatttatcattgaaaatagagatatgcgacaagtaacgcaaattccagattgggttacaaagacagtctggtatcaaattcaaattgatagatttgctaatggcaatgataatctagctaagttatctgagaacgaagataatacaactcaaattttaggtggagatctaactggtattttaagtaaactagattatttacaaaatttaggtattaatggtattgtgctatcttctatttttgaaggcgatggaccatttaaattaacgactaacgatttttatagtattgatagtcagtttggcaataaagatctctttaagatgttagtcagcaacttacatcgccgcaatatgaaagtagtactaaaaatgaatttagcttatttaagcgataattctagacaatggcgtgaaattctagaagaaggacaacatgcgaaatatgtagattggtttaatattaagggatttccgcctaaatatagccaagatccacataacaaaaatattgttagagctaattataaattcagtgagttaaatccacattatccaactttgaatttaaaaaatccagaagttcaaacatatctaattcaagcaataaaatattgggtagaacattttgaaattgatggattaatattggatcatgctgataaattaagtcgagaatttgtacatttattaaaccgaaatcttaagaagatgaaacctgatttctacctagttggaaaatcagaaatgagtaatactagtgtagttcaattaggagattttgatgcgatgacagatgatgccttaggcaatttgttattgaattttgctagagataagaaaatcgccgctagtgaatttaagtatcaattaagtcgacaaatgttagctcaaaataccaagttaagtcgagtgaccttaagaacattggatgatctaacatcttcgagaattttaacgcgctgtcgcgaaaataaggctttgatgcgctccttgttaacctttatgtatttattaaaaggtagtccagcaattacttatggaacagaactaggtttttcagggcatgattttccaagtaatctagcaggaatggattggaaccaagaagatcaagacgataagatgatgcgttttatcaaagtgttgaataattttaggttgcaaaactataaaattctaagtgaaggcagttttgagtggggccagattagtgatagttatgattatgtaagttttatcagaagaaaagataaaagaagattatttgctttatttaattttggctacaatgggataaaatttgtcttacctaaacacgctaaattaattttaggtcaaaatattgtagatgaaaaatccgaaataggtcagtatggatttgtaatattagaagcatag

SEQ ID NO: 62 - DNA, 1644 bp, Lactobacillus salivarius
  isolated from gut, Lactobacillus salivarius
gtgacgattaagggagaagatgagaatatgaaattcaagaaagtattgagattagttccagttgttttagcaggcacattcttactagcatcgtgttcaggaaagaatagttcaaaggacacattaaaattaatgcaaacagctgaaattcaatcgttggataactctaatgtagcaactttgcctcaatggaatatgctagttcaatcaatggaaggtctatatagaatggacaaaaatggtaagccagtagcagcgatggctacaaaagttgtaaaaccaactaacaatggaaagacttataccttccatatcagaaaagatgctaagtggtctgatggttctaaagttacagctcaagactttgtaacttcatggagaagatcagcaagtccatcagctaaatcaggatataactacatatttactggaatcaaaaatgctactaaagtttcaagtggtgaattgccagcttctgacttaggtgtaaaagcattaaatgatactacacttcaagttcagttagagtatccaatgccttactttagtcaaatgatggtaatgccagctttcttcccacaaagtacaaaatacgttaacaaagaaggaaaaagatatggtacttcaagtacaagattagtatataacggaccatttaaggtaacaggttggaccggtactaatgaaagttgggatttaacacgtaataagtactactatgataagaaagatgttcatttgaagaagatatctatgcaagtagttaaagattcaaatactgctcatcaattgttccaagataataagctagatgatgcattagttacaggaactacagctcaaggcttgcaaaaagataaagatttgaagcatgtatacagggcaggaacatattatttaagactaaatctacaaaataataaagctttccaaaatcaaaaattaagacaagctttgtatctagttttaaatagaaaacaattagctaataaagtattaagtgatggatcaacagcaggagatacttatgttgctcctagattagctaaagatcctactacaaacaaagactttgcaacagaaatgaagccttctacaacttatgatttgaaaaaaggtcaagaattatggaatgaaggtttgaaggaacttaataagaagaaagtaacattgacacttgttacagatgatcaaacaatttctaagaatgtaggtcaatttgttcaatcacaagttgaaacaaaattaaaaggtgcagaagtggatgtagtatctgttcctgacaagagtgctaatgataaagtaagcaacggtaattttgatatgaattatactttgtggttagctgattttgcagatccaatcagtgatttcgatgtattatctaaaactaatccacaaaattatggtaagtatgctagtgagtattacaacaagcaattggaattagctaagcaaaatggtactgatactaataagtattgggaaaatatgagaaacatgcaaaaacaattaaatgatgacatgccagtagtaccattgtacacaatgacagaaagtcacttagtaaatagcaacttaaagggtgttatgtggcattcagtaggtgaaacagactacacaagagcatatttcggtaagtaa

SEQ ID NO: 63 - DNA, 1350 bp, Lactobacillus helveticus
  isolated from gut, Lactobacillus helveticus
atggataaatttaaaaatattattattggatttggtaaggcgggtaagacattagctaagtacttggcgcagcatgatgagaccgtgcttctgattgaacggtctaaacaaatgtacggaggaacttgcatcaatgttggctgcctaccatctaaaaatttaatttttaatggccaacgtggcgtggacttcactacagcagttaataagcgtggtgagatgactagacagttgcgaaacaaaaactatcacatggtggctgatgagccactagcaacggtttgggatgggtcagcccgttttatcgacaattatgttttggcagtcgtaatgagtgatggaacaactaagaaggtgagaggtgaacgcatcttcattaatactggagcggttccaaattggccatcaatcccagggttagaattcggtcagcggatttttacgtctaaagaagctatggaattggagaaacaaccgaaacgactagcaattattggtggcggttatattggccttgaatttgctggaatgtttaattcctttggtacgcatgtaacgattttcgaccaacataccagattgttagagcgcgaagatcctgatattgcgaccgaggtcgtagcagatctgactgacgcagggatcgagattaaaccggagactcaactaactcaagtaaaagataatggtgagaaggttacattatattatcaacaaggtgatcaaagtaacactgcggaatttgatgcggtattagttgcagtcggtcggcggcctaatataaatagtttagggctagaaaataccgatattgctttaaccagtcgtggtgctattcaggtcgatgatcatttaaggaccacagtacaaaacgtttgggctttgggcgacgttaatggcggtcctatgttcacttatgtctcattggatgattttcgtattattgtagatcaattgtttgataagggggatcgctcaacggccgatcgaatggtgataccgactgcttcgttcctaaatccaccactggctaacgtcggcttaaatgaacgtcaagctaagagtgcaggttatgatttacaaaccttcaagctatcagtcaaggcgattccaaaggcccgtgtcttggaggatcaacgcgggctttataaggtaagcgttgatcaaaaaacacaccttattttaggggcaacattgtatgccgctgaggctcatgaaaccatcaatctaattgcattggcaatgaaggccaaattaccttacgaaagattacgcgacatgatctatactcatccaacaatgtctgaagccttgaatgatctttttaagaccccggttgtgaaaagctaa

SEQ ID NO: 64 - DNA, 1104 bp, Lactobacillus salivarius
  isolated from gut, Lactobacillus salivarius
atgttaatcggtgtacctaaagaaatcaagaagcaagaagaacgtgttggtgctactccaagtgctgtagcaagcttagttcatgcaggccattcagtaattgtcgaaaaaggagctggggttggctccggtttcccagatgaagaatacatcactgctggtgcaaagatgggttcagcagaagaagcatgggacacagaaatggtcatcaaagttaaagaacctttggaaaatgaataccaatacttcaaaccaggccaaatcatctatacttatcttcacttggccgcagataaaccattaacagaagccttaatcgaaaagaaggttacaggggtagcatacgaaacaatggttggtagaggcggcgggcttccacttctcttccctatgagtgaaatcgctggccgtatgtcaatccaagttggatctcatttcttagaacaagcacatggtggcaaaggtattcttttgagtggtgtttccggtgtacatcgcggtaaagttgctattatcggtggtggtactgtaggtttcaacgctgctaagatcgctgttggtatgggcgcacaagttacaattcttgatattaatgctcaacgcttagctgaaatcgacaacattttcgatggaaagattcaaactttaatgtccaatactgctaacatcaagaaagctgttgaagaagctgacttagtagttggtgctgttctaattccaggagctaaggcaccaaaattagttacagaagaaatggttaagaacatgaaacctggttctgttatcgttgatattcctatcgaccaaggtggtatcttcgaaacaacagtaagagcaacaactcacgaagatccaatctatgtaacacatgatgttattcattacacagttgctaacatgcctggtgctgttccaaagacagcgacagaagcactttccagcgcaacagtacattatgcaattgaaattgctaataaaggtattgataaagcagctgctgaaaacaacacaatccttacaggaattaatacacaccaaggagaccttacttccaaggctgttgcagatagtttagacctaccattcacaccctataaaggttaa

SEQ ID NO: 65 - DNA, 1083 bp, Lactobacillus salivarius
  isolated from gut, Lactobacillus salivarius
atgccacaagataacagaagacgtcgacgttctattgaaaattatcaaaacgacacgccttcacacgtaccacaacgacaacatgaacatcatcattctccgcatagacttagtaaaactatctttttttggttactactatctttagtagtttttgctatcgttggtggaaaatatctggagaagaaactgaataatgcacaaaaagctgccaataccatctatagttctagtaattttagcaaatcacgtaatgttagctctaccttaaaaaaaggtaaacctgtttctattctactaatgggaactgatactggagctttaggtagagatttccgtggacgtactgatacattgattgtcttagttatgaaccctaaagataaaaagatgactcttgtttcacttccgcgagatgaaaaagttgcaatctcaggatatgaagaatactatcctagcaagttaaactccgcttatttttacgggggatctaaagccgctgttagaactgttcaacaagatttaaatattccaatcgatttttacgttacagttaacatgggtggcttagaaagtatcattaatgctattggaggagttgatgtagctcctacaatctcattctcatatggtggttactctttcaagaaaggtaaagtaacacatatgaatggacctaaagctttagcttacgttcgcatgagacatgaggatcctttaggggattatggtcgtcaaactagacaacgacaagtccttatgaaagttgccctgaagagtagtcacgtttctaatttactcaaccaaaaattcttgaacactatttctaaacaaatgcagactgatttatcttttgatgatttattagctcttggaactaaatatcgtgttgcaactcatggtatggattcagatcatttacaaggtacttcaacgatgataatgggtgaatcttttgaagtacctactttatctgaaaaacaaagaattacaaataaagttcgctctgctttagatttagaaaaggctaaaactggttctacatatggaactgattatgaaataaatacttcacaatattaa

SEQ ID NO: 66 - DNA, 726 bp, Lactobacillus salivarius
  isolated from gut, Lactobacillus salivarius
atgacaccagaagaattccgtcaaagtttagcagaacaaggattgaatctaacagatgaacaaatgcaacagtttgagctgtattatgaatttttagttgaaactaacaaaaatttgaatttaacagcaatcactgaaaaaaatgaagtgtatctaaagcatttctatgattctttattattagctttgacagtaaaggatttacaaacagaagagttgagtttatgcgatgtcggagcaggagcaggtttcccatctttaccagtcaaaatagcatttccacaattgaagattacaatagttgattcattaaataagagaattaaatttttacaagaattaactcaaaaactaaatttacaagatgttcattttcatcatgcacgtgctgaagaatttggtggtaaacgaagtgttcaccgcgaacgctatgatcttgtaacagctagagcagtagctagaatgtctgtattatcagaattatgcttgccattaactaaagttggtggaagatttatagctttgaaagcacaaaaatcagatgaagagttgaaaaatgctcaaaaagcaattgaagttttaggtggaaaagtaatagcagattacgctacagaattaccacaaattcatgatgaacgtcatattattgttgttgcaaaagagaaagaaacccctaaaaagtaccctagaaaagcaggaacaccagcgaaatctccgattgaataa

SEQ ID NO: 67 - DNA, 663 bp, Lactobacillus salivarius
  isolated from gut, Lactobacillus salivarius
atgaagagtattcggaatgatcagattgaaataaatccgatattgtcgaatcgagctagtgaaggatattatcttgcaagtcctaatagcgatgatttgaagaataaagctgatactgatttgcgctacgttacctggacatataatgatcataaattgacgggtgattttaccacgttaattaaaataaatgatagcgacaatccacaaaaaactttaaattcagtagttgatgatgcgagtttgataattcatggaaaagactatgcatactctaaagaattatcaagtaaaaatactattgtttatacgcaaatggtgcatggaaagccaatctatacacctgagggtcaattgagatttacggttaaaggtggttatgttgtaggttatactcaacgtcatctcgctaaaattcatcaattaagagaagtgaagaagacgattagccagagacgagcagttattttgttgtatcaatataacaagattccagctaattcaacggttaaatgggtaaaactaggttatacgaagttattgacagcaaataataatacaattttaattccaacatggaatgtgaagattaagagtgattcatctggaattgtgcaatatcgacgcttaaatgcgttcactggtgcaattatggatgattag

SEQ ID NO: 68 - DNA, 2013 bp, Lactobacillus salivarius
  isolated from gut, Lactobacillus salivarius
atgagtgaaactatggataacgagaaatttgaaaaagaagcgttgcaagtagtagagaattttttaaagagtaatacgcaggtattaatagtatctgggcgagctggtagtggaaagtcgactttagctggaaaaatttatgaattagtaaataagaataatgaatctgaatattctcaagcacagatcttatctcctacgggtcaatctgtaggtctaatcaaacaaaactttcctcaaattccagaacaagattgtcaaacgatctatcgtaaaatctatcgaagagcaacaaaaaagattgatgatggggataatttgatatttgatttcaaattgaataaacaagaagataagaatgtttttattatagacgatgcttcttacatttctgatgaagaaaacaataggggaaatttgcattttggttctggaaaattattaacggacttgttgacttctactcagatttttgaaaaaggtaatgttaaaataatatttattggcgatgaatatcgattattaccaattagagatactagtgctaaagctttaaagcaaacttattttgaagagttaggcttaaatactatgaaatacgaattgaaaacccaatatcgtatgcatggggaactagctagaggtatagataaatatgccgaattgattactagtgtagaaaatcatcaaaaaataataccttatgaatttaaaaatactggtaatgttagaaatattgatgcggctgattggagcaaggaagaaaagaaacaaaagattgccgggcaatttaatcgtgacaataagagaaataaggtagtagtaacttattcgactagagcagctcaagaatataataaattgattcgtagaaaacttcaaaatatggaagatgcgctaattagtagtggtgatttagtagtattttctaaaaatcaatatgatttacttgtaatggatgctgcaagtaatgagttcaatgaggactttttcactggagatattgctgaaataatcgcaacctatgatcgaaagtcaagtaatgtaagagttaataaccaagatgtaactttgtcttatgtaaaggttaaatatcgtttagaacgaacaggaaaagagtatgtgagctacttattagaaaatgttctaaattcagatgactctcaactttcatcagatgagaggacagcactgttttacgatgctgaagaacgtatagggattacagaaactccagaagaacatcgccgtcatattaaaagtaataatgaatactgggaagtagccgtaaagaaattagcaaatgttggagaaagtggattatctgtatcagataaggataggataagagaacttttgagaaaacatccgatttgtgatcctaaaaatgaatgtgaaagatatcaactattagacaagatttatcaggataaattttataatagtattcaagtgaagtatgcttatgcgatgactggtcacaaagttcaaggaaatgaatggaacgatgtatatgtagattttactgacagaaatggattagatgaatctagtttacgctggacttatacagctttatcaagagcgataaaaaatgtattagtatttaacgcaaccagtttatttggtaactttgatatctcaaatgaatttattggcaaaaagaagaatcttgaaaaagaaagagaaatggcaactaagattgaagagtatcaatgtaatgatgaaaagattgctcgcttagtagataaggtggaagaaatttctgaaaataatggtttagttgttactaatatcgatgatagaaattttgaaaaacaatattttgttttgatttatctaagtgatgttgaaaataacaactatgtcatgcaagcatattataatagtcgaaaattttggactaaagcaacacttcgtagcaaggtagaaatagcagagaaattagagtcgattggaacagaatttaggaagataaatccaaattttagaggaagtgcggacaatgaatga

SEQ ID NO: 69 - DNA, 2064 bp, Lactobacillus salivarius
  isolated from gut, Lactobacillus salivarius
atcaaaaatttagactgtgaggatggaaaagtgaaacgtttgttggaaaaagaattttggcagataccagaatttttaagaaataaacatttgcgaataatagcagttttcttacttatactctccttagtctgtgcaacattggcatttattgttaatgcctggttaggtataattgtctttctgctgattttattgacaataggattgtcttttataacattaaaacaagttatgcaagataccacacattatatatctgatttatcgtataaaattaagcgaagtgagcaagaggcattgttgaaaatgccaataggaattctaatgctcaatgattcagcagaagttgtttgggttaatccaactatgcaaaagttatttgggcaagaagaaatattaggtaaaaagttaacagaggctgatgaagaattagctaaagtgatcaatgataatatgtcgaataaagatagcgttgagattaaatggcaagataaaagatttaatatgttagtacaaagtgatattaacgttgtttatcttttagatattacacactatgctgaaatccagaaacaatacgatgattctcgattagttatcggacaaatttttattgataactatgatgaagttacccaatcaatgaatgatactaatatttccaatttaagtaattatataacgaatgagttatcatcatgggctagtcaaatgggaatgtttctaaagatgattgatgaagatcattatttcgttttagcatatacaaaatcattaacacaaatggaaaaagaaaaattcaaattattagatcgtattagggaaagaacatctaagcaaaattttccagttactttgagtataggattagcctatggtggtactgatttagctaaactttctcgattatcgcaaagtaatttggatttagcactaggacgaggtggagatcaggtagttgtaagaggagtagatgattctcaagcccgcttttatggtggtaagacgaatccaatggagaagagaactcgtgtaagagcaagaatgatttctcaagcattacaagaattaatgagtcaatcagatgatatttttgtaatgggacatgctagaccagatatggattcgataggagcatgtttgggaattagacgaattgcaaagatgaatggtaagcaatgttggcttgtgttggacacagataatttgcattcagatatccaaagattgctagatgaaattgataactatccagatatcaaggaaagcatcatttctcctgaagaagctttacagaaagcaaccaagaaaagcttattattgatgctagacttgtctaaaccttcaatttcaatgagtcctgaattatatgatcaactcaagaatcgagttattattattgatcaccatcgtcgaggtgaagaattccctgaaaatccgatgttggtatatattgaaccttatgctagttctacatgtgagttaataacagaaatgtttgaatatcaatcacgctatagtgatgatccaataaataaattagaagcaacagctatgctgacgggaattattattgatacgaagtcattctcattaagaacgggaactagaacatttgatgctgctagttatcttcgttcagtaggtgctgactcgcaaatgtcgcaacattttatgaaagaaaatgtacaaagtttcttgcaacgaaatcatttgattgatagagtggaatttgtagggaatggaaatgctgttgtagttggtgaaaatgatcgtgcctatgatccggtaactgctgcacaagctgccgattctttattaactgttagtggggtgcaagcttcgtatgtagtgactcaccgttctgaagatattattgggatttcagctcgaagtaatggagagactaatgttcaaattattatggaaaaaatgggaggcggaggacatttatctaatgccgctactcaaattgaagatagagatattttggatgttaggaagcaactacttgatttaattgcacaaacagaagaaaataatacagaggaaactgattag

SEQ ID NO: 70 - DNA, 738 bp, Lactobacillus salivarius
  isolated from gut, Lactobacillus salivarius
ttgattacattatcgggtattattggctctggcaagtcaagtttaacagaaattttagcgaaagaattagggactaaagcatactatgaaccagtaaaggataaccctgtattaccaattttttataagggaaatgaaattgctgctaaaaagcgtgctgaaggggataaggaagcaactaatccatatgcttacttgttacaaacattctttttaaatcgtcgttttgcgatgataaagaaagctatgcaagatgataataacattttggatcgttcaatctatgaagacgaaatctttatgcgtatgaacactgaaatgggaaatgcaactcaagtagaatatgatatctataagagcttattgcataatatgatggaagaattaccacttgcttcacacaaaaaatcacctgacttgatgatcacaatcaaagtttcatatgaaacaatgattaagagaattgaaaaacgtggtcgtgattatgaattaattgaaaaagatccttccttggtagattactatcaaagactattgaagcattacgatatctggatgaaggaatatgatgcttcaccacttttgatcattgacggtgataaatacgactttatggaaagtaaggaagatcgtgttcaagttctagaaactgtagaaaataaattactagaattaggtaatattagcgaagaacaatttgaacatttcaaaaagaaacatcaagcatttttaaattaa

SEQ ID NO: 71 - DNA, 678 bp, Lactobacillus salivarius
  isolated from gut, Lactobacillus salivarius
ttgaatacaagaaaaaatagctcagattttcctgtgcgtcgttggtatggcgatgcttttggaattagtggagcagtcttcttattaacattattactagtaatatttaacgtaaaggtatttgttaattttgaagataatattactgctactttccaatctatgtttggtttaccaaaaatggattatagtggtggattattaaacgatatcatgacatttgtggcatcttatttcgatactaagccaattattgcaatcacaattgtagtaggtattgtattgattttaagacgtcaaatcaaaataggtatttggttgatgtatgttgtagcaagtggtggcattataggattagttttaaaagctttgatcaagcgtccacgtccacttcatcatcttccaattgatgatggatattcattcccaagtggacattctctagcaagtactttattgatttgggcaattatcttcgttgttcttcctttgatcaagaaggaaaatgttcgtagaattgttggatggttgttagttctattgtgggtattaatcttattctctagactatactttgctgctcatcattttggcgatgtcctaggtggtgtaagtttctcacttgcttggttatggttgaatatggcgttatatcccaagatttttatgagaaattag

SEQ ID NO: 72 - DNA, 1383 bp, Lactobacillus salivarius
  isolated from gut, Lactobacillus salivarius
gtgaatgtattggcgaaaactaagacaagatatgtttgtcaaaattgtgaatatatctctccacgttatttaggacgctgccctaattgtggttcttggaatagcttggtagaggaaatagagaaaaaggaaagttcaactaaagcacagcctagagttagcatctctggtacaacagtgaaacctaaattaattgatgatgtttctactgtggagactccaagatttaaaactaatttagaagaattgaatcgtgttttaggtggcggaattgttcccggatctttagtgttaattggtggagatccaggtattggcaagtctacattattactacaagtttctggacaattatctactctcgggaaaaaggttctttatgtttctggggaagaaagtgcaactcaaattaaattacgtgcggatcgtttaggagttcatggaactgagctatatttatatcctgaaacagatatggatagtattagaaaaaatattgaacttttaaagcctgattttgttgtaatcgattcggtgcagacaatgcaggagccagaaatgacagccgcagttggaagtgtttctcaaattagggaagtaactggagatttgatgcaaattgcgaaaactaatgggataactgtctttgttgtaggacatgttactaaaggtggagcaattgcagggcctaaaattttagaacacatggtagatactgttctttattttgagggagatcaacatagaacatttagaattttacgagctgttaaaaatagatttggttcaactaatgaaattggaatctttgaaatgaaaaatggaggattaagcgaagttgctaatccatcagagatttttctagaagaaagattaaaaggggctacgggatcagctgtcgttgcttctcttgaaggaactagacccatattggtagaattacaagcactagtaacaccgactgcatttggaaatgctaagcgaacaacaactggtttagatcacaatcgagttgcgttactgatggcagtacttgaaaaaagagctggtttgttattgcaaaatcaggatgcttatttgaaggctgctggtggagtgaagttagatgagccagcaatagatttagccattgctgttagtttagtttctagttatcgcgatgcagaaacaagaccaactgactgttttataggggaagtgggattaactggtgaaataagacgagttaatcgtattgaacagcgtgttgttgaggctgctaagctaggatttaagcgagtatttttaccaaagaacaacttagatggttggatgcctccaaaagagattgaagtagtaggcgtaagtacactaaatcaagcattaaaactaatttttagttaa

SEQ ID NO: 73 - DNA, 837 bp, Lactobacillus salivarius
  isolated from gut, Lactobacillus salivarius
atgagtgctaatcctttattgaatccagttccaactaaagacggtcatgtcgtaggttatgtacattctttggaaacttttggggctgtcgatggaccaggtatacgttttgtcgtttttatgcaaggttgccatatgaggtgtaagttctgtcacaatccggacacttggaaaacaagggtaggttcacaaatgacgactgaagaagttctaaataaggcacttccttatcgtagcttttggggcgacaaaggtggaataactttatcaggtggtgaaattctattgcaaatagattttgcactagagttattcaagatgtgcaaggaagaaggtattagcacttgtttggacacttgtggacagccatttacaagaagagaaccttggtttagtaagttcaatgagttaatggactataccgacattctattagttgatatcaagcatattaattcggacgaacataagagattaaccggattcccaaatgataatattttggatatgtgcgaatatctttctagcatagggaaacctgtttggattcgtcatgtccttatcccaggcatcacggataatgatgaatacttgaaacaattgggcgagtatgttaaggaaaatcttcataatgtcgaaaaatttgaagtattaccttatcatacaatgggcgttcataagtatcatgaaatgggtatcagatatcgtcttgaaggtgttgagcctcctacgccagaaagagtaaaaaatgctgaaaaactgctagaagtagatagatatcaaggatataaagattggtatccaggcattaatactttggatcaacaaccaagctag

SEQ ID NO: 74 - DNA, 687 bp, Lactobacillus salivarius
  isolated from gut, Lactobacillus salivarius
atgattggaacattcttcaatgtcagtacaattctaattggaagtttacttggaaattacttcaagaaaagctttgctgataaatatcaagaaattctgatgcaaacgatgggactagccgccacttgcttaggaatgcaagctgtcttgcaaaatctccctaaaagtaaactccctatcttgtttattttaagtttggcaattggtggcgtattaggagttaaatttgacctagctactcgtttttctaattcagttaaaaaattcagtaattctaaatcatctgaaggattgtcaactgctatcttgctatattgtatgggtactttatccattttaggtccagttgaagctgctttacaccacaattatacttatctttttacaaacggtattcttgatggcattacttctatcattctagcatcaacttttggattaaccattatgttagctgcacttgttttattcttctggcaaggtagcttttatctaatagccttcttgttacaaagtagcgttaatcctgactttttacatgaattgtcaattgttggcggtgttttaattctagcctctggtcttagtattcttggaattaagaagtttgaaactatgaatttattaccatcgctacttgtatctggtattctcttctttattcttcattacatcggtataatttaa

SEQ ID NO: 75 - DNA, 1059 bp, Lactobacillus salivarius
  isolated from gut, Lactobacillus salivarius
atggttgatacaccagcaattaagtttgaaaacatctcaaagacattccaaacagctgataatgaagtcaaagctgtacagaatgtaaatcttgaaatcaaatccggtgaagtatttggaattgtcggcttttctggagcagggaaaagtacattagttagaatgttaaatggattagaaaaaccaacgaaaggtaaaattcttattcatggtaagcgagtagataatcttgctggaagagacttgcgtgaacaaagaaagaagatcggaattattttccaacatttcaatttactttggtcacgaacagttttggaaaatattacttttccgttagaaattgcacatgttcctaagaatgaaagaattgagaaagctaagaaattagcagaattagtaggattgggcgatagattacatgcttatcctaaccaattatctgggggacaaaagcaaagagttggtatcgcaagagcattggctaatgatcctgaaattttgatttcagatgaagctacaagtgctttggatccacaaactactgaagaagtattggatttacttgaagatattaatcgaaagttaaatctaacaattgtaattattactcacgaaatgcacgttattagacgtttggctgataaggtggcagtaatggaaacaggtaaagttattgaagaaggacctgtttcagaagtatttactcatcctcaacaagacttaacgaaacgtttcgttaatgccgaagttgatacaaataatacacctgatgttaaggaagttgtaaatcaacttttagaaaaatacccacatggtcaattagtagagttaagattccatggagatcaggttcaattaccggtagtttcggaattagttagacaatttccggaagtgcagttaagtatcttggaaggatcaattcatcagttggctgacaaagctcgaacaattggaacgttatttgttcagttagttggtagcgatgaagatattcaagaagctttgaagttccttgaaactttaagagtggaagtgagggtgataagtaatgaataa

SEQ ID NO: 76 - DNA, 1380 bp, Lactobacillus salivarius
  isolated from gut, Lactobacillus salivarius
atgcaaaaggtaaagaatgatataaaaataaaagttggacagaagtttcctttaacaattaaaagactaggaataaatggtgaaggaattggatattttaagcgtaagataacatttgtgcctcaagcacttcctggtgaagtaattttggctgaagtaactaaagttcatcctaagtatttaaatgcgaaaataaagaaaattagaaaagcaagtcctgatagggtagaacctgttgataattatgatgttggtgggatagagcttgaacatttagcatacagcaagcagttagaatttaagacagatgttattcgtcaatctttagaaaaattcaaaccaaccaattatgaaaatatggaattacgtccaaccttagggatggaagtaccttatgagtatcgaaataaagcccaatttcaagtaagaaaagttaagggaaataaggtaattgccggattatacaaacctaatagccatatcttagtagatttaccaacttttaaaactcaaatgccattaacaatggaaataatgagaaagatagttaagctattagaaaaatggaatatttcaatttatgatgaaagaagaaattctggaatcttaaaaacggttgtaatcagacaaacgctaaagacagagcagattcaagtagtatttgtaacagctaagaataattgtgctaatttgaatcaagttgtgaatgaaattatggcagcatatccacaaatcgtatcagtcatgcaaaatattaatccaagccgttcttccttggtttggggtgaagaaacctttaagttagctggaacggatagattactagaacaattaggagacataaaatttgaactatctgcacgatcatttttccaattaaatcctagtcaaactgaagtattatatacagaagtgaaaaaggcattggatttaaaagaagatgaaacactggtagatgcatactgtggggtaggaacaattggtttatttgtttcaccagacgccaaagaagtaagaggaatggatattattcctgaagcaatagaagatgctaagaaaaatgtagaattatcaggtagaaagaatattcattacgaagtagggaaggcagaagatctttttgccaaatggactaaaaataattttgtgccagatgctttggtagtcgatcctccaagaactggactggatgataagatgatagagactattttaaagtatcgtcccaataaatttgtatatgtttcatgtaatccgtcaactttagctagagatttagtgaagttggtcaaaatatataatgttgagtacattcaatcagtagatatgtttccacaaacagcaagagtagaagctgttgttaaattgagtaaaaagtaa

SEQ ID NO: 77 - DNA, 1035 bp, Lactobacillus salivarius
  isolated from gut, Lactobacillus salivarius
atgacagcaaaagaaccattaacaactcttgattgggacaacttgggatttgaatacatggatctcccttatcgttatcgtgcttattggaaagatggcgagtggcataaggcaggtttaactgaagactctacacttgctatgaatgaaggttcaacagctcttcattatggtcaacaagcttttgaaggtatgaaagcttaccgtacaaaagataaccatgtacaattattccgtcctgaccgcaatgctgctcgtttacaagacagttgtcgtcgcttattaatgcctgaagtttcaactgaaatgttcattgaagcatgtaaatcagttgttcgcgcaaatgaagcttatgttccaccatatggtactggcggtactttatacttacgtccattaatcattggggttggacctaacattggtgtacatccagctaaggaatacatctttactgtttttgctatgcctgttggaaattacttcaagggtggtatggttcctactcgcttcttagtttctaactatgatagagctgctcataaaggtactggtgcaagtaaagttggtggtaactacgctgctagtttacttcctggtgacaaagcccataaagaaggtttctccgattgtatctaccttgatccagttgaacataagaagattgaagaagttggttctgcaaacttcttcggtatcacaaaagatggtaagtttgtaactcctaaatcaccatctatcttgccttctgttactaagtactctctcttgtatcttgctaaagaacgctttggtatggaagttgaagaaggcgacgtttatatcgatgaattggatcactttgcagaagctggtgcatgtggtacagctgctgtaatttctccaattgctggtttccaagttggtgacaagtatcatcaattctacagtgaaacagaagttggacctgtaactaagaaattatatgatgaattaacaggaattcaatttggtgataagcctgctcctgaaggctgggttgtccgcgttgactaa

SEQ ID NO: 78 - DNA, 831 bp, Lactobacillus salivarius
  isolated from gut, Lactobacillus salivarius
atgcctgaattaccagaagttgaaacagtacgtagaggactagagaaactagtcttaaataaaaaaataaaagatattagagtgttgtattctaaaactataattaatgaagagacagaattcatagaaaaactaacaaataaaactattaaaaaaattgatagacgtgggaaatatctattatttagatttagtagtgatttgacaatgatttcccatttgagaatggaagggaaatatttcgttgaaccaagtacaaaagaagttgaaaaacatacccacgtagtatttgattttacagatgggacatcacttagatataacgatgttagaaagtttggcaggatgcaattggttaaaacaggagtggaaatgcaaactgctggcttagctaaattagggccagaacctaaagaggaaacatttatagttgaagatttttctaaaaatttgaaaaggagaaaaaaagctataaaaaatgccttattagatcaaacaatagtggcaggtttgggaaatatttatgcagatgaagtgttgtggatgagtaaaatccatcctgaaacaccagcaaataaattaactgaagaggaagttaaagttttacgagataatattattaaagagttagcgttagctaccgaagctggaggaactacaattagatcatatacagatgcatttagacattctggaggatttcagtttagcttacatgcttatcaaagaacaggagatccttgtgagagatgcggaacaccaattcaaagaattgttgtaggtcagagaggaacacatttttgtcctaagtgtcaggtggtaaaatcatga

SEQ ID NO: 79 - DNA, 1830 bp, Lactobacillus salivarius
  isolated from gut, Lactobacillus salivarius
atggatttagaacaaatgaaagttcgtcagaagcatattcggaatttttccattgtggcacatattgatcacggaaaatcaactctagctgatcgaattttagaaatgactgatacagtaaccaaaagagagatgcaagatcaacttttagattcaatggaattagagagagaacgaggcattacaattaaattaaatgctgttgaattgcattatcatgcaaaagacggcgagacgtatatttttcacttgattgatacaccgggacatgttgatttttcatatgaagtttctagatctttagcagcttgcgaaggagctgtattagttgttgacgctgcacaaggagtagaagcgcagactttagcaaatgtatatctagctttagatgatgatttagaaattgtaccggttattaataagatagatttaccttcagcagatccagaacgtgttcgtcaagaaattgaggatgtgataggactagatgcttctgaagctgttttggctagtgctaaaaagggaattggaattgaagaaatgttagaacaaatagtgcagaatgttcccgctcctgacggggatttagaggcaccgttgaaagctttaatttttgattctgtttatgatgattatcgaggtgtagttctaagtattagagttgttgaaggaactgtaaagcctggtgataaaattcgtttgatgaatagtggcgccgaatatgaagtagttgaagttggtgtaaattcacctaaaccattaaagagagattttttaatggctggagacgtgggatatcttactgcaagtataaaagatattcaagatacacgagtaggtgatactgtaacaaatgctaataatccgacagcaaagccactcgagggatatcgtgaaatgaatcctatggtatattcaggattgtatccaacagataacgctaagtataatgatttacgagaagcgttagaaaaattgcagttaaatgatgctgctttagagtttgaaccagaaacttcacaagctttaggctttggtttcagatgtggttttttaggtttgttgcatatggatgttgttcaagaaagattagagcgagaatttaatatggacttaataacaacggctccttctgtaacatatgatgttgaattaacagatggtacacatattaatgtatctaacccatctgaaatgccagaaacaccactaatcaagcaaattaatgaaccatacgttaaagcagagataatggtaccaaatgactatgttggcgctgtaatggagttatgccaacgaaaacgtggtacttttgtaactatggattatctagacgattatcgtgttaatgttatttatgaaataccattatctgaaataatttttgacttttttgacaagttgaaatctagcacacgtggttatgcgtcattagattacgagttagatggaactagaccaagtgatttggtgaaaatagacatacttcttaatggtgataaagtagatgctctaagttttatttctcatagacaatttgctcaagcgagaggtagagtaatagttgataaacttaagactatcataccacgtcaaaactttgaaattcctattcaagctgctattggagctaaaataatagctagaactaatataaaagcttatcgtaaagatgtaacagcaagaattcatactggtgatccagatagacgtgctaaattactagataaacaaaaacgtggtaaaaagagaatgaaagcagtaggtacagtagatgtacctcaagctgcatttatggctgtattgaagacagatgaagaaataaagtaa

SEQ ID NO: 80 - DNA, 555 bp, Lactobacillus salivarius
  isolated from gut, Lactobacillus salivarius
atccctccagtggttaaaaccactggtatctcgcccactatgtcaatgaagagagttgctgtatattgtggagctaatcctggtaaaaatcctatttatactcaagccgcaatcgatgttgctgattggttagctcaacaccatttagatcttgtttacggtggtggcggagttggtttaatgaatgtattggccgaaagagctattaaaaatggtacttataccattggcattatgcctcaatttttagtagatagagaaattgctgctccacatctagatgaattttacgttactgatgatatggacgaaagaaaagctaagatgctttctttagctgatgcttgtttagcattacctggaggtccagggacattagaagaaatcagtgaagctttctcttgggcaagagtggggcaaaatcctaacccttgtgctttttataatgttaatggctattatgataaattagctgacttcttcgatcatatggttacagaaggtttcttaacaactgaagatagaaataaacttctattttctgattcacttgaa

SEQ ID NO: 81 - DNA, 1386 bp, Lactobacillus salivarius
  isolated from gut, Lactobacillus salivarius
atgaagaaattaattaagaaaagtgaacctattttaggcttaggggaaagtattattgttttagctattattctaggaattttaggtttcctaattattggacaacatcaagaaccacaagcaccattattaatcgcttttgttgttttaatggtttacggtcgcttacgtggatttacttgggacacgatcattgacggtatgcgtactggtttacgtgctggagttgatccacttgtaattttcttaacaattggggttttaattgctacttggatcttttcaggaaccattcctactgttatgttctggggatttaaaattatttctattcaatttttcctccctactgtcttcttagtttgtaccttggtcggaattgcttgtggtagttcatttaccagtgtttctactatgggaattgcctttatcggtattggtacaactttacactttagtcctggtctaacagctggtgcaattgtttctggcgcattctgtggttctaacatttcaccattgtctggaacaaccaacttagctgctagcaccggagaaattgacatctacactcatatcaaatcacttctttggactgatctaccagcttggtttatctcattaatattcttcacacttatgggattacatccaaaaccagctagtttacacgctatcaatgttatgcttgatcaattacaaaataacttctggatttcaccatggactatgttacctgttatcttgttgatcattctagctatctttaaagttcctgcaattccttcattaggactaggcgctttatctgctgttattctaggttggattcataatccaaatatctccattaattctattactgaattgattatgaatggattcgttgctcatacacctaacaaaaatatcaaccttcttctttcaaaaggtggtattagtagtatgcttacttcacttgcattaattatttttgccctagctttgggtggacttttaatcaaattcaacattatcggtgtgatcatcactaagattgaagaatctgtcaaaggtatcgttggtttaactatttctgctgctttaacttgtatcggtgttaaccttttagttggtgaacattaccttgcgatcattttaccaggcgaatcctttaaagaagctttcgatcatcacaatttacctagaacagctcttactcgtgtcctcaatgatgccggtgctgcaattaatgctgtcgttccttggagtgttagtggtgtatttatcgccggcaccctacgcgttaatccactagactttattccatttgcaatcttcccattcttagttacggctctttgcatcttagcaggatttgtaaatgttataaagaaaaaagcttaa

SEQ ID NO: 82 - DNA, 2157 bp, Lactobacillus salivarius
  isolated from gut, Lactobacillus salivarius
atgaacacaaataataaacgtcctataaaagaaagacaacaaaggatgatgtacaatcgaaagtattttgggaggggaatattttttattgttcttatcgtttttattgtttttatcggacgtttttttcgtgtagctgtaggacataaaatatatggtgtggatctaaataagagtacacaacagctatacgcaagtaaaactgagataaaagcgaaacgtggaacaatatatgatgcagctaatcaaccaattgctgaggatacgactacttactcaatatatatagttctctctaaaagtgcagttgcttatggaaaaaaagaatatttaccggattcccaaaagaagaaagctgctaaagttttaagtgataatttaaatattagttataaaagagtattacaaattttgaaccctaaagataagaatacttatcaagttgaattgggaaatgttggtaagaacatctctcttgagactaagaaaaagatagattcttatcatttaacaggtataaaatttacaccatcacagtctaggttatatcctaatggtgtttttgcttcacatttgataggattagctgaatcggaggataaaaagttagtaggtattatgggactagaaaaagtatttaataaacaattatctggtcgcgatggaataaataatactgctacagatagttacggtgttcagttgccgggatcttctaaaaagaaacgaagcgttcaaaatggcgatgacatctatacaacattggatcctaagattcaaactgccttagaaaatttacttacacaaaagcaaaagaaatttaaggctgcatcaattaatgcggttgttatggattcacataccgggaagatagtagcagctagccaacgtccgacatttgatgctcaaacaaaagaaggtttgacaaatgtttggagaaatacattgttagaggatgcatacgaaccaggatctactatgaaagttttaacagttgcatctgcaattaatagtggaaattatgattcaaatgcaacttatagatctggatcatatgtgattgatggatccacagtgtacgattggaatcgttctggatggggcaatattacagttaaagaaggttttatgcgttcatctaatgctgtaatggctcaacttgaacaaaaaatgggtaagaaaacctggatgagttacattagaaaatttggtttacttcgcccagtaggtgcaggtttaggtgcagaatctagtggtaatatcaattacacatatgcatttgatcaagctaatacggcttatggtcaagggatagatgttactgttattcaaatgatgcaagctttttctgcaattgctaataagggtaagatggttaagcctcgcttggtagataaaatagttgatcctaatacaggaaaaacagtttataaatcaaaaacacaagtggttggtaaaccaattactgcaaaaacaagtaagaaagttttagatatgatggaagctgttgtctatgacgaaaaaggtcttggacaagattatgcaattgatggctataagatagcagctaaaacaggaactgcccaaatcgctaattcaaacggaacaggttatttgagtggtagttctaattatatcttctcagttgtaggaatggcgcctgccgataatccaagatatattatgtatttgactgtaaaacaaccaaaatcattcggtaataatgatgctactaagaatctagcaactatttttaatccgattatgaaaaaagttttagattcaagtcaagtaaacaatactaatcctggtacagttaaagttgaaaatgttgttggaaactcagttgatgatgctaaggacaaaatttcaaaacaaggcttggtacctgttgtggttggtagtggtgataaagtagagaaacaatcagtcgagggagatcagactgttatttctggagaaaaagtattattattgacgaatggaacgaaaactatgccagacataaatggatggtcaagaaatgatattgctaaactagctgatttaactggaattacggttaattatactggatctggttatgcatactaccaaagtatagcggctggaggagctcttaagaaatctgatatagttgaagtaaaattaaaatag

SEQ ID NO: 83 - DNA, 2172 bp, Lactobacillus salivarius
  isolated from gut, Lactobacillus salivarius
ttgagtctaaaggacattgatattagtaaagttacttactttgatttaaataatgaaataaatattcctgtaaatggtcaaatccaattaggaaaagataaagaggctcttgaagcctttttaaatgaaaatgttaagcccaatactaaacaattttcttcaattaaggaacgaattaattatttaattcaaaataactactatgaagaagaatttatttctaaatattcatttgaatttatcgaaaaattatatgattatctaaaaaaagaagattttcattttaaaacttttatggcagcatataaattttatgctcaatatgccttaaaaactgacgataatgcctactatttagaaaactttatcgatagagtcgctactaacgctctttattttggtgatggagatgaaaaattagctttagaattagccgatgaattaatccatcaaagatatcaacccgctactccaagtttcttgaatgccggtcgtaaacgccgtggagaactggtatcctgtttcttaatccaaatgactgatgacatgaattcaatcggaagaaatattaattctgccctacaattatcacgtattggtggtggtggtggtattaatctttctaatttacgtggtgctggtgctcctattaaaggaattcatggagctgcatctggtgtcgttcctgttatgaagttacttgaagatagctttacatattcaaaccaacttggtcaacgtcaaggtgctggtgctgtttatttaaatgtcttccatcctgatatagaagcatttttatctgctaaaaaagaaaatgctgatgaaaaaattcgtgtaaagaccctttcattaggattagtcgttccagataaatactacgaattagtagctaaaaatgaagacatgtatctttttgatccttggggggttgaacgtgtttaccacaaaccattttcttatgtggatatcactaaagaatatgataatatggttgctaatccaaatattcctaagaaagttattaaagctcgtgatttagaagaacaaatttctaagctacaacaagaatctggttatccttatgttattaacatagatactgctaatagagtaaatcctatttctggaaaaattgttatgagtaatttatgttccgaaattttacaagttcaacgtgcttcagtaattaataatcgtcaagaatatgaagttctagggacagatattagctgtaacttaggttctactaatattgttaatcttatggcatcacctaactttggtaaatctgttgaagttatgactagggctttaacttttgttactgataaatcagatattgatgttgttccatcaatccaacacggaaatcgattagctcatactatcggtttaggtgctatggggttacacgcttaccttgctaagaatcaaattgaatacggatcacctgaagctcttgaatttactagtgtatatttcatgttattaaactattggactttagtagcttcaaataaaattgcaaaagaaagaaaagttacttttgataattttgaaaatagtaaatatgctgacggtagttactttaatacttatttaaatcaagaatttgcaccaaaaaatgcacgtgttaaagaattatttgatggtatctttatacctacaaaatccgactggactagtcttaaagaaaatgttatgaagtacggtttatatcatcaaaacagattagctgtagcacctaatggctctatttcatatattaatgacacaacagctagtctacatcctatcatcaatagaattgaagaacgtcaagaaagaaaaattggaaagatttactatcctgcaccttacttgtcaaatgaaactttaccatattacaagtcagcatacgatactgatatgcgtaaagttatcgatacttatgcagccgctcaacaacatgttgatcaaggtatgagtctaacattatttatgcgttcaacaattccagcaggtttatatgagtggaagaatggaagaactgataaaatgacaactagagatttatctattcttcgtaattatgcacactataaaggtgttaaatctatttactatgtacgtacttttactgatgatgcatctgaagttggtgcaaatgaatgcgaaagttgttcaatttag

SEQ ID NO: 84 - DNA, 1380 bp, Lactobacillus salivarius
  isolated from gut, Lactobacillus salivarius
atgttttcgaaagtattagtggctaatcgtggagaaattgcagttcgtattattcgatcacttaaagaattgggcataaaatcggttgctatttattcaactgttgaccgagaaagtttgcatgtacaattagcagatgaagctgtatgtgtaggaactgcccgtccacaagattcatatttaaacatgaaaaatattttagcagctgctattggaactggtgcggaagcaatccatcccggttttggtttcttatctgaaaatagtcaatttgttgagatgtgtgaagctgtaggtataacttttatcggccctaattctggaataattgacttgatgggaaataaagctaatgcaagagaacaaatgcaaaaaagtggagttcccgtgattccaggaagtgaaggtttcattgaaactgttgaagaagccaaggaagttgcaaataaggttggatatccagttttattaaaagcagcagctggtggtggtggcaaaggtattagaaaggttaatgacgataatgaattaacatcattatttgaagaggctaagcgcgaagctcaagtatctttcggtgataaaagaatgtatctagaaaaaataatgacaaatgtaaagcatattgaagttcaaatttttcgtgataagcaaggaaatgtagtttattttcctgaacgagattgttcagtacaaagaaacaaacaaaagatgatagaagaaagtccatgccttttaattactgaggagcaaagaaaagagctaggaaatatagcaataaaagctgccaatgccattaactatgttaatactggaacaattgaatttttaatggatagtcaacataatttttattttatggaaatgaatacgcgtattcaagtagaacatacagtgacagaaatggttacaggaattgacttggtaaaagctcaagtaaaagtagcttctggagaaaggttaccatttaatcaaaatgatattcaaattaacggaagtgctattgaatgccgtatcaatgcagaagatccatctaagaattttatgccacaggttggtaaggtgcgctatttgtattttccagtaggaaatttgggaatgagaatagattctgatttgtatgcaggttgggaaatcactccattttatgactcaatgattgctaaagtaatttctttaggtcaagacagacatgaggcgattgaaaaagtaaaacgcttattgagtgagatgctaattacaggagtaaaaaccaatcaatctttctacttagatattttaaaagataagaatttcttagaaggtaaagttactactgaatatttagaacagaattttttacctaaatggaaggaagaacataaagatgcagctatttga

SEQ ID NO: 85 - DNA, 1116 bp, Lactobacillus salivarius
  isolated from gut, Lactobacillus salivarius
ttgaaattatcaaagtactttaatacaaaatttttctaccgaattgttgctctaatttttgctctttttctttttttctatgttaatacagatcagttaacatcaggacagtctacaggacatacattaacaacaagtacaaatgagaagtcaattgttattgagatgccattaaaagttaagggagcaaaagatactgaatttgtggcaggattaccagataaggtaaaggttagaataattgggccaagcgcaattgtcacagctattaacaatacacgtaattttgaggtgtatgccgatttaactggtaaagggtatggtaaacatacaataactttatctcaatctgggctgagcaaagaagtgtcagctaagatagatccacaaactgttaaggttaaaattagtaagaaagctacaaaaactttcccagttcaagcacgctataattcaagtaatgtagcaagtggatatgcaactggtagtgtaactatgaataatcaaacggttcgagttacaggtgctaaaaatgatgtaaaaaatgtcgaaattgttgtagcaaatgttaatatcccaagtggaactaagaatgatgtagtacgatctgttctactacaagctttggataaaaagggtaaaagcttagatgtagtttttgatcctgaaacagttcgtgtaacgattccggtttttgaagctagttcaagtaaaaaagtgagcttgaatttagttcaaagcgatggagacaaaaatcgaagttactcgatatcaacagatacaaaaacagttgtgttacatggaacaaaacaagctttgagcaaggtttcaacattaacggtgcctgtgtcagtagaaggtgtaactagttctgtaacaagaacaattcaattacaatcaacaattagtggaattgcaagtatttctccagctacaatttcggtaactattactgcaagtggagataataatgaaagttctgcagatgtatcgcagactaataaaatagataatagtttgaataatgataaaactgaagatgatagcagtaaaactagctcaaatataagtgtaagtagctcgaatagtgagaaatcatctgaaagtaataattaa

SEQ ID NO: 86 - DNA, 180 bp, Lactobacillus gasseri
  isolated from gut, Lactobacillus gasseri
ttgcaacaacaagttcaacaagcaaggaacccacaacaaaaatcagaactaaaaagtaaactaaatgatatacaccatgaaatcagtaatcgaacacaaaaacagttgcaagcatttactgaagaaaatccatcaatcaaacaacccaaatccgaacccgatcaaagtttaaagcgttag

SEQ ID NO: 87 - DNA, 951 bp, Lactobacillus salivarius
  isolated from gut, Lactobacillus salivarius
gtggagttattacttcccggaaatgatagagttgaaattttattaatagatgatggttcgacagataggacagcagagattatagataaatatgagcgtacatatcctaagcaaataaaggctgttcatcaggaaaatgggggacatgggcaagctgtaaacactggaatgtatctagcaaagggaaagtacgtaaaagtcgttgatagtgatgattggctagatttaagttcgtatcagaaagttctgaatttcctagagagtttggaagaatcaaacaaagaaattgatatgttaatttgtaattatatttacgataaagtggagttaggacataaaaaggtaattaagtatcgatggttaccaaaaaataaatgtttcacgtggaacaaagtacatttactgtatggagaatattttttgatgcatgcggttatatatagaactagtctagtaaccaaagaagctaaattaaaactaccaaagcataaattttatgtagataacctgtatgtatttgaaccattgccttatgtcgaaaagatgtactatttagatgttgatttgtatcattattttattggaagagaagatcaatctgttaatgaaaaagtgatgctcaaacgaatagatcaacaattgtatgttaataaaagaatgatgaaattctatgcagagaatatagatgttaattctgacgtaggaaagtacatgaagagatatttagaaattattacgactatttcgtcgatacttttgattcgtggaaatacaaaagagtacttggatttaaaagatgatttgtggaattatttaaaagaatatggcgatgtacataggattttgcgaagaagattatttgggataggtgttaatcttccaggaaaatttggtaggaaattagctatagatgtttataaagtagctcaaaggctatatggctttaattga

SEQ ID NO: 88 - DNA, 666 bp, Lactobacillus salivarius
  isolated from gut, Lactobacillus salivarius
atgtccgtgattataaaagagaagaagaaaagagagccattagcgtacctttttacaatactattctttatcaattattttcttgtatttcaacaggctcaatggttgcataaaatagatacagtagtttattttaaattaactcgtaacttaaataatttacaagtgatgttttacaatgttattagtgaactatctagttccagaatggcaattgtttatacgatagtactactaggaattttatggtttataagatggcaaattcctggtgtgtggattacttttacagttggaacaggattagttgtaggatgggtagcacgattgatattgcgttatggaagtaaaagagttgaaccggaaatgggatatgctttcccaggtttacacgttttagggatgacaattctggtggctattgtatatatcatctttttaccatattttaaagacaaggctttggcttacttagtgggattcattttaggaatttggttaattgcgacaagtgtagcttgtatatatttaggtcaattacatgttagtgatattacaggcgcattaacattaggttttgcttgggtatattactgcagtaatttatacataaggtatgctgcaaagttaaagaagattaaggggtttagaaattcaaattattaa

SEQ ID NO: 89 - DNA, 1002 bp, Lactobacillus salivarius
  isolated from gut, Lactobacillus salivarius
gtgttagaattaatctgtaataattctaaactaactttggaaggggaaattattatggcaatgaatcctagcaaagcgcaagatgtgtggaaagatattggaaagagtgtacaatttacagttcttgaattaaagcgtgaaaatcaagctcatgaacaagaagtgatccaagaatttgcagatcgttatcaagcaattatccgttccttgagaattaggaatggcgatggttacttaaaagcatctttcggtatcagtaatgaagcttgggattatctattccctaatgctcccaagcccaaggaactagaaacgtatgaaacaatcagtggtccaaaatactcaatgcctgcaagtaaaggtgacttattcttccatattcgtgccgatagcgaagcatatgtgtacgaagcaatgagtcaattccgcagattccttgaagacattacaacagttgttgatgaaactaaaggtttccgttattttgaaggccgtgctattattggctttattgatggaacagaagctccacaagtagaagatgctgctgattacgcaatcattggtgatgaagatccattctttgaaaatggttcatatgcatttgctcaaaagtggaaacataatatggacttctggaatcatatgaagactgaggaacaagaaaaagctgttggtcgtgagaaatttactgacctagaacttgaagatgaagataagtttaagaatgctcataacgtagcatctaaggctgaaattgatggtgaggaacaaaagattgtacgtatgaatgttccatattctgatccagcacaaaataatactggtacttactttattggatatgcacgtcattggaaagtaacaaaaatgatgttacaaaatatggtagataaatcagacttcttgttgacattctcagatattttatcaggtcaattattcttcattccttcacgtgatatgttagacaagatagctgatggtgaattgaataaataa

SEQ ID NO: 90 - DNA, 1353 bp, Lactobacillus salivarius
  isolated from gut, Lactobacillus salivarius
atgaagtattttggaactgatggtgttagaggaattgcaaacgaaacattgagcccagaattagcatttaagctaggtcgttgtggaggatatgttttaactcaacatgcttctaataaaccagcacgtgtgttagttgcaagagatacacgtatttctggacaaatgcttgaacaagctcttattgctggtcttttatcagtaggaattgaagtattttctttaggagttatgacaacacctggggtagcttatttagtaagattacaagatgctgatgctggaattatgatttctgcatcacacaatcctgtacaagataacggaattaaattcttcggtagcgatggttataaattatctgatgaaaaagaagaagaaattgaagcattattagaaagtgatgaagatactttaccacgtccttctgcagaaggcttaggtactctaagtgattatcgtgaaggtgctttgaaatatacacaattcttagaacaaacaattcctgatgatttagaaggaatgcacattgctgttgatggagctaacggatctacaagtgcattggtatcacgtttgtttgcagatttgggtgcagattttgatacaatggcaacaaatccagatggacttaatatcaataagggagtaggttctactcatccagaagcattagcaaaatttgttgtagaaaagggtgcacaagttggtgtagcttttgatggtgatggcgatagatgtattgctgttgacgaaaatggtgaaatcgttgatggcgataagattatgtttatttgtggtaagtacttgagtgaacgtggacgcttgaagaaagacacaattgtaacaactgttatgagtaatattggtttgtacaaagcaatgaaagaaaataatcttaattctgttcaaactaaagttggcgatagatacgttgtagaagcaatgagaaaagatggatataacgttggtggggaacaatcaggacacgttgtattcttagacttcaatacaactggtgacggaatgttaaccgcacttcaattattaaatgtaatcaagcaaactggtaagaagttatcagaattagcagctgaagttaagacatatccacaagaattagtaaatattaaagttactgataaaaaagcagctttagataatgaaaagattaaagaagctatcgctaaagttgaagaaaaaatggctgacgatggtcgtgtcttagtaagaccaagtggaacagaagacttacttagagtaatggctgaagctaaaactcaagaattagtgcatgactatgtaatggaaattgcagacgttgtagaagctgaaatgggtgtaaatgaataa

SEQ ID NO: 91 - DNA, 888 bp, Lactobacillus salivarius
  isolated from gut, Lactobacillus salivarius
atgttatatcaacagatagcaaaaaataaacgcaaaactgttctagtaatggcgggctttgtatttttagccgggctaataggggcagcgattggatacgcctttatgggaagtgctcaaacgggtattattattgcagttgttgtcggcatagtttatatgttcgtgattttaggtcaatcaacagatgtagtaatgagtatgaataatgctcaggaaataaccgagcagcaagctcctgaattatggcatattgtagaagatatggcgatggttggcaaagtaccgatgcctagggtatttatcattgacgatcctagtcctaatgcttttgctacggggcctgatcctgagcatgcagcagtagcggcaacaaccgggattctacaaagacttaatcgtgaggaactagagggtgtaatggcacatgaagtttctcatattagaaattatgatattagattacaaacatatgctttggctctcgcctctgtaatttcattcttagcaaatatgggaatgaacgcgatgtggtggggtggaggtagacgcgatgatagagataatggtaatgctggtcaagttataatgctattattatcagttttagcaattatcttaggaccgttagcggcatctatggctcaaatggcactatcaagaaatagagaatatttagctgatgcatcggctgttgaacttactagaaatcctcaaggtttgataaatgctttaagaaaaatttctatgagtgaaccaatgcaaaatgcagatccaagtagtgcttcgatgtatatcgctaatccgtttaaagatggctcatggacacatctttttgacacacatccaccaattgaaaagcgaattgatagactagaacatatgtaa

SEQ ID NO: 92 - DNA, 771 bp, Lactobacillus salivarius
  isolated from gut, Lactobacillus salivarius
atgactaataaaaaagatgcccctattggagtttttgactctggtatgggaggaatttcggtattacgtgaattagttaaaataatgccgaatgaagattatatattctttggtgattctgctaatgcaccttatggtattaagacggtagaagaagtccaaaaattatcatttgagaaagtagagcatttgctatcatataattgtaaagcaattgttgtagcatgtaatactgctacgagtgcagcaattaaggaattgagagcagcataccctgatttaattattgttggacttgaaccagctctaaagccagcagtagaacataaaaaagattctaaagtaggtgttatggcaacaccactaacactgaaagaaaagaaatttaatgacttaatgaataagtatgttacagaggcagatattcgaaagattcctgcaccagatttagtggagtttattgaatcaggtgatgtggattctcctgagttagaaacatatttacgaaagttattgaatccttataaagattcagattccattgtgcttggctgcacacattttccatttgccaaaaaagtaattcaaaagattatgggcgatgatacttttattgtcgatggtggagaaggtgctgctagagaaactaagcatttattggaaaagagtaacttactaagtgataagacagaaaagggttctgtgaagtttgaaaattccaaaaatactaaagaggaattagaacttagtcaaaagctatttaacttgtaa

SEQ ID NO: 93 - DNA, 843 bp, Lactobacillus gasseri
  isolated from gut, Lactobacillus gasseri
atggataatcggcagcaaattcatttagaaaatttaagtctacgttaccgagggattgaaacatccgcgctaaaacatatttcggttgacgccgaatttgggcacgttattggcatcattggtaatcatcatgcaggtaaaacatcgttatgtcgggcattagccggaattgtaccaacaattatttcaggtgatgtaacgggaaccattcaagttggatcattatcgccaaatttggattggcagaagtataatcagcagaccggtgttgtgctgcagaatccggctggtcaattgagtgggcttgccgatacggttgccgatgaaattgcgtttgacctcattaatcaaggagttccagccgatcaaattaaacggagagtcttcaatgttgccgatcagttggggttaggcgaccaattaaatcaatcaccgggaacgctgtctggcggacaaaaacaacggctggcaattgccacagcaatcgtaactgatccgtcaattttggttttagatgatcccactagtgaaatggatccacttggacgtcagcatttcttcagttggttagtcagtgttgaaaaaaagacgatcttcattgtgtcaaatgaagtcgacgatctctgtgaaattgctgaccaaatttgggttctgaaagctggcgagttagttgcggcaggaaaaccgctgactgtttttaatcatctgaagccggactggcagcttgctgaaccgactgtgtttcgattggcaaaattaatgaagtggtcaatccctggtgcagcagacgaatttccggttaccaatcaacaattagaggaggcttattatgccgcaaattaa

SEQ ID NO: 94 - DNA, 1299 bp, Lactobacillus salivarius
  isolated from gut, Lactobacillus salivarius
atgcttaagacaatgaagaacgccttagctgtaaaagagattcgaaaaaaaatcttatttaccttaggtgtcttgattgtatttcgcttaggcacttatatcactgtccctgggatcaacgctaaagctctgcaaagcgttgcatcttcagggttaattaatatgttgaatatttttagtggtggtggtttaactaacttctcactatttgctatgggtgtttctccatatattactgcgcaaattgttgttcagttattacaaatggatattgttcctagatttgttgaatggagtaaacaaggtgaagtagggcgtagaaagttaaatcaagtaactagatatttaactattgtgcttgcgtttgtacaatcaatcgcaatcactgctggttttaatgctttgagtagcttaaaccttgtaactaacccaagtgttaaaacatttgtagttgtaggaattgttttaactggtggaactatgtttactacatggttgggtgacatgataactgatagaggtctgggaaacggaatctctatgattattatggctggtattttatctcgtgttccagatggaatcgtacagatttataaagatcagttctcaggtgttactggtagtgatttatgggaaccaatattatatgtagttattttattgattgttattttaataatcgttacatttgttacgtatgttgaacaagcaagctataaaattcctattcaatatactagaagattggctggagcaactgaaaattcttatttaccattgaaagttaatgttgctggggttattcctgttatttttgctagttcatttatttcagcacctcaaacaatactattagctttcacacagaaccactctgaagatacatggtataagattatgacaagcatttttaatatgcaatctactccaggtatgattctttacacagttttaattgtagtatttactttcttctatgcatttgttcaagttaacccagaaaaactttctgaaaacttgcaaaaacaaggaagttacatacctagtgtatggccaggaaaagaaactgaaagatatgtatcaagattattgatgcgtctcagttcagtgggttcattgtatctaggtcttatttcattaattcctttagttgcatccgcagtttggggattggatgaatcaatcggactaggtggtactagtttattgattgttgttggtgttacaattcaaacaattaatcaattaaatggtatgatgatgaaacaagaatacgtaggctttatacgtgaataa

SEQ ID NO: 95 - DNA, 780 bp, Lactobacillus salivarius
  isolated from gut, Lactobacillus salivarius
gtgatttttttgaaagtactaggtattttaggctcacacaagagtaatggagttactagaatgatgctagatgcagttcttaatggagttgaagcttcaaatgaagtagagttacttaacttgaatgactatcaaattaagccacgtgttccaggtgaagataatccaacattagacttaataattgaaaagctcaaggcagctgatgtatgggttctagcagctcctacttactggggtggactatctggagtaatgaagaactttttagactgtattagacaagaagttttacgttttgatcgaaaaggtgatccacatcctattccagaattcgcacacaagcattatgttacattgacgaactgttacgtaggtaaagcagaaaatatgctaactggaatgacagactcagcttttagaacaatggataaggcgatgacaacagctggcctaattaaattaggtgaaggggttcaaactgcgacttatggtttaaaacaattaactgataaaaagcagacagagctagaaaaattaggcaacaagattaatcgaacacagagaaaggatgaccaaaccttgaaacgttatattgaattgttctttattgtagcagcgatggcattaataacaatggtaattcaagcaggaatattaaaattattaggacaagcacttagcttttggacaaattatatttcctttgtcttgatattctttattttattagcaatcacactccacttcttcacagtagtaaaacataaacgtaaatga

SEQ ID NO: 96 - DNA, 186 bp, Lactobacillus antri
  isolated from gut, Lactobacillus antri
gctggaagaaagctggactatttggataggaaattatatcaaaaggcccgttacctcattaggaaggtaacgggccttttgagaataggcaaaagaaaagccatgctaatcaataagaaaagcatgacactaagacttttactaatggaacatcagcatgaatggaaggagaccaattttctatag

SEQ ID NO: 97 - DNA, 1128 bp, Lactobacillus salivarius
  isolated from gut, Lactobacillus salivarius
ttgttaattttaaaacttataggtagttacttattaacacctgttctatggttaggaatattgtacgtaattattagttataatcagagaattaataaagaaagaaaacaatttagagttgcgataaataaggatttttatgagggacgaaatttcataaaatatggtctgttcttttttgtgatgggaagtttaatttccatgatattaggactaaccttgcctacaaatagtgtatacatatatcaaattttagtagtactagcgtttttaataaacggattttcaacaacaagcatgttattagttatgactgcagcaggtatattagagttagttgtcccaagattcattacattttttggagatgtatttccagaaatatcagggcctagttggctattgttaatatttatttcaatattagccgattattatctaaagagaaatatgaagaagcatccattaagtccaaggataaaaagtggaaaacgtggtagaaatattgccacatatttagggagagaaacgattgtgtttccactgttggtattaattcctagtggtactctctctagcactttgaatttttggccagtttttaatattggtaatcaaaaattttcgttaattttatttccaatttttataagtactagcgttaaagttataaaaagagctaaggaacgagtaattcaagataaattaaagaatactgaattacttttaggcctaacttttattttaatagtattaactaaatttatgtcaagactatttttgatcagtttgataattttgacagtagtatcgatatttttggaaattaaacttagaaagaaagagaaagatgctaattcttggtatgtggaaacagatgaaggaattagaattatttcggttcagccagaaacacctgcagcaaaaatgaagttgcagccgggagatgttattttgacatgcaataatagagtggtaaattctgaggaagaattttatcaagcattacaactaaactctgcatattgccatgttaaagtgagaacttatgagggagatttacgaattgctgaaagtgccatttttatggattctcctcatgaaatcggcttaattttattccactag

SEQ ID NO: 98 - DNA, 666 bp, Lactobacillus salivarius
  isolated from gut, Lactobacillus salivarius
atggaaaaaattggaggaacggttagcatgaagaaattagatagagaaaatattaataaaagatacatctatcattttttcaaacgagtttttgattttttcgctagtctagtaggattaatcttgttatcgccgttgttattatacatagcatttagaatccataaagaagatagaggaccagtattttattctcaaactagagttggaaaagacggtaaagaatttgaaatgtataaatttcgttctatgattgtggatgctgataagaaattagctgaattaaaatctcaaaatgaagtagagggtccaatgtttaagatgaaagaagatcctcgaattacaaaaattggtaaatttattcgcaagcatagttttgatgagttgccacaacttttaaatgtgcttaagggtgacatgagtctagtaggacctcgtccacctttgccaagtgaagttgctcaatacacagattatgataagcaaaggctattagtagtccctggttgtacaggactttggcaagcaacggttagaaatagtgtaggcttttctgaaatggttaaattagatttagaatacattcaaaagagtggttttttctatgatttatatttgatctttttaacagttaagattgtgttgttttctaatgatgcgtattaa

SEQ ID NO: 99 - DNA, 711 bp, Lactobacillus oris
  isolated from gut, Lactobacillus oris
atggcaagagtaattaaatataccaaagcttttaaaaaacagttcaaaaagcggcgccaaaaccccaagtggcgttcaatatttaaaagttcactacctcaagagcttgatgatcaaaagcggagtccttggaaatatattattcagtgtttaattgaagataaaaccattccagattatttttatccacatactttagaaggtgttacaatgaaaaagcaagaaacgacaagaaagaaaaagaggtttgatatgaaaaggtctttcaggcggatttccgctgtcatagcaacgatggctttcacgacaggtctggccgcctgcggttcctcccagtcgacttgccccatcggcgaacaaagccacttcctccgtcactgcccccagggctggaagaagttcacgtccaaggatctgggctattccgtctatttcccgggcgttccggagaaggacacctataaggatcccaccggcgcttatgcccgctattcgacggtcaatgacaaggatcacatcaactacgctgtgtccgtcaccaaattcactcggaagcaagtcgaggactccaaggggttcaatgacgcgcagaaacgtaaggttttgaccaatgtcgctcgtcttctgcagattgacaagtattcctttaccaccgtggacgggcatatggccatttcctacaccggtcacgatagcgaggactcctcggtg

SEQ ID NO: 100 - DNA, 1410 bp, Lactobacillus salivarius
  isolated from gut, Lactobacillus salivarius
atggcaatagattggaaagcagaagttgaaaaaagacgagatgatattctcgaagatttaaaaacaatgcttcgaattgaaagtgtacgagatgaaagtatagcaacagctgatgcacctttaggaccaggccctaaagaagctttagatgcttttttgaatattggtaaacgtgatggatttgaagttgaagaatttgatggtatggctggacacattaaatttggagatggtaaagaagatttaggtattctagcacacgttgacgtaatgccagcaggtaaaggttgggatacagatccatttaacccagttattaaagatggaaaattatatgctcgtggtgcctctgatgataaaggaccaagtatggcagcatattatggattaaagattgttaaagaattaggattaccagttaaaaagagtgtacgttttattttaggtactgatgaagaaagcagttggagaggaatgactcactactttgaaaaaatgcctaagccaacaattggtttttcaccagatgcatttttcccaatcatcaatggtgaaaaaggtaatttcagtatgcttgtaaaattcgatggtaaaaatggggatgaattaaaattattatcctttgattctggtttacgtgacaacatggttccacgcgatgcagtagccgttgttgaaggtaatgatcttgaaagtatagctgctgatttcaagcaatatgttgctgaaaatagtgttttaagtggcgatgcagaaattaaagatggaaaattagaattatccttaattggtaaggctgcccatgcacaagaaccacgtaatggcgaaaatgcagggacttacttagctgtattcttgaataagtacaattttgctaaggatgccaagggatacttagcttttgctgctgaatacttacatcaagattcacgtatggataattttggaattagctatactgatgaagtaatgggtgatttaactatgaatgctggtatctttacatttgaagctggcaaaggtggagaaattactttgaacttcagatatcctagaggtattgatgatgaatatgtattcaatgctgttaaggaagctgcaactaaattagaagctgtttcatttgaaaagaaagaacatgcaatggtaccacattatgtttcacctgaagatccattagtttcaaaattattagctgtttatagtcgtcaaacaggtcaagaagctcatggcatggttgtcggtgggggaacttatggtagattgttagaacgtggtgtagcatttggtgctatgttcccaggtgttgaagacacaatgcaccaagcaaacgaatttatcccagtagatgatgtaatgaaagctgctgcaatctatgcagaatccatctatgaattaattaaagactaa

SEQ ID NO: 101 - DNA, 1005 bp, Lactobacillus salivarius
  isolated from gut, Lactobacillus salivarius
atgaaagcagcatacattgaacattatggacaagaaaagttaactttaggtcaactacctaaacctaagattacttcagctaaacaagttttagtcaaagttcttaaagcaagtgttaatccagttgacctgaaaattcaatctgggaaattacgtccgttattacattttccaatgccacttattttgggtaatgattatgtgggaattgttgaagatatcggagaagaagttaaatcagtagaaattgggcaattagtatttggacgcatcagcaagaaacaaattggaactttttgtgaatatttagttgatgaagaaaataatcttgctgcagtcccatcagcattgacactccaagaagcagcagggttgccattagttggtttaactgcttatcaagcactattcgagaaaatgaaagctaagagtggacaatcgatattaattcatgcaggagctggaggagtaggaagcttgttaattcaattggctaagatgcagggcctgacagttattactactgcaagtcaacgaaataatgcttggctgtattctctaggagctgatcaagttatagattatcataaaaatgattttactgaagtttgcccgccggttgattatgtttttgacactattggacaagaaacattattgcgctcttttaaggtagttaagccaggcgggaaagtagtatctgtttcaggattaccagatgaaaaattcgctaaagactatggtttaaatataatttggcaaaaattatttaagttaggtagttacaagataaggaaagctagtcaaaaagctaaagcagattatgagtttctattcatgcatcctgatggaaaacaattagagaaattggatgaattagttgcagataaggaattggaagtcagacttgataaagaatttgcctttgatgatttacaagcggcttgtgattatgtagcgactggccacgctaatggtaaagtgattatagatgtagtgggataa

SEQ ID NO: 102 - DNA, 531 bp, Lactobacillus salivarius
  isolated from gut, Lactobacillus salivarius
atgaaaaagaatatcttgattgttgatgcatataatatgataggaaattggccacaattagataaattaaagaaaagtgatagactagaggatgctagggatttacttttgaaaatattatctaattaccgtaaacaggctaatacagaaattattgtagtatttgatgcgatgtatgtacctggtatgactaaacaatatgagcaatatgacttacaagtggtatggacagctgaagatcaaacagcagatacttatattgaatcattggctggaagattacaaacgccattgactcaggtaagagtagcaacaagtgatcaagctgaacaatggacaattttttcgcaaggagcattgagactcccagcgtgggaattatatcaggaaataaaaagatccaaaaaagaagttagacaacaggcaaagatatatcaaaatcaaaaagccgcaagacgtttaacttggaatgatgatcagttagaaaaattagctgagtatcgggataaattaatgggaaaagaaaaatag

SEQ ID NO: 103 - DNA, 1335 bp, Lactobacillus salivarius
  isolated from gut, Lactobacillus salivarius
atgcaagaaaaaaatgtaaatcatggtagagctgcgattttaggcttacaacatttattggcgatgtattcaggagcagttgccgtaccattattaattggtacagcattaaaatttaatagcgagcaaatgacatatttagtctcaattgatatttttatgtgtggtttagctacttttattcaattagctcgtaataagtattttggaattggactaccagttgttttaggatgtgcgattcaagcggtagaacctttgaagatgataggtaaacaatttacaattggaacgatgtatggtgcaattattgtcgccggaatttttgtatttttgatttcaggttatttttctaagattaagaaattattcccaccagttgtaactggaacattgattacagttatcggtttaacattaattccaattgctctacaaaatatcggtggtggcgatgcaactgctgctgattttggtaattggaagaatttagttactggttttgtaacaattttgattattttgattattcagatttggggtaaaggttttttgagttctatagctgtattaattggtttaattttaggaacattactggcagctacaatgggtatggtatccttgcaaccaattgtcgaagctgcatggttccacgtgccacaaccattttattttggagctccacactttgaatggtcatcttctgtaacaatgataatcatttccttagtatcaatggttgaatccacaggtgtattctttgctttaggtaatttattaaacaaagatattactgaagatgatttaaagcatggttatcgtgcagaaggtttagcagtagttttagggggtatttttaatactttcccatacacaactttctcacaaaatgtaggtttattacaattaacaggaattaagactaagcgtccaatttattggtcagcagttttattgatgattttaggattacttccaaaaattggagcattagcaactattatcccaactccagttttgggtggggctatgttggtaatgtttgcgatgatcagcgttcaaggtattagaatgttgattgatgttgattttaaagatgaacgtaatattttgattgtagctgtttcaattggcttaggattaggtgtatctatctatcctacaattttccaaaacttgcctcgtacagtgcaattattcttaggtaacggtattgttgttgcaagtatctgttcagttggtttaaatgtttgtttcaaaggtaaagaaggattagatcaagaacaaattactcaaaaagatgaacgaccaatgacagttgaaactaaataa

SEQ ID NO: 104 - DNA, 948 bp, Lactobacillus salivarius
  isolated from gut, Lactobacillus salivarius
atgacgaaaattagtataattgtgccaatttataatgtagaaaaatatttaaaaagatccttagatagcttagtgaatcaaacactagaagatatagaaattattttagtagatgatggaagtactgataattctcataaaattgctgaagattataaagaaaattattctaatgtattattagttactaaagaaaatggtgggttgtctgatgcaagaaactttggtttacagtatgcatcaggagagtatattgcttttattgactccgatgattacgttgaaagtcaaatgtttgagagaatgtataatttatcggaaaatggtcggaagaaaattattgaaagtaattttctttgggaattcccagataaaaaagtaaaagatgtagtgaaaaaatataattcattaaatgaatacttagtaaaaggtagagtagtggcttggaataaaatttataaaaagtcatggctagatacattggattttaaatttccagttggacgattatatgaggatcaggacttctttttcaagatggttgctaatttacaaaatatagaggaaatagctgtagatgatcatataggagttcattatgtacaaagaagtaattcgatttcttataatgaatctacaagaattagggatattttttggatatacaatgatataattgaatactatcgggtacataaagtaacatgttataaaggtgagatggaatatagattcactaggaatttactgggaaatgtattgattagaaaagttttaaagcaaaaagataggaaattaaaaagagagttattatctgaaataaaaagttatattgatacaaattttccaaattggaaaagaaataaatatctcagtgaaagaagtaaacaaaatctatatttaaaaatggtaaattcaataacatataagttattctatttatattag

SEQ ID NO: 105 - DNA, 1863 bp, Lactobacillus salivarius
  isolated from gut, Lactobacillus salivarius
atgtatgagatgaatacatcaaataaaagaaaagaagtgaattttatgtctgaaaagaaagcaaaaagattacttcagagaaatgaagttccagaagaattaacgtgggatttaacaaaagtatttaaaagtgatgaagagtttgaaaaggagtaccaagctgtaaaagatgaagtacagaacttcagaaaattacaaggtacaatggatcaaggtagtcaaagatttttacaaatcattgaaaatttcttaagtattaataggaaatttgaaaaagtttatgtatatgcaagtatgaaaaatgatcaagatactacaaacgctaagtatcaaggatataatgaaatggttgatgcattagctgctgaattttcagaatctatatcttggttcgaacctgagttactagaattagatgaagataaattaaagcaatattttgtagaaaaaaaagaattaaaacagtatgaacatttaattgagagtatgttggtcatgagaaaacatacgcttgataaaaaaagtgagtctttattagctggagctagtgatatctttgggacatcgcaaaatgtttttggcattttaaacaacgcagatctaaagtttccaatagtaaaagatgataatggtgatgatattcaattatcgcatggtgtttatggaaaattaatagaatctacaaataggaaagttagaaaagctgcattcaagggattatacagtgtttatgaccaatttaagcatacaatggcgacaacattaattggaaatgttaaggtgcataactttaaagcaagagttcgtaattataaagatgctagagaagctgccacaacatctaatcatattccaacagaagtctatgatgtattactggaacaagtacacaaaaatcttccattattacatcgctatgtaaaacttagaaagaagatattaggtgtcgatgaactccatatgtatgatatgtatacaccgttaactgaagatagtaagctcacttacaattacattcaagcacaaattgaagccaaaaaagcacttaaagtattgggaatggattatttaacgcacgttagtgaagcatttgaaaatcgttggatagatgtagttgaaaataaaggaaagagaagtggagcatattcatcaggagtttatgatactccgccatatatcttattaaattggcaagataatttagaaaatctttttaccttggtacatgagatgggacatagtatgcatagttattacactagtcataatcaaccctatcagtatggagattacccaatatttttggcagaaatagcttcaactactaatgaaaatattttgacggattatctattaaagaataacgatgaaaaagagatattaatctatattttaaatcactatttagatggatttaaaggtacggtatatcgtcaaacacaatttgcagaatttgaaaaatggattcatgaacagaattcaaaaggagtaccactaactgctaaatcaatttctgaatattacttagaattaaataagaaatattatggcaatgatgtagtaagcgatcctgagatagctttagagtgggctagaattccgcatttttattataatttctatgtttatcaatatgcgacaggatttgcagcagcaactactttagctgaaaatattttatctggcgatgaaaataaattaaacaaatatttaacttacttaaaagctggtagtagtaaatatccattggaagtcatgaaagatgcaggtgtggatatgacagattcttcatatttggagaaagcatttaaagtttttgaagaaagattaaatcaattagagacattattgtcagaaaaataa

SEQ ID NO: 106 - DNA, 813 bp, Lactobacillus salivarius
  isolated from gut, Lactobacillus salivarius
atgactaaagttatagatattgtaaataaatttgaagaatttgcgcctaaaagaattgctgaagatggcgatccaattggtttgcaattaggttctttacataatgatgtacataaaatgatggtgactttagatgtaagacctgaaactgtcgatgaagctattgaaaataatgtggattttatttttgcacatcatcctgcaatgttcgttccagttaagaaatttgatttagatgttccacaaaacgcgatgtatgctaagttaatcaaacatgatattacagtgtatggtgcgcatacaaacttggataatgctaatggtggaatgaatgattggttagctgaacaattaggattagaaaatacagaattcttactacctactaaggtagatcctgtttcaaacgaaaaatactctatgggtcgcgtgggagagttaaaagatagcttaacagctgtggaatttgcagaatattgtaagaaagtattaaatttacgtggtttacgtttaatagcagcagacaaccaaaagccagttaaacgtgtagcagtccttggtggtagtggtggtcgtttctttaacgctgctttactacataaggcagatgcatacgtcacaggtgatatctcatatcataccggtcatgatatgattgctgcaggcttaacagtggttgatgcaggacatcacattgaatctatttgcaaaccaaagttgacagataaatttaaaaagtggaataatgagaatgattggaaaatcgatatttatcaatccaaattaaatactgatccatttcagttcatttaa

SEQ ID NO: 107 - DNA, 600 bp, Lactobacillus salivarius
  isolated from gut, Lactobacillus salivarius
atgaaacttattttgctaaaattgaaaggaagatataaaaaaatgaaaatgattgtaggtttaggtaatataggaaaaaagtatgaaggtacaagacataatgttggatttatggtagtagagcgttttgtggaagaacatggtggaaattttaacaaagaaaaatttgattcattgatatcagagttatttattaatggtgaaaaaataatagtaataaaacctacaacttatatgaatgaatctggtagagctgttagaccattgatggattattttaatctaactactgaagatattattatttgccatgatgatatggatttggaaattggacatttacgtttacgacaaaaaggatctgctggtggacacaatggaattaagtctattatttcacatgtggggactgaaaaatttaagagagtccgtgtaggaattgatcatccacaaaaaatgtcagtggtagattgggtattatctagatttactaaagaacaagaagcaaaattagatgatggattaactagagctgttgctgctttagatgattggatagaaaatgatgattttatgaatacaatgaatagatttaactag

SEQ ID NO: 108 - DNA, 1032 bp, Lactobacillus salivarius
  isolated from gut, Lactobacillus salivarius
atggataaaaaagataatataattttagcttttgaatctagttgtgatgagacaagtgtagcagtagtaaaaaatggaaatgaaatcttgtcaaacatagttgcaactcaagtggctagtcatcaaagatttggtggggttgttccagaagttgcttcaagacatcacattgaacagataacatattgcatacaagatgctcttgatgaagctaatgtagattacgaggacttggatgcggtagcagtgacttatggtccagggttagtgggtgctttattagtaggtgtagctgctgctaaagccattgcatttgcacataatttaccattaattccagtaaatcatatggctggacatatctatgccgcaagatttataggagagataaaatttccagctttagctttattagtatcaggaggacatactgaattagtatatatgcctgaggaaaataaattccaaataattggcgaaactcgtgacgatgcagctggggaagcttttgataaagtaggtagagtaatgggaatgaagtatccgtctggtaaggaaatcgatgaattagctaaaactgggaaagatatttttaattttccaagagcgatggagaaagaagataactttgattttagtttcagtggtttgaagagtgcgtttattaacactgtacatcatgctagtcaaattggagaaaagcttgataaagcagatttagctacaagttttgaacaaagcgtagttgatgtattaagtagtaaaaccgtcaaagcattggaacattttaaggtaaaacaattaattcttgctggaggcgtagctgctaatcaaggattaagaacaagattagataaggaattaacagcatttaaagatgtagaattgttgaaagcacctttgaaattatgtggtgataatgcagcgatgataggtgctgctggatatgtggctttcaagcatggtgttcgagctgacatgacattgaatgctgaaccaagtctagaatttgaatggatggtagaaaaataa

SEQ ID NO: 109 - DNA, 708 bp, Lactobacillus salivarius
  isolated from gut, Lactobacillus salivarius
gtgaacgggtttttaggagaatttttagggacaatggtcctaatcgtactaggtgtgggcacgggtgctggtgttaaccttaaaacatcatatgcacgtaattcaggttggctattcatcacaattgcttggggtatggctgtaacatttggtgtttatgtagctggtagctttggttctcaaggacatttaaatcctgctgttacaatcccattcgcaatctttggattcttcccatgggatcaagtattaccatatttgttaggccaattcttaggagcttttgttggtgcagttttagttatcatccaatatggagcacaatttaagaatgcaaaagactctaatgatggtaatgtagttggaatttttgcaacaggtcctgctattaacaatggcttatacaatttcttaagtgaaacaatcgcaacttttgtattcatcctaacattattaaacttaggagactttacaaagggattgaagccattgattgttggtttactaatcatggtagttggtcaagctttaggtggaacaacaggatttgccttgaatccagctcgtgactgggctccaagatttgcttactcagtattaccagtacctaataaaggtgattcaaactggggttatgcttgggttccaatgtttggcccattagcaggtggtttaattgcagcttgtgttcaatatttcttaatgtaa

SEQ ID NO: 110 - DNA, 564 bp, Lactobacillus salivarius
  isolated from gut, Lactobacillus salivarius
atgaaaataacagaacctattattaaagaagcacaagaaaaaatgacgaaagcagaggactctttacgaagagaattaggaaatatccgtgcaggacgtgctaatgccagtttattgaatagaattaatgtagaatactatggagctcctactcctttaaatcaaatggcacagatttcagttcctgaagcacgtgtattgttggtcacaccatatgataagtcctctttgaagaacattgaacatgctatcatggcatcagatttaggaattgctccaatgaatgatggaacagcaattcgtttagtcattccacaattaactgaagaacgtcgtaaagagttagcaaagcaagtaaaggctgtttctgaaactggaaaagttgccgttagaaatattcgtcgtgatatgatggatgctttgaagaaagctcaaaagaatggtgacttaacagaagatgatttaagagatttagaaaatcaagcacaaaaagtgacagatgaatctattaaaaatattgataaaattacagaggacaaagaaaaagaagttctcgaaggataa

SEQ ID NO: 111 - DNA, 687 bp, Lactobacillus salivarius
  isolated from gut, Lactobacillus salivarius
atgccaaaattagtatttatccgtcacggacaaagtgaatggaacttaaagaaccttttcacaggttgggaagacgttaacttgagtgaaaaaggtgttgaagaagctaaggaagcaggtcgtaagttaaaagaagctggtatcgaatttgaccaagcttacacatctgttttaactcgtgctatcaagactttacactttgctttagaagaatctggccaattatggattccagaaatgaagacatggcgtttaaacgaacgtcactacggtgcattacaaggtaagaacaaagcagacgctgctgaaaagtatggtgacgaacaagttcacatctggcgtcgttcttacgatgtattacctccattattgagtgcagatgatgaaggttctgcagcaaacgatcgtcgttatgctgacttagacccacgcatcattcctggtggcgaaaacttgaaagttactttggaacgtgtaattcctttctgggaagaccacattgcaccagacttattggctggtaagaacgtaatcgttgctgcacacggtaactcattacgtgctttaactaagtacatcgaacaaatctctgatgaagacatcatgaatgtagaaatggcaacaggtcaaccagttgtttacgacttagatgacaagttgaacattgtaaacaaagaaaagctttaa

SEQ ID NO: 112 - DNA, 2028 bp, Lactobacillus salivarius
  isolated from gut, Lactobacillus salivarius
atgggtgaaaaaccaacattttatattacaactccaatttactatccatctggtaaattgcacatcggaaattcatatacaacaatcgcttgtgatgtgttagcacgttacaaacgacttcaaggttacgacgtattctttttaacaggtacagatgaacatggattaaaaattgagcaaaaggctcaagcattaggaatgcaaccacaagaatacgtagataagatggctgctgatattaaagaactttggaaaaagctagaaataacaaatgataagtttatccgtacaactgatgattatcatgaaaaagctgttcaaaatatctttgaaaaattattggcaaaaggcgatatctacttaggtaaatatcgtggatggtattcagtatctgatgaagaatatttcacagaatcacaattagcagaagtttaccgtgatgaagatggaaacatgattggtggtaaggctccatctggacatgaagtgcaacttgttgaagaagattgctacttctttaagatgagtaaatatgctgatagattagtaaaatactatgaagaacatccagattttataattcctgatactagaaagaatgaaatgttaaacaacttcattaaaccaggacttgaagacttggctctaactcgtacaagtttcaattggggtgttaaagttccttctaatccagagcacgtagtttatgtatggattgatgctttatgtaactatattactgctttaggatatgaaactggtgacgatgatagtctatttaagaaatactggcctgcagatgtccacatggtaggtaaagaaatcgttcgtttccacactatttactggccaatcattttaatggctttagatttacctttaccaaaacatattattggtcatggttggttattaatgcgtgacggcaagatgtcaaaatctaagggaaatgttgtctatccagaaatgatagttgaacgttatggtttagatgcattgcgctactacttaatgagagccgttccttttggaaacgatggtgtatttacacctgaagactttatcggtaagattaattttgatttggctaatgacttaggtaacttattaaatcgtacagttgcgatggttaacaagtaccgtggtggtcaaattcctgaattgaaatctggagtaactgcttttgataaagatttagaagacgtggctgctaatactatcaagaattttgaagaacaaatggatagtgttcatttctccaatgctttagatgaagtttggaaattagttgctcgttctaataaatatattgatgaaacagaaccttggattttagctaaagatgaaactaagaaggatgaattagatagtgtgttagctcacttagcagcttcattacgtttagttgcaatcttgattcaacctgtcatgactcacacacctaaggaaatttttgcacaattaggcttaaatagtgatgatatggcaattcaaggtgtttcatactttgacctacctgcaggtgcacaagtagtagctaaagggactcctatcttcccacgtttagatgtagaagaagaacaagaatatattaagtctaagatgactaagaatgaaaaagctaagggtcgtaaagctatggctgaaaaagctaaagaaaactgggatcctgaaaatacaactttagttttgactaaggacgaaatcaaatttgataagtttgataaagttgaattgaaagttgctgaaattaaagaagtgtctaaagttgaaggtgctgataagcttttgaaattcagattggatgcaggcgatgaaggtgaccgacaaattctttctggaattgctcaatggtatccaaatccagaagaactagttggaaagaaagttattgctgtaactaacttgaaacctcgtaagatgagaggcgaagttagccaaggaatgttgttgtcagcagaatttggtgaaacagtccaattaattacagtttcagaaaatattccaaatggttcattagtaggataa

SEQ ID NO: 113 - DNA, 879 bp, Lactobacillus salivarius
  isolated from gut, Lactobacillus salivarius
atgtttaaaggggaaatttttatggtagcaacaatattagatgggcgaatgttatctaaaaaaataagaactaatgtatctgaaaaagttagcttattaaaacaagaaggaataactccaaaattagtagtaattttagtaggcgaagatcctgctagtcaagtttacgtaagaaataaaagaaaaactgcacatgcgttaggtatagaagctgtagatattagattgcctgaaaatgttgaagaagatgaattaattaggttaattgatgaattaaatagtgatggaactgttcatggtattttagtacaattgccgttaccaaaacatataaatgaaaataaagtaacccatagaattatacccgaaaaagatgtagatggatttcatcctttaaatatcggaaaactatttatgaatatacctggaccattaccttgtaccccaagaggaattatgggatttttcaaggaatatgatattcctgtttcaggaaaaagagttgtaattgttggtagaagtaatattgtaggtagaccaatggctgcattgttggtaaatagtgatgctactgtaacaatagcgcatagtaagaccaagaatttagctgaagtgacaaagcaagctgatattttgattgttgctattggtaaaggtgagtttatagatgaaaattatgtaaagaaaggagctgttgtgatagacgtgggtatgaacagaaataatgatggaaaattagttggcgatgttaatatggaaagtgtgagcaaagtagccagctatataaccccagttcctggtggtgtagggccaatgacaattgcaatgttgatgaaacaaacagtagaattagcagaaagaagtgttgctggtgagtaa

SEQ ID NO: 114 - DNA, 852 bp, Lactobacillus salivarius
  isolated from gut, Lactobacillus salivarius
atggagattacacttgatattttacaaaaggtcattaaaaaacgtgaacctaacagtcataaaggtaattttggtagggtattactcattggcggaaatattaactatggtggagctataattatggctgcttccgctgccgttcatgctggcgctgggttagttactgtcgcaactaataaagaaaatctatcttcattacattccgtcgtaccagaagcaatgtttattaatttttttgacaaagtatctcttacaactgctatttcaacggctgatgcagtagttgtaggccctggattaggtactgataatagagctaaagaagttcttgaagttacattaagcaatatctctgataatcaactttgcataattgacggttcagcaatcactctcatatctgaaaatgattccttaaaagaattgattgctaacaataaaaaaatcatttttactcctcaccaaatggaatggcaaagactatctggtattcctatagataaacaaattgatgacatcaacttacaaaaacaaacatcgctaaatgctactgttattttaaaaaaacaccatactactatttatcatcaatcaggaactattgataatttagcaattggtggcccttttatggcaactggtggtatgggagatatcttaaccggtatcctcgctgcatttatcacacagtttaaggaaagttcactagatgaaagaatcaacgcagctgtttatttacacagctatatagctgaaaatttatctcataaatactatgtgacattaccaacagatattattaaaaagattcaaaaaacgatgttgaaagttatttctgaacaaaaataa

SEQ ID NO: 115 - DNA, 1194 bp, Lactobacillus salivarius
  isolated from gut, Lactobacillus salivarius
atgagtgaaacagaagcaaacttattagaagaagctttgaacagcgttaaagaagttaaagttggagacgttgttaaaggtgaagtattaacaattgatgaatctaaccaagttatcgttggtatcgaaaacactggtgtagaaggtgttgtacctgtacgtgaattaagcgtaaatgctgataaagttgctgacacatacaaagctggtgacatgttagatttagttgttattgctcgcattgggtcagataaagaaggtggaagttacttattgtctcaacgtcgtttagaagcacgtagagtgtggaacgaaattgaagataagttcaaagctggcgaaactatcaaggctcctgttacacaagttgtaaagggtggtttagttgttgatgctggtgttcgtggttttgtacctgcatcaatggtatctgaccactttgttgaagatttaaaccaattcaaaggtcaagaacttgaacttaagattgttgaaatcgaaccaagtgacaaccgcttaatcttatctcgtaaagaattagtacaagctgaacgtgaagctaagcgtcaagctgttatggaaaaacttgttgctggtgacgtagttgaaggtaaggtagctcgtttaacaaactttggtgcatttattgaccttggtggtgttgatggtttagttcacgtttctgaaatttcttacgaacgtgtaaacaaacctgctgatgcattgaaagttggacaagaagttaaagttaaggttctttctgtagacgcagaaaaaggtagaatttctctatctatcaagcaaacattacctgaaccatgggaacaagttcctgaacaagttgctgaaggtgacgttcttgaaggtacagttaagcgtcttacaagtttcggtgcatttgttgaagtattaccaggtgttgaaggtttagtacacatttctcaaatctcacacaagcacattgctacacctaacgaagtattgacttctggcgaaaaagttcaagttaaagtattgagcgttgacgcagcagatcatcgtctagctttatctattaaagcattacaagaaaaaccagcagttgaaaagaaagaagcagctcctaagaaggaagaaaaagtagaaattcctgaagaagatacaggatttactttgggtgacattgttggtgaccaattaaaagacgaacaataa

SEQ ID NO: 116 - DNA, 1413 bp, Lactobacillus salivarius
  isolated from gut, Lactobacillus salivarius
atgttgcaattgtataatacattaactaatcaaaaagaaaaatttgaaccattaaatcctgggaaagtgacaatgtacgtctgtggcccaacagtgtataactatattcatattggtaatgctagaagtgcggttgcttttgatacaatcagacgttatttagaatatcgtggttttgaagtaaactatgtttcgaattttacagacgttgacgacaaaatcattaaagcaagtcaagaaatgaatctttcagttaaagaaataactgagaaatttattaacgcgttttatgaagatacaagtgctttgaatgtaaagaaagctacattgaatcctcgagtaatggataatatggatgatattatcaaatttattgaagttttagtacaaaagggatatgcatatgagtctgctggagatgtatattataagactagaaaatttaaagattatggtaaactatctggacaattaatagatgatttagaacaaggtgctagtagccgagtcgatgatatcgaccaagataaaaagcaagatccattagatttcgctctttggaaaaaagcaaagcaaggagaaatatcttgggattctccttgggggcaaggacgtccagggtggcatattgaatgttcagtaatgtctactaaatatttaggagatacaatagatattcatgctggaggacaagatttagaattcccacaccatgaaaatgagattgcacaaagtgaagcaaagactggcaaaaaatttgctagatattggttacataatggatttgtaacaattggtgaagaagatcaaaaaatgagtaaatctttaggaaattttgtaaccgtacatgacttactaaaggaagtaaaccctcaagttattagattctttatgtcaacaacacaatatcgtcgacctatccgatatagttctgctaatttaaacgaagcgaaagttaatctaaataaactacaaacagcttatgaaaacttaagttatcgtttaaaagatagtgtagaaggaaacgataaagaagtagaagttaattttgctaatcttgaaaaagattttgttaaagttatggatgatgattttaatgtacaaaatgggatttctgttgtttatgaaatggctaaacaactaaatgtctattcagaaaaagaaaaggtatatactgatactattaataacttaattaacacttataagaaagtcgtagaaatttttggtataagttttagtgaagaaaaagaattgttagatgatacgattgaacaacttatccaagaaagaaatgaagcaagaaaaaataagaacttcaaacgtagcgatgaaataagagatctactaaaagaacaaggaataatattagaagatacagcacaaggtacaaggtggaagagaaatgattaa

SEQ ID NO: 117 - DNA, 1791 bp, Lactobacillus salivarius
  isolated from gut, Lactobacillus salivarius
gtgatatcattgagtgatactagaaaatcgttaagatattttattaagtatttaagaccttactggaaaggaattacactggtagtgctatttacaatcatttttacgtgggcgcaagttgaagctccacattacttaggtttagcacttacatcgttaacaaaatatgtagaacagtatttcaatccagctagtagggcgacagcatcaatggatgatttctaccaagctttgaaattaatgctgattttctttattttaaacgcgattatcatgctatttacatgggttattacctcaagatttaatgctcattcaactaataatatgcgtgagaatttgtttggtaagttacagaagatgacgattaagtattttgatacgcatcaagatggaaagatattgtcattgtttaactctgatttggataatatctttaatgcgatgaacaatgcggtatttgaagttatttcgcaaacagcactgtttattggaacaatatggatgatgttcagaattgatgttagattagctttagtaacagtggcctcaactccatttgttgtagtcttgagttggataattatgagaaaggcacgcaagtatttagatgctcaacaagatgaaattagtaatctaaatggctacattaatgaacaaattaatggtcagaaagtaattatcacaaatgggttgcaaaaggaatcagttgaggggtttaaagttcataataaaaaagtccgtgatgcgatgtttaaaggacaattctattccggaattcttttcccaatgatgcaaggcctatcagtattgaacctatctattgtgattgcgatgggttcattatgggtggttgacggaacttatagtagagcagttggtttagggttaattgtgactttcgtacagtattcacagacttatttccaacctttaactcagttaacttctatttattccatgatccaattagcactgacaggtggtagacgtctagcaacaattgaagaacaagctgaagaaaaccaagttccaacaggacaagaacttaagtcacttgaaaaaggagttaagttagaagatgttcactttggatacaatgaaaacaaggaaattttgcatggaattaatatttctgtgaataaaggtgagtcagtggcattagttggtccaactggttctgggaaaacaaccgtaatgaacctgttgaatcgtttctatgatgttacaggtggaaaagtaacttttgatgatgtggatgtcagagatttaactttggaatcacttcgtaataatgtaggaattgttttacaggattcaattctcttttcaggaactgtggcagataatattaagtatggcaagccaaatgccagccaaaaagaaatagaagaagcggctaaacaagctaatattcatgactttattatgactctaccgcagggatataatactgaaattaacgatgaaaattccgtcttttcaactggtcagaagcagttaatttcaatcgcaagaacaatattaactaatccaccattcttgattttggatgaggcaacgtcaaatgttgatactgtaactgaagaaaagatccaaaaggcgatggatgcagtgattgcaggtaggacaagttttgtgattgcacataggttaaagactattattaattctgataagattgtggtattgaaggacggtaaagtcttagaagaaggtaatcatgaagaattattgaaagaaaaaggtttctactataatctatacacaaaccagatggcatttgaataa

SEQ ID NO: 118 - DNA, 672 bp, Lactobacillus salivarius
  isolated from gut, Lactobacillus salivarius
atggcatttacaatttacatggttcgtcatggacaaacatttttaaataagtataaccgtctccaaggttggtgcgattccccactaactcctaagggaatggaagatgctcatagtgctggacgtcatctagctcatatcaattttgatcatgcatatcattcagatacaactcgtgctatgagaacatgtcgttatattcttgaagaaaacattgcatccaatgatattacacctaaagaaattcgcaatttccgtgaacaaagctttggttattttgaaggcaatgactcttcacaagtttggacaatgttaggtgctcaacatggtggctatcgttcatataacgaacttattgcaaactatagtttaggtaaaactcgcgactttttaaatgaaattgacccattcaaagatgcagaaacagatgaacaatactgggctagaatcaatgctggctttgatcatcttcgtcgtcatcgccaagatggtgaaaacattcttcttgttagtcacagtattacaattagaagtattgtagatcgttttgccccagaattgggagcagctgaacttggacctagaaatggttcagttactaaattaattgtttcaaaagatgatattaaggttgagtattataatcatcatttagatagcgaaacttactaa

SEQ ID NO: 119 - DNA, 843 bp, Lactobacillus salivarius
  isolated from gut, Lactobacillus salivarius
atggttgtaattgtaaacggatactttgcaactgtatttatccgtgatttattgaaacataagcaggaatttaaggaagaaccagctgattccaaatggttagcattgtcatcatttattatattctttttatcaacatttggaatttctgattttgcaattggtactgttctatatcaaaaagctaaatgggtaagcatgaaaaaattgccaggaactttgaatacagaatgcgtaatacctgtagcagttatggctttgagctatattactggaatatcagttggtatcaaaactttattggtttgtatcatttgccaagttatcggtgcatatttaggaccacgttttgtagttaaattgccagaaaaaaccattaaagtttttgtagggattggtttaattatcgcttcacttttgatcgttgctggtcagttaaaattaattccttcaaatgggactgcaacagaattatatggttggaaactgattttagcaggatttttactttttgtatatggtgcgttgaataacattgggattggatcatatgcgttgacgatggtgacagtatatttactaggattaaatccaattgcagcttttcctattatgatgggggcatgtacattctctgttccggttggttcagttcaatttattaaattggatgactatagtagaaaaataactctattcactgcaacttttggggtgttaggtgtattagtagctgtatttttggtaaagcaactaaatacatatcttttaaattggttagtagtaattgtcttgctatatagtgcctatactatgttatcaaagcaaaaagaagaagcttag

SEQ ID NO: 120 - DNA, 993 bp, Lactobacillus salivarius
  isolated from gut, Lactobacillus salivarius
atgaaaagattaatagcaacaattattgcattagcagtatttttaggagtagcttttaacgtagaaaaaaagcaagaagaaagcaaaaataaaatgcctacagtcgctattttacaaacattaagtcatccagctttagatcaaatccatcaaggaatagtggatggattgaaagaagaaggttttgtaaatggtaagactatgaagattgattaccaaaatgctcaaggtgatcaaagtaacttaaagacaatgagtgatagatttgtacaggaaaaagcatcagtacttattggaattgctacacctgcagttcaatcactggcaaatgaaaacagtaagattcctattacaatgggagctgtaagtgatccagttggaactggtttggtaaaaactttagaaaagccaggtggtacagtttctggggtaatgcacaaagaacctgtcgctgctcaagtgaagttgattagagaattcatgccagacttgaaaaacattggagtaatttacacatccagcgatgattcatcaactgccgaatataaggaatttaagaagttagctgaaaaagcaggaattacagttaaaacttatacaataacttctactaatgatattgatcaagtatctgcaactatggcaagtgaagtacaagctgtttatgtaccttctgataacaccgttgcttctggcttctctactttagtaaagaatactaatgcgaagaatattccaattttcccaggtgttgactcaatgattaaaggtggcggtgtagcaactgttagtgttagtcaatatgaattaggaaaattaacaggtaagatggcagctcaagaacttagaggtaagaatccagcaacaatgctagtcgaaacagtgaaaaaaggttctacggttattaatcaaaaacaagcagataagcttggtttgaaagtaccagcaagtgctataaagcaagcaaatgagaaaggggaaattataaaatga

SEQ ID NO: 121 - DNA, 1716 bp, Lactobacillus salivarius
  isolated from gut, Lactobacillus salivarius
atgaaacaatcacaaatgttaattccaacattaaaagaaattccaagtgatgctgaagttgtcagtcatcaattaatgctaagagggggatatatcaaacaaataacagctggtatgtatgcttacttacctcttgcatatcgagtaatgaagaaaatcgaaaatattattcgtgaagaaatggatagaattgatgcagtagaaatgctagtccctgcagttgtaccagcagagttatggcaagagtcaggacgttatgaaacttacggtcctactttgtttaaattaaaagatcgtcatgaacgagattttattttaggaccaactcatgaagaaactttcacaacaattgtaagagatgcaataaaatcttacaaaaaattgccactatatttatatcaaattcaaatgaagtatcgcgatgaaaatagacctagatttggtttattacgtggtcgtgaatttttgatgttagatggttattcattccatgttgatgatgcaagtatggaaaaagtttttaatgatactgacaaagcatatcaaagaatttttgaacgttgtgggctagattttagaggaattattgctgattcaggcgcaatgggaggaaatagatcaaaagaattccaagccatcgctgaagttggagaagatacaattgcatattctgattcgtctgattatgcagctaatattgagatggcaaagaatttgagaatacctaaacaatctcatgaaactccaaaagatttggaaaaagttgctacacctaatgccaaaacaattgttgaagtagctgaatttttgggaacagatactcaaaatgaaattaagactctactatttgtggctgatgacgaacctgttgttgttttaatgagaggtattgacgaagtaaatgaagttaaattaaagaatcatttaggagctattgatttacgtccagctgaagaagaagaagctgtaaaattcttaggtgcaaacttcggctctctaggacctgtaggaattgatgaaaatctaaaagtactagcagatttagatgttgaaggaatgataaatgctagtgtaggtgccaatgaagatggttaccattatataaacgttaatattgatagagattatcatgttgatgaatttttagatctacgtgaagttagagaaggagaactatcaccagatggcgaaggtgtattgaaatttacacgtgggattgaaattggtcatattttccaattaggaactcgttattctgagagtttgggtgcagatgtattagatgaaaatggacgtcaagttcctatgagaatgggttgctatggaattggtgtttcacgcttattatcagcaatagttgaacaacataatgatgaaaatggtattgcttggcctcgcgaaattgctccatttgatattcatgttgttcctgttaacgtaaaaaatgatacacaaagagaactaagtgaaaaagttactgcaatgttagaagatgcaggatatcaagtgttagttgatgatagaaaagaacgcgcaggagtaaaatttgcagattcagatttaattggacttccaattcgtataactgttggtaagaaagcagatgaaggaattgttgaaattaaacttcgtcaaaatggagaaaagattgaagttaagttagaagagttattaaattctgtaaaaatactttttaatgaaacaattactgattag

SEQ ID NO: 122 - DNA, 744 bp, Lactobacillus salivarius
  isolated from gut, Lactobacillus salivarius
atgaaaataataatttctccagctaagaaaatggtagaagatacggacagctttgatattagtaaattaccaatatttaaagacaaagcagaagtgttattaacatggttaaaaagtaaaaactatgatgaattaaaaaatatttggaaatgtaatgataaaattgccaaacttaactatgatagaattcaagatatgaatttagatgagaacttaacaccagcagttatggcatattcagggattcaatatcaagcgatgggaccacaagtttttacgcaagaagcactacaaagagcagcaaaagatttatatatcatatcaggattttatggaattttaggagcgatggatggtattacgccatatagattagaaatgcaggcaaaagtagatattaatgatcaacatactttgtatcaattttggggtgacagtatatatcaagaattatatagagataatgaattagtagtaaatttagcttctaaagagtattctaaagccattgagagatatctaaaacctcaagataaattcatcatttgttcatttaaaaaggaaaagaatggtaaatatgtacaacaggcaacagctgctaagcaagcacgtggtgatatggtaaggtatattttagaaaataatattaaagaaattgatgaaataaagaacttttcagtaaatggatatcaatatgaacctcaattttcaactgatactgaattagtgttcattaaaaactaa

SEQ ID NO: 123 - DNA, 1365 bp, Lactobacillus salivarius
  isolated from gut, Lactobacillus salivarius
gtgcttaatctagatttagattcactttggcaatatattattgaatctttcagtaaatctttaaatcctgctagctacaaggcatggtttggtccagcagaacctgttcaatatatcgatcaaacactaatcgtaaatgttccaacacctttacatagggattattggactcaaaagcttaatggacaaatttcagatctaattcaagaagtatctggtgaaaaaataactgttttagctaagctacctagtgatcctaatcctctagcaaattcagaaagtgtaactacaccaaaaaaagtttctgttgtagaaaataataatagttcttcttttctaaaagaaactcaacttaatgatcgttatacttttgatacttttgttgttggtaaaggtaatcaattagcacatgcagcagcactagccgttgctgaagaacctggcgttttttacaaccctctcttcttctacggcggtgttggcctgggaaaaactcacttaatgcacgctattggacatcaaatgttagaaaatcgtcctgacgcaaaagtaaaatacgttactagtgaatcctttgccaatgatttcattagttctatacaaacaaaacgtcaagaagaattcagacgtgaatatcgaagtgttgatttactacttgtagatgacattcaattttttgcagataaagtaggtacacaagaagaatttttccatactttcaatgcactatatgatgataaaaaacaaatcgtactttcatcagatagattgcctaatgaaattccaaaacttcaacaaagactagtttctcgctttaaatgggggctatccgttgatataactcctccagattttgaaacgagaatcgcaattttaagaaataaggctgaggctgagcatgtttctattccagatgacactcttagttatatagctggtcaaatagattcaaatatcagagaacttgaaggtgctttaatgcgagtagaagccttttcttcaatgactcgcaccccaatttctactagtctagcagctgaagctcttaaaaatttaaaagttagtggcaaatccagcaaattaactattcctatcattcaagataaagtagctaagtattatcatgtaacaattgctgatttaaagggaaagaagcgtgttaaatctatcgttattcctcgccaaattgctatgtacttatcacgtgaactaacagatgcctcacttccaaaaattggaaatgaatttggtggtaaagatcatacaactgttattcatgctcatgagaagattgctgaagctcttcatacagacactactcttcaaaaagaagtaaatgaactgcgcgctgagctgcaagattag

SEQ ID NO: 124 - DNA, 2475 bp, Lactobacillus salivarius
  isolated from gut, Lactobacillus salivarius
atgagtgaggaattagatctttttgcccaagaagataatggtaagtatcttataggaacagtaaatgctgtctattttgaggcttccgatagtttttataaagttctacaagtcttgattaaggaaactaatttcgactgggatgatcagagaataactgtgacgggaagctttgctaatatccagacagattctttatatcgatttgagggaaatgttgtagaacatcaacgttatgggaaacagttccaagctgaaagttatcaactagaattaccttctacaaaagatggtgtaattgcatatctttcgagtgatgaatttgttggtataggtaagaagactgctgaaaaaatagtaaaaaaattaggtgtagatgctattgacgttttaaacaatgatatggataaattggaagaacttggattatctgaaaagcaaaaggacagtataaaaaaagttttaaaggaaaattatggaattgataaaatcataattgaacttaatagtctaggttttactagtacgatggctggaaggatttataataactatacaaatagtaccttggaaataatccatgaagatccatacaggttatccgtagatattgacggaattagctttactaaagcagatcaaatagcacagcaatttggttttgctagtgattcccctggtagaattcgaggagctatttttcaatcattgtatgatttgacttatgctacaggaaatacttatgttgagttaaaacctttagtaactgaaacattaaaacttcttgaaagtaatcgcaatgaagcaattgacccacaattagttgcagatcagttaattaagcttgctgaagaagataaaattaagtctgatgataataaagtgtacagtagaacctttttcaatgctgagtggaatatagcagagaatttatatcgactattgaaatcgggcaacagtgatttgccaaataatgatgcgttattagataaactcttaataaaggctgaggatcaattgggaatagattatgatagtgaacaaaaaagggcgataaaagatgcaattaaatcgccagtttttctgttaacaggtggtccaggtactggtaagacaacaattattaatgggattgttgcagtatatgccttattaaacgacatagatttagatattggtaagtacgataaagataatccatttccaatattgttagctgcaccaacaggacgagctgctaaaagaatggcagaatcaacgggattaccagcttctacaattcatagaatgctaggaataaatgcacatgatgataagttacctgaagatattcaagaacttgaaggtgcattgttaattgtcgatgaaacatctatggtagatacacttatcatggatttattgttaaatagtattcctagtcatatgcaagttatttttgtgggagatagaaatcagcttccatcagtacaaccagggcaagtattttctgatttattagttagtgataccttacctaaaaaagaattaacgaaaatctatagacaaggtgaaggttcctcgataattaatttggcacattcaataaagaatggagagctgccagcagactttactaaagcacaatctgacagagcatttattccatgtgaagctgggcaattaacttctgctgttgagcaagtggtaaaagctgctttgaataagggaaatagtaaagatgatattcaagtattagctccaatgtatcgtggtaatgcaggaattaataggttaaatactattttacaagaattattgaatccagctaaacctcgacaaaaagaagttattttcaatgagcaagtatttagaattggagatagagttcttcatttagtgaatgatcctgaaaacaacgtcttcaatggtgatattggaaagattgtgggaataaatatacctaaaactaaaaaagataaaaagggtgagcagataatagtagacttcgatggaaatgaagtaacttttgataaaaaggattggattaatttaacgttagcttattgtatgtccatccataaatcccaaggtagtgaatttccaattgtagtattagcaatgttgccacaatatcaaagaatgtttgctagaaatttgttatatacaggaataactagagctaagcaaaaattagttcttttagggaatgtttcttcatttagacaaagtgcagagattatctctctcaatagaaaggctggattattgaaacgtataagaatggaattcggagtagaaggaaaaccagtagaaaaaactgataatgaagaagttgctgtgaataataacaaagaacaagattccattgttgaagaacaggatgaaccgttcatttataatgatggtatattgaccatggatattattgttaataacaaagttgatgcaatgataggtatggatgatataacaccgtatgattttatgggataa

SEQ ID NO: 125 - DNA, 1386 bp, Lactobacillus salivarius
  isolated from gut, Lactobacillus salivarius
atgagtaaaattagacttgttttattaaatattattttagttctaatatcaatgctaggtgcagtattgataatggttgattttaaaaaatcggttctatcagagtttttggaaagagaatcgtggatacaaattataattgctgttgtagtacttgtagtattagatacaggaattgatttgtggaatagtagaaaacaaagaaaagagatagagagattaaataagaaaattatagaagatatcaaattaactgataatgtgatagataagaagaatccttattatgagttatctcaatctataggttatgttcaagataaacaaaataagctttctaaaaaatatgataaaagaaaaagagaatatttgagtttattagaatacattgatattggaatattagttattgattataaagatagattaacaatgtctaatgaattaggaaaagatttttttgattttgacaatgaatggaaaaatcaagattatcaaaattatatttacaatcttgatgtgagaaaattaattgagcaagttaagttgaccaaggaagataagaaaaaacagattgtattaaaagtcgatacagttcaaaaaattgttgagacaagtgctatctatattccaatagattctaagcactacttaataatgctgatgttacgagatttaacagctcaaaaagaagtggaaaaaaagcaattagattttgtgggaaatcttagtcatgaaataaaaacgcctattactgcaataacaggatttagtgagacattattagatggtgctctaaatgataaagaagttagtaaacaatttattgaaattattcatgatgaaagtactaaactctcgaacttagttgatgatatgataactatttctagattaaacgagcatggaaatttgaatattgagttggtaaatatctttaagttggttaaagatacattacaattatttagtcatgaaattgagaaaaaaagattgaatgttaggatagaaatagatgaagaattaagtttatattgtgataaattgaaattaaagcatattatcactaatttaattcaaaatgcaattcgatataatttagaaaatggggaaataaaaattaaggtccaaaatgataaaaaaaatgagtgggtctttgttatcagtgatacaggtattggtatatcggatgaagataaagaaaggatctttgagagattttatcgtgtagataaatcacatagtaaaacagttggtggaacaggattaggtttagctgttgtaaaggaatcagttgatgctttatctggaaggataaaagttaaaagtcaaattaataagggaacaacattttatgtgattttaccgagatttaaggcaaggtag

SEQ ID NO: 126 - DNA, 1761 bp, Lactobacillus salivarius
  isolated from gut, Lactobacillus salivarius
atgtttaagaaaattccattattacaagaattgaaaaaagatacttgggttaagcctttcttgaaaaaatacaagaaaactttggtactagcaattttcttaggaattttaacattcttttgtgcaggagccttgatgtttaattctggttatctaattagtcgttcagctacacgtccagaaaatattttgctagtttatgttccaattgttttgacacgtgcatttggtgtaggtagaccggtattccattatcttgaaagattaacaagtcataattgggtctttaagatgacttctgatttacgtgttaagttatacaaagctttggaaaaagatgctgtattttttaagagtaagtatcaattaggcgatgtcttgggattgttatcagaagatattaatcacatccaaaatttgtatctaagaactattttcccaacctttgttgcatggggactttatgtatttgttgttattggagttggtattttttcaatttggatgggatttttaatgttattaatgataggtattatgttagtagcattcccaatctggtcagttatcgtaaatggtgctagacaagaatatgaaaagaaaataaagaatgaattatacctagacttaactgataatattgttgggattacagattggatttttgctcaacgtggtcgtgattatgttaagctacatgaacaaaatgagggaaaattgatggatgttcaagaaaaactacatcattttgatcaaatcagagattatctcttacagttagtgtttatgttggtagttgtgagtcttattttatggggcggtacatacctaggtggcagtaatggagtatatacaggtctagctaactggattgctgcttttgttttgtgtcttttccctgtggttgatgcatttgcagtaattccagctgcttcacaagaaactaatgtatataaggattctttagttagattaaatagactacaagataattcatttgaagaagaaaaatcagaaattaaattaattgcaccttatgatattaaattagataatgtgcattttagatatgaaaatggtagtcgtgaaatccttaagggtattaacttagatatatcttctggcgataagttagcaattttaggtcgaagtggttcaggtaaaagtacgttagctaacttgattagaggggatagagttgctactgaaggtacgattactataaatggtattgacgtaagcaaagttggcgatcaaatttccaattatattggagtaatacatcagactccatatttatttaatactactattttaaataatcttagaatcggaaatgaagaggctactatcgagcaagtatggcaagtgctggaacgtgtaggcttgaaagatatggttaaagctttaccacaagggctggaaacaatggtggacgaagccggaatgcgtttttctggtggtgaaagacatcgaatggcattggcaagaattttgttaaaagatgctccaattatcattttagatgaaccaactgtgggcttagatccattaactgaacaagaagtaatttcaatttttaatcgtgaattgaaagataaaactttaatttggataactcatcacttacaaggtgttgaagcaatggatcaagttatctttattgaagatggaactattgaaatgcagggtagtcctgattatttgagaaaaacaaacgaacgttatcaaaagcttaaagcaattgatgaaggacgataa

SEQ ID NO: 127 - DNA, 639 bp, Lactobacillus salivarius
  isolated from gut, Lactobacillus salivarius
atgttagagttaaagaatattagtaagagctttggtgataaagttattctaaataatttaaatttagaagttaaagatggtgaaattttatgcatcgttggtcaatctggtggtggtaaaacaacccttttaagatgtattagtggacttgaaaagattgatggcggtcaaattttaattgatggtcaagtatttgatccatatacaaatgaaaataatgattctgttatcggggtagtattccaagaatataacttattcccacaccttacagttttacaaaacgtaactttagcacctactatggttttaaaaaagaaaaaagaaattgctgaaaatgaagctaagaatttattaaatggtttagctttagaaggaaaagaaggattatatccattccaattatctggtggtcaaaaacaacgtgtggcaattgcacgagctttagcgatgaaaccacaaattttatgttatgatgaaccaacttctgctttggatccaggattgacagctacagttaaaaatatcattttgaatttgaaaaaagaaggaatgacacaaattatagtaactcacgatatggattttgcagaagagattgcggataatattttgaaagtgaaacctttaggctattaa

SEQ ID NO: 128 - DNA, 1113 bp, Lactobacillus salivarius
  isolated from gut, Lactobacillus salivarius
atgcgaaaaagaatcataggattaatattagctattttaggtgtaggtgcaggatatacatttctaccagagctatggagcttgataggacttggaagtaatcgctggttaactaatgggttggttaatgctattattggtttgattattatggaaatactagcgattttcttaatagatgctattgagcgagtaatcataaaaatagagaaaaatttgattagacaaaagccggaagtaattatttcaacgagcttgtcaatcacagtgggattaattgtagcagctttaatttcaacgatatttaatcgatcacatgtatttttcatcaataccattttgccaattgtattaatgattttattagggtatctgggatatgttgttgggaaagaaggctttggaaatttaaagagattatttaatttacgacaaagaaaagtggaagatgataaagctcagattttagaaagaaaagttggcgaaaatttccacaaatataagttgttagatactaacattttgatagatggtagaatttatgatctagcaaaaactggtttcattgaaggaacattagtagttcctaattttgtattatatgaacttcaatatattgctgactcaggagatagtattaaacgagttagaggacgtagaggtttggacattctaaataaactacgttcagaaaaaattgttcctgtaaaaatgtatgagggagattttgaagatataaaagaagttgacagtaagcttataaaattagcaaaggttttagatgcagtcatagtaacaaatgattacaatctaaataaagttagtgaatttcaaaatgtacaggttttaaatgtaaatgctttggctaagtcattaaaaccacgtgttattccaggtgaaaaattaaccgttacagttataaaaaatggtacagaaagacaacaaggtgttgcatacttggatgatggaacaatgatagtggttgaagatggacgttattatctcaataaacctattgaggtagaagtaactagtgcattgcagacggatgctggaagaatgatttttgcaaagccaacacattctaaaagagaattacgtgagaaaaactaa

SEQ ID NO: 129 - DNA, 1398 bp, Lactobacillus salivarius
  isolated from gut, Lactobacillus salivarius
atggggattttaaatcgcattctaagaaaagaaagtctcgaacgttacttagattccgacaatcaccttgaacgcattatcggaactaaagatttaattgccatggggattggtgttgttattgggacaggtatttttatccttccaggaactgttgccgcaacacatagtggtcctgcgattactatttctttcatcctagctgcaattgtttgttctacttcagctttatgttatgcagaattttcatctgctttaccagttgccggaagtgcttattcattcggtaatgttatcttcggtgaactcataggttggattttaggttgggctttaattcttgaatatatgttagctgtcgccgccgttgcaactggatgggcttcatacttcaactcttttattgctggttttggaattcatattcctaaagcagtcagtggtccttttaatccatctcaaggtacttacgttaatttaactgctattttaattgtattgtttatttctttcttgttaagtagaggtgtgcaagcatctattcgtcttaacaacattatggtttatctaaaaattgcaattattttattatttgtcatcgttggtgccttttttgtgaaacctgctaattggaatccatatatgccatttggaatcaaaggtgtcttcactggtgcctcaacagttttctttgcttatttaggatttgatgttattgcttcatcagctgctgaagttaagaatccaaaacgttcaatgccagctggtatcttaggaactttatcaatcactactgttctatatattgctgtagcagctgttttaactggaatggtcaagtatacaaaacttgatgttggaaatcctgtatcatacgctatgcaactagctcaccaagattggtttgctggtatcatcgccttaggtgctttgatcggtatgtttactatgatcctttcaactacattctcatcttctcgcctaatttactcaattggtcgcgatggtctactacctgcttctttaagtaaattagatgaaaagacacatacacctaaagttgctctatatgccgtaacagttgttatagctttaactagtggatttgtttctttagaccaattagctaacctagttaatattggaactttagttgcttttaccgttgtttctctaggtgttattcctttacgtcgtcgtaaagatattgataacagcaaaggattcaaagttccattttatcctgtacttcctattgtttctgttgttttatgtttaatcatgctatctcaactttcattagaaacatgggttgcttctggtatttggttcttaattggtttgattatctacttcagttacggtattaaacacagtaagctttctggaaataaataa

SEQ ID NO: 130 - DNA, 1335 bp, Lactobacillus salivarius
  isolated from gut, Lactobacillus salivarius
atgagttatgttgatgacgtttattcaagagtagtagaacaaaatcctagtcagcctgagttccatcaagctgttaaagaagtattagaatcattaagaccagtaatcgaaagtgatgaagaaaagtatcgtaaagaagctttattggaaagattaacaactcctgaccgtcaaattctattcagagtaagttgggtagatgataatggacaagttcaagttaataatggttatcgtgttcaatttaataatgcaattgggccttataagggtggtcttcgtttacatccatcagtttacctaggtattattaagtttttaggatttgaacaagtatttaagaacgcattaacttcactaccaattggcggtgctaaaggtggttcggactttgatcctaaaggtaagtctgacagagaagttatggcattctgtcaaagtttcatgactgaactttataaatatgttggagctgatgttgacgtaccagctggtgatatcggaacaggtgctcgtgaagttggttacttatttggtcaatataagcgtctaaagtctacatatgaaggtgttctaactgggaaaggcttgacctttggtggttctttagctcgtactgaagcaactggttatggattactatatttagttgaagaattattaaaagatcatggtaaagacttgaaagataaagttgtgacagtttctggtgctggtaacgtagctatttatgcaattgaaaaggcacaacagttaggagctaaagttgtaacatgttctgactctaatggttgggtatatgacccagaaggaattgatgttgaactgttaaaagatgttaaagaagttaaacgtcaacgactaacagaatatgcagcacgaagagaaagtgctcaatatcatgaaggtcgtggggtatggtcagttaaagctgatgttgccttaccatgtgcaactcaaaatgagttaaatttagatgatgctaagaatttagttgctaatggtgtacttgctgtttgtgaaggtgcaaatatgccaactacattagacgcaacaaagtatcttcaagaaaacggggtactttttgttccaggtaaagcaagcaatgctggtggtgttgcagtgtcagccctggaaatgagtcaaaattcagaacgtctaagctggtcattcgaagaagtagatggcaagttaaaggatatcatggttaacatttatcataatattgatgaagctgctaagaaatatggtttagatggagactatgtagcaggtgcaaatattgctggcttcttaaaggtagcagaagcaatggaagcacaaggtgtagtttag

SEQ ID NO: 131 - DNA, 3426 bp, Lactobacillus salivarius
  isolated from gut, Lactobacillus salivarius
gtggaaaaagtattaattgctaatcgtggcgaaattgcgattcgtattattagagcatgtcatgaactaggattaaaaacagtagctatttatgccaaagaagatgaatatggtgttcatcgttttaaagctgatgaagcttacttagtaggtagtggtaaaaagcctattgaagcttatctagatatcaatgacataattcgaatagctaagatgacaaatgctgatgcaattcatccaggttatggatttttagctgaaaatgaagaatttgctcaaaaatgtgaagaaaatggaattacatttattggaccatcagtggaacatctacgtatttttggtgataaagtagaagctcgtaatgttgctaattctgctggtttacatactattccgggaacgaatgatccagtaaaatcacttaaagatgttgaaaagtttgtagataaacacggttatcctattatgattaaagcagcaatgggtggcggtggccgtggtatgagaattgttaaacgtaaagaagaattacgagaggcatatgaacgtgctagaagtgaagctaaccaatcatttggtgatgatgaactttatgttgaaaaaatgattgttaaccctaaacatatagaagttcaaattttagcagataaacatggaaatgtaatgcatctttttgaaagagactgttctgtacaacgtcgtaatcaaaaggttatagaatttgccccaagcataactttgtcacaagaacgtcgcaaagaaatttgtgaagctgcagttaatttggcgaaatctgtaaactactataatgctggaacagtagaatttttagtaactgaagatgatttttactttgttgaagtaaatccacgtgttcaagtagagcatactgttacagaaatgatcacaggtgttgatattgtacaatcacaaattcaaattgctgaaggtaaagatttgtataatgatttagaattaccaaagcaagaggagttaacaagccaaggtatagcaatccaatgtcgtattacaactgaagatccagaaaataactttatgccagatacaggtaaattggaaacatatcgttcaccaggtggttttggtgttcgcctagatggtggtaatgtatatgctggagcagtaataacacctttttatgattctttattagttaaggcttgtgttcaagcacgaaactttaaagaagctattaagcgtatgaacagagtgcttaatgaatttagaattagaggtgttaaaacaaatattaaattcatgcgtaacgtgttgaaccatcctgttttcgttgcaggcgatgcacgcactacatttattgataacacaccagagttattcgaatttaatcgtagcagtaacaataataaccaattattgaagtatattagtgatgttactgttaacggattcccaggcacaaaacatcatcgtaaagtatttgtccctgatattaaattggataaggattttgtatctgaaagtaaagtagaaaatgcaaaatcagtatttgataatggtggagttgatgctttagccaattgggtaaataaacaagaaaaggtattaataacagatacaacaatgagagatgcccaccaaagtttatttgcaactagaatgcgtactaaagatatgcttccggtaattgaaaaatatgatacagctttacctcatgtattttctgctgaggtttggggtggagctacttttgatgtagcgtatcgtttcttaaatgaaagcccatgggatagattagatattattcgtgagaaaatgcctaatactttgctacaaatgctattgagaggttctaatgctgtaggatataagaattatcctgataatgtattgagagaatttgtcaatgaaagtgcaaaacatggagttgatgtatttagaattttcgatagtcttaactggacagatcaaatggaaaagagtatagagtttgttcgcgatgctggaaagatagcagaagggacaatgtgttatactggagatattttaactcctgagaataataagtatagtttagactactatgtcaacttagctaaggaattagaagcaatgggttcgcatattatcggtattaaagatatggcaggacttctaaaaccaaatgctgcttatgaattaattagtacattgaaagaacaagttaatgtgccaatacatttacatacacacgatacaacaggtaatggtgtggcaacatatgtacaagcagttcgtggtggagttgatattattgatgttgcaactagttcactttctggtacaacaagtcaaccaagtatgagtagtttgtattacgcattagaagggaacgctcgtcagccagaactaaatattgataatgttgaaacattgaatcgttattggagtggaattaagccattctatcaagactttatgaatggaactacatctccacaaacggatatctatcaaacagaaatgccgggtggacaatattctaatttacaacaacaagcaaaggcagtaggtattgatgattttgaacaagttaagtcaatgtacagaactgttaataagttattaggtgatatcattaaagttactccaagttcaaaagttgtgggtgattttgcaatctttatgattcaaaataatttagatgaaaagtcaatctttgaaagaggtaaaactttagatttccctaaatcagttgtagatttctttgcaggcgatttgggtcaaccagttggtggatttcctaagaaactacaagaacttgtacttaaaggtaagaagccaatcacagtgcgaccaggtagtttagctaagccagttgactttgatgaagtagctgatgaattaaaggataagattaaacgtaaccctacaaaggaagaggttctaagttatattctatatccagaagtcttcatagattatattaacaacgtaaaacgttttggttctatgcatgatttagatacaattactttctatcaaggaatgcgtgaaggggaaacaattcatgttgactttaaaccaggacgtagtattataatccgtctagattctgtttcagaagctgatgaggaaggaaatcgtagcttattcttctcattaaatggtcaaaatattcaaattattgttcatgataagagtaaggaagctaagattaagaagattcctaaagcagagccaactaatgaaagtcatataggtgcaactttaagtggatcagtactagaagtattagtacaaaagggtcaagaagttaagaagggtgaagcattaattgttactgaagctatgaagatggaaacaacaattaaggctccatttgatggaaaagttagtcatgtatatgttaaaaatggcgatgttcttgaaagtcaagatttattattggaattggataaaaactaa

SEQ ID NO: 132 - DNA, 981 bp, Lactobacillus salivarius
  isolated from gut, Lactobacillus salivarius
atggatttgcgaaaggataatgatatgaaaacaaaacaagagaatattttttcttctaaaacattgagttatttcttgcaacttgctgagacaatgagttacacacaagcagctcagatattagggattacccaaccagcgcttactcaacaaattaaaaagttagaaagaacagtaggtgcaccattattttactcagtaggtaagaaattacatctctctgatgcgggttacacaatgttggatgctacacatcagatttatgaaacattgaaccaagctactgatgagatacaaatgtcaacaagtgcaacacaaggcgaaattaatataggtattttagcttcaattgaagacagtgttattagtcagtttgctacagcttattatcgtgaacataatggtattaagttaacaacacatatgcttacacgtaaggaaatttgggaaagattagaaaataatacaattgatttggcagttatgtatttgcctgatgaaagtattaaaaattggaaaccttatgaatctaaacgtatttgccaagaagatttaatctttttacataacgataataagattaaacaaaagaaaattaatctaaaagatacgttacaacatccatgggttacatatccacctgaatattatctaaatgaaagcataagtgaagcctataaaaatgcaatgttagatgcaccaaatagtgtttcttactttgcaacaccaggtcaaatttttaattttgcagctcaaactggtgtatgtactgctttgccaatgtcatttgtagtagcacataatcaagatggtattatgaagcaagcattattggaaccaggcattagctttgatttgtcatttgtctttagaaaaggaaaagatcaaataccaagaatttctaatttcttaaaagagattgacaattatctacgagaagaagattatattagtaggttaacaaagattaacaaaaaataa

SEQ ID NO: 133 - DNA, 4356 bp, Lactobacillus salivarius
  isolated from gut, Lactobacillus salivarius
ttggggaaaggagctacttctttggaaaccaataaacaagatctatttaagaaattattaagacagattaattgggaaaataaacatgggtttgaagaggtatttacgaatgcagaaattcaaaaagttgaagttcatgtagagagtaaagtttggaattttcatttacagatagaagatatactgccatatgaagtattttaccaattttatcagcaactacagttagcgtttaaagatattgccaaagttgacatcactttgcatacaaaaaatcccattataacgaatcaaaagttaggagattattggaaatgggttgtatttaatagtggtattcaatcatcatttatacaagaactttccagaagtaaagtaccatatttagataataatagagtaattttactggcagaaaatgaaattgtaaaacgttttttagtagatcaagctttaggtccattagaatcaacatatcacaagatagggtttcctaaattttcagttaatactctagttgatgaaactaaggctcaggagataattgagaatattaaagaacagaaagctaagagcgatgccgaattggctcaaaaagctgtagaagccataaagaaacaaagtgaacaaagagaaaaatctaaagcagaagttcctagtatagaagggccggtccaactaggaaagaaaatttcacctgatcaagaaattacgcaaatgattaatataactgaagaagaacgttcagttacagttcaaggctacgtgttcgacaaagaagttagagagttacgttcaggaagaaaattattaatcctggaagttacagattacacttcatcatttgtcgttaagaagttttcacgaactgaagaagatgaagcaatgttcgatgctataaattctggtgtctggattaaggtgcgtggaagtgttcaagaagataactatatgagagacctagttattaatgcatatgatttgaatgaaataaaacatgagagtagaaaagatacggcccctgaaaatgaaaagcgagttgaattacaccttcactctaatatgagtatgatggatgctactaatagcattacagaatacgtatctaaagctgcggaatggggacataaagctattgcaattacagaccatgggacgttacaggcatttcctgaagcacatgctgctgggcaaaaaaataatgttaagattctctatggtgttgaggcaaatattgtagatgatggagttcctattgcgtataatgagcaacacaaaaacttaagagatgcaacatatgttatttttgatactgaaacaacaggtttgtcagcacaatatgataaagtaatagaacttgctgctgtaaaaatggaaaagggaaatgttattgatacgtttgaagaatttattgatcccggtcaccctctttcacaaactacaattaatttaacaagtattactgatgacatggtaagaggttctaaaagcgaggaagaagtttttaggttattcaaagaattttgtaaagattgcattattgtaggacacaatgctacttttgacgtagatttcatgaatacaggatacgaacgtcataatatggaaatgatacaggaaccttggattgatacattaccgttagcaagatatttatatcctgaaatgaaaggatttagacttaatacattagctaaaaaattgaatataaaattagagcatcatcatcgagctatatatgatgctgaagctactggttttatatattatgctatgttaaaagatgctgaagaaaaacaaatattatatcatgatgactttaataagcatgttggggaaaatgatgcgtataaacacgagcatccatcgcatgcaataattttagcaaaaacacaagaagggctaaaaaatctctttaaattaacttcagaatctatggttaagtatttctatagagttccaagagtaccacgttcaattttagaaaaatatcgtgaaggacttatagtagggtctgcttgtgctgatggagaagtatttacagcaatgatgcagaagggatatacaattgctaagcaaaaagcagaattttatgattatttagaagttcaaccaaagccgttgtatgaaccattattagaacaagaattagttaaagataatgataatcttgaagaaattattacaaatatggtcaaattagcccacgaactagataaaccaatagttgctactggagatgttcattttatgaataaagaggatgcaatttatcgaaagatattaatccattctcaagcaggagctaacccattaaatagattaaaaaaattaccagatgcacattttagaactacagatgaaatgttagaagaattcagctttttaggagaagatatagcaaaagaaattgtggtaaccaatcctaataagttagtagatgaaatttcagaaattactcctgttaaagataaactttatacacctaaaatggaaggtgcagagcaagacatacatgatcttactatgaatagagcacatgcctggtatggtgatactttaccagaaatagttcaaaagagattggataaggaattaaaatctgttattggtaatggattttcggtaatttatctaatttcacaaaaattagtgtataaatctaacaaagatggatatttagtaggttctcgaggatctgttgggtcaagcttagttgcaacaatgacaggtattacagaagttaatccattgccaccacattatcgatgcccaaaatgcaagtggacgcatttttatgaaaaaggtgagtatggttctggttacgacttaccggataaagactgtcctaattgtggtacagaattaataaaagatggacaagatataccttttgaaactttcttaggttttaagggaaataaagttccagatatagatttaaatttctctggtgactatcaacctattgcacataattatacgaaagtcttatttggtgagaataatgtttatcgtgctggaacaattggtacagtagctgataaaacggcttatggctatgttaaagcttatgagagagatactgaacaaaatttcagaggtgctgaaatagatagactagctaagggagctactggagtaaagcgaactacagggcaacatcctgcaggaattcttgttgttcctgattatatggatatttatgactttactccaatacaatatccagcagatgacctaacagctgcttggcgtacaactcactttgattttcattcgattcatgataacatcttgaaattagatattttaggtcatgatgatcctacgatgataaggatgttacaagatttatctggaatagatcctaaaactatccctacagatgaccctggagttatggctttgttctcaggaacagatattttgggtgtaactcctgaagagattcaatcttcgacagggacattgggtgttccggaatttggtactcgatttgttagaggaatgttagaagagacccatccaaaaacatttgcagagttattaaaaatttcaggattatcacatggtacagatgtttggttgggaaatgcagaagaattaataaaaaatgggactgtaacaatgccagacgttataggatgtcgtgatgatattatgatggatctaattcatatgggtgttgagtctgataaagcgttcaagattatggaacatgtacgaaaaggtagaggaataccagatgagtggcaagctgatatgagagcagcagatgttcctgagtggtatatcggagcatgcttaaaaattaagtatatgtttcctaaagcccatgctgctgcgtatgtcttgatggcactaagaattgcatattttaaagtttattatccccttgtttactatgcagcatatttctcagtacgtgcggatgattttgatttggtttcaatgtctagaggaaaagaagctgtaaaaaatgcgatggaactcataaattcaaaaggaaatgaagcaacaactaaagagaaaaatcttttaacagtattagaaattgctaacgaaatgttagaaagaggtttcgattttagtatggtagatattaataagtctgatgctcagaactggactattcaagaagacggaagaacattattggcacctttcacagcaatccctggtttaggactaaacgtagctaagcaaattgttgctgcaagagaggaacaagaatttatttcaaaagaagatctaagtaagaggggaaaagtatctcaatcattgattgattttatgacagaaaatcatgtattggatgatttaccagatgaaaatcaattaagcttattttaa

SEQ ID NO: 134 - DNA, 693 bp, Lactobacillus salivarius
  isolated from gut, Lactobacillus salivarius
atggctaagaaaaaaagtaaaaagtatttagaagctgctaagcaagttgaagaaggcaagttatacaatgcttctgaagcatttggcttagtaaagaagattgattttgcaaactttgatgctactatcgaagttgctttcaacttaaacgttgatacaaaacaagctgatcaacaattacgtggtgctatggttttaccaaatggtactggtaaagatcaaacagttgttgtatttgctaaaggtgcaaaagcacaagaagctaaggatgcaggcgcagacgttgttggtgacgacgacttagttgcacgtatccaagacggttggttggactttgatgttgctattgcaacaccagatatgatggcacaagttggtcgtttaggtcgtatattgggacctaaaggcttaatgccaaaccctaagactggtacagttacaatggatgtaacaaaggctgttacagatgctaagtctggacaagttacataccgtacagaccgtgacggtaacgtacatgttccattgggtaaagtatcatttacagaagaagcacttgaaggtaacttcaaagctgtttatgatgtaattgctaaggctcgtcctgcatctgttaaaggtgtttacatcaagcatgtttctgttgcttctacatttggaccaagtgttacattagatacaacagcactttaa

SEQ ID NO: 135 - DNA, 2400 bp, Lactobacillus salivarius
  isolated from gut, Lactobacillus salivarius
atggataaagaaaaattacaagaaaagctattacaaatttttgaagctgaaccacaaaaaaaattccaagttcaagatttagttaaagttcttgacatggaaggagcaggtcaattcaaatttgtagtacaagctttagcagatttagaacataataagcaaataaaattatctgaagatgatacatttagtttaatagtaaaagaaagtcctaaaacttttgagggagtctttcacgctaatgatagaggatttggttttgtatcagtagatgatgaagaattggatgatttctttattagtcctacacaaactctagctgcattgaacggcgatcgcgttgtagtcgaaatgatcagtgaaggcgatcctgaaattagcaagcgtcctgaaggtaaggttatcgaaattattgaccatgttctaacacaagttgttggggaatttcgtgttgatccagatgaaatcatgccagatggatatattggaacagtacatttaaaagataaaaaattatctaatatcaagtgttttattgaagaaaaaggattacatccagtacctggggaagttattttagctgatatcacttcttatcctacacagacactaccaaatataatcaaggcagtagctgttaaagttattggtaatgttaacgatccaggaatggatattttagaaattgtataccaacacaatattccaactgaatttccagaagaagtgttagaacaaatttctaagattccagactatgttacagaagaagaaaagattggtcgtgtagacttaactgatcaagatcttgttactattgatagtatagaatctaaggacttagatgatgctgtaaatgtttggaaacttcctaatggaaattatcatttaggagtacatattgctgatgtttcacattatgtaaaacctaaaacacctctagataaagaggcttttgaacgaggtacttctgtttatttaacagacagagttattccaatgttacctcctaaattatctaatggtatatgttctttaaatccacatgtagaacgtctagcaatgacatgtgaaatggaaattaatgctgatggagaagttgtaaatcataaaattttcccaagtgtcattaaatcaactgaaagaatgacatataaggcaatcaataaaattttagaatctgatgatgaaaaaactaaagaacgttatgcagatttagtacctatgtttaaagacatggctgaattacataagattttagttaaaatgagaaaacgtcgtggtgcaattgattttgatgcccctgaagcaaaaatcattgtagatgaattaggacatccaattgatattgaattacgtgaacgtggaactagtgaaagaatggtcgagtcattcatgttagcagctaatgaaactgttgcggctcactataataaattacatgtaccatttgtataccgtattcatgaaacaccaactccagaaaaaataacaacattctttgaagctcttaatagtttaggaatagaagttactggtagaagtaatgatgttaaacctaagatgttacaaaatatcttgaagaaggtagcaggtaaaccagaagaagcaatggtatcaacaatgttgcttcgttctatgcaacaagctaaatactcacctgacccattgggacattttggtttagcagctaaagattatactcactttacttccccaattagacgttatcctgacttgatggtacatcgtttgattagatactataaagaaaatggtacatctgaacaagttcaagaaaagtatcgtaacaaattagacgaaattacacttcacagttcacaaatggaaagacaagcaattgacgctgaacgtgatactgatgcaatgaagaaggctgaatttatggctgatagagttggagaaacattcccagctgtagttagctcagttacaaaatttggaatgtttattgcgcttgagaatactgtagaaggtttaattcatattagtgagatgaaagatgactattacgtattccttgaaaagcaaatggcgttagttggtcgtcattctaaacgaacatttaagattggacaaccaattgaagttaaactaattaatgttaatgtcgaacaaaaagagatagactttaaattagagggtgtcaaagatattcctaagtctgatttattagagggtgttgaattacctgaatttaaaccacgtgataataataaacgtcgttttaaagataaggataaaaaacgttcacatggcaataagaagtaccatggtaaagataagaaaaactttaaaggtggacaaaagcctttctacaaaaatggtaataaaaatagatttaatcactctaataagaaaggtcgacgttcaagataa

SEQ ID NO: 136 - DNA, 996 bp, Lactobacillus salivarius
  isolated from gut, Lactobacillus salivarius
atgattcatttggaaaataaaaatacaacatttaaacaaactccacttcaaaaaacttattttgcactaggaactagaattaatctaactatctttggttgcgaaaatcctgttatcttagataaaacatatgacttaataaaatattacgaagatgtcctaactgttaaccgtgacgaatctgaagttatgtccattaatcatgctgctggcaaatatcctgttagagtaagcgaggcaacttataagcttattaaacgttctgttcaagttagtcaggaatatcttggcttcaactctttaatcggtccacttgttaagctttggggaattggttttgataatgctaatgtacctgaagacgaggatattaagtcaactttaaatttaattgaccctcaaaaaattattctagatgataacgaaatgacggtattcctacaagatgatggaatggaactagatttaggtggaattgctaaaggatatattgctgatagaattaaaaacttttggcatgcctttgatattagttcaggtattatcgacttaggtggaaatctattaatggtcggccctcaacctaaacatgatgatgcactctggcgaattggtgtacaaaatccacatgatgctcgtggtagtgcaattggagtagttgtgacacctgaatgttctattgtaactagtggaatttatgaacgtcatttagaagttgacggcaaaagttatcatcatattttagactctaaaactggatatcctaaacaaaataatctagcaagtgttacagtattctctaaatactcaattgatggagaaattgaaactactaatctcttctttgccggcgaaccagttaaagattggggcaaagataatcctaacttattaggagctgtatttgtaactactgataataagatatatttgagtaagtttactcctaatgatttccatttactctccgatgaattcgaagttattcaacattaa

SEQ ID NO: 137 - DNA, 846 bp, Lactobacillus salivarius
  isolated from gut, Lactobacillus salivarius
atgaagcaagttggatactacaatggtactatcgctgatttaaatgaacttaaggtgcctgctactgatcgtgcactttattttggtgatggttgctacgatgcaactacatttaagaacaatgttgcatttgccttagaagatcatcttgatcgtttttataatagttgtcgcctactagagatcgatttccctttaaatcgcgatgaacttaaagaaaagctttatgctgttattgatgctaacgaagttgatactggtatcctttattggcaaacttcacgtggttctggtttacgtaaccatattttcccagaagatagccaacctaatttattaatttttactgctccttatggtttagttccatttgatactgaatataaacttatatctcgcgaagacacccgcttcttacattgcaatattaagactttgaatttacttccaaacgttattgcaagtcaaaaggctaatgagagtcattgccaagaagtagtcttccatcgcggtgacagagttacagaatgcgcacactctaacatcttaattctaaaagatggcgttctctgttccccacctagagataatttaatcttgccaggaattactttgaaacatctcttgcaattagcaaaagaaaataatattcctacttctgaagcaccattcactatggatgatcttagaaatgctgatgaagttattgttagctcttcagcttgcctaggtattcgtgcagtcgagcttgatggtcagcctgttggtggaaaagatggaaagactttaaagattttgcaagatgcttatgctaagaaatataatgctgaaactgtaagtcgttaa

SEQ ID NO: 138 - DNA, 834 bp, Lactobacillus salivarius
  isolated from gut, Lactobacillus salivarius
tggggtgagatgatgaagcggtggatgttttggttaataacagcaattgtagtggcacttgtatttgttggctttggttatactaaaaagcgtgaaacacaaaagcagtttgataatttaatgtctcaagcaataactaatgctcaagctgcagaatataagaaagcagaacttaatttgcaagatgctctacgtaagaaaccagatgatgtagtagctaaacaacgattagaacaagttaaactctatcaagaaggcttagctgaattgaaacaagatgattatgaacaagcacagttaacatttagatcaactgcaaaagtatctccgtctttatcaattttaacccaaagagctaagaagaaagataagtttctagaatcagtactaaagcaacgtgaaaagtatgatgatctttataatgaagctgtaagacttactgaaatgggagcttatagccaatcgaatgaaaatctagttcagattttagatggaaaaaatattgacgaaaagtattattcacaagtaagaaaagatgcacgtgaattgcaagaaagaaataatagtattttggaacaaattagaattcaaaatcaacaagctgcaataagaagacaacgtgaacaacaaagacaagaagaagctagaaaagcacaacaagctgctgctagttcatcatcgtcagcggaaaatcaaaatgatgagcccaagaaaagtgacgataaaaatgatgatagaaatagtggtcaagacaatgtaaaaaatagttcggaatctaagccagaaacaaataattctgcagctgagccacaacctaataatgaaaataagtaa

SEQ ID NO: 139 - DNA, 876 bp, Lactobacillus salivarius
  isolated from gut, Lactobacillus salivarius
atggcaagtagatctaaaggactaggacgaggaatcgatgctttattccaagaatctaaagaagaacaacaaccagatgaacaagtggtagaacttgaaattagtgagattagacctaatccctatcaaccacgtaagacttttaatgaagaggcattagaagaattagcaaaatcgatcaagaaatctggagttttccaaccaattattgtgcgtaaatcttcagttaaaggatatgaaatcattgctggtgaacgtcgctatcgtgcatctaagttagctaaaaagacagagattccagcaataattcgtgaatttaacgaagaacaaatgatggaagtggcagtgttagaaaatcttcaacgagaagacttaacaccactagaagaagcagaagcctataacactttgatggaaaaattgaatttaactcaaactcaagtatcagagcgactaggaaaatctcgtccatatattgctaattatttgagattattaggtttaccaggtaaagtaaaactaatgctacaagatggtagcttatcaatggggcaagctcgtactttattagcagttaaagatgaacaaaaaataatagaattagctgaaaaaactgttaaggaaggcttaactgttagacaattagaacagttagtagcacaaattaatggtaaaaagccaaagaaagctaagaaacaagctaatccatatgaaccttacattaagcaaacagaaaacttacttcaagaaaaatttggaacaaaagttgctgttaaagctaactctaagagtggtaagggaaaaattgaaattgattatttaagtattgatgatttcaatcgaattatggatattttaaaaattaagttagactag

SEQ ID NO: 140 - DNA, 795 bp, Lactobacillus gasseri
  isolated from gut, Lactobacillus gasseri
atgaatgaaccaaattcaattttacaaggttcggtagctcaccgtggctggacgtcggtagttgatccggtaacgaaattattgatggcccttgatctggccttactaagcttttgtttcaccaatttgttagttgaaattgcgcttgtattcgttgcgctagtgattctactgatttcgaaagccggcaagtcggcggttcacgcaattgaattcagctcattcttaatttttacaatgctgattattcagggcctcttttacagtcacaatcagactctgttggtttcagtggtcgggattcgattctatcaagaagggctgttgtatgcagcaacgatggggtgtcgaatttttgtcattattttagcaaccagcttttttatgacaacgactacagtatcagaaaattctaaatatttggagcaggtcggtctctcctataaagcggtctatgtattgatgtcggtttgctatattttaccggaaatgatggccaacatgaaaaaaattcaaatggcgcaacgggcacgtggcattaatcaacagaaaaccattcttgaaaagattaaatcaattttaccagtgctggttccgttagtgatcaaaacgcttgatcaatcaatggaacggtcgatcgccctgcgattacgtggatttaacagtccccatcgggtagcactaaaatcggcaaatctttatcggcacgaaatggttaatcatcgtggcttgagtttattagcaattatattgattgggtggaaattatggataatcggcagcaaattcatttag

SEQ ID NO: 141 - DNA, 1488 bp, Lactobacillus salivarius
  isolated from gut, Lactobacillus salivarius
atggctaatcaacaatcaatgaatgatcagttaagagttcgtcgtcaaaagatgcaagaattgcgcgatgaaggcattgatccattcggtcatagatttgagcgtgatttcttaaacaaagaattacacgacaaatttgaagataagacaaaagaagaattaattgacttagatgttaaggctacaatcgcaggacgtatggtagcaaagcgcggtaaaggtaaggtaggctttgctgatttacaagacaagacaggtaggatgcaactttacattcgtaaagatgaagttggcgaagaaatgtaccatatctttaaacgttcagatttaggagatttcttaggtgtaactggtgatgttatcaagactgatatgggtgagcttacaattaaagtaactaaacttactttcttatccaaggctctaagaccattgccagataaattccacggtcttcaaaacgtagaacaaatttatcgtcaacgttacttagacttaattactaaccgtgaaagttacaatcgttttgtaaaccgtagcaagattgttacagctgttcgtaattatttagatagtaatggatttttagaagttgaaacacctgtattacataatcaagctggtggtgcagctgcacgtccatttattacacatcataatgcattggatattcaactttacttacgaattgctttggaattacacctcaaacgtttgattgttggcggaatggaacgtgtttatgaaattggtagagttttccgtaatgaaggaattgatactaagcacaatccagaatttacaatgcttgaaacttatgcagcatactttgactttaaagacgttatggatgaaacagaaggtatctttaaagcggctgctaaagttgtaacatctgatggaaagattaactatcaaggaacggacgttgattttaataaagaattcaaacgtgttcacatggtagatctaatcaaggaaaagacaggagtagatttctggaaagaaatgtctcttgaagaagctagaaagatagcagatgagcataaagttcattatgaaccatactggcaagtaggtcatattattaatgaattctttgaacaattctgtgaagatacaattgttgatccaactttcgtttatggtcatcctgtagaaatttcaccattagctaagaaaaatactgatgatccacgtttcacagatcgttttgaattattcattttaggaaatgaatatgcaaatgcctttactgaattgaatgatccaattgaccaacgtcaacgctttgaagcacaagttgctgaacgtcaagctggtaatgatgaagctgaaggtatcgatgaagattatattgaagctatggaatacggaatgcctccaacagggggattaggtataggaattgatagattggtaatgcttctaacagatgcaccatcaattcgtgatgtactcctattcccaactttgagaccagaataa

SEQ ID NO: 142 - DNA, 1908 bp, Lactobacillus salivarius
  isolated from gut, Lactobacillus salivarius
gtgagtagtttgcaaactttacgtgtagaaagtttaaccaagacatatggcgaaaaaacgctattcaaggatttaaactttttaataaatgaacatgatagaattggcttaattggaacaaatggttctggaaaaacaacactattgaatgtattaactggaattgattcagcagattctggaaatttaataaaaccaaatgattatcgcataagttacttaaaacaagcacctgaatttccacaaaacagtacaattatggaagctatttttactggagcagctcctgtatttcaaacaattagagattatgaagaagctctaactgaatatggggcacatccagatgataaaaaagctgaacaacgttacattaaagctgaagaaaaaatgaatcaagaagatgcatggacagctgatagtgatgttaagacaattctaactcaattacacatagaggatttaacgcaaaaaatagaagagttatctggtggacaaaggaagcgtgtaggattagctcaagtattgattcaagcgcctgatttgttgatactagatgaaccaactaatcatttggattttgattctattgaatggttagaacaatatcttgctaactataaaggggcattattggtagttacacatgatagatattttttagatcagatagctactgaaataatggaattgtcatttggtagtttatattcatatactggaaactatcaagattttgttagacaaaaagctgaacgagttgaaagagaacttgttcaagaacataaacaacaacaattatataaaaaagaattagcttggatgagaacaggtgctaaagcacgtactactaagcaacaagctagaattaataaatttaatgaattaaaaagcaatttaaataaagtccaagttgacgaaaatgttgatattaatttaggacaacaaagactgggaaagaaagtattagaattaaaagatgcaagtttaacaattggaaatcataaaataattgaagatttcaatttgctaatccaagctggagacagaatcggtattacaggtgttaatggtgctgggaaatctagttttttaaatgctttatcaggtgaattgccattggattcaggcattttgacaatcggtgaaactgtaaagatggcttattatcgacaacagacggaagagattcctgaagataaaagaattattagttatttaaacgaagttggtcaaaacattgtaaataaagatggcgagcgaattagtacaactcagttattggagcaatttctatttccaagatttatgcatggaacattgattcgcaaactctctggcggtgaaaaaagacgcttgtatcttttgaaattattaatgtttcaacctaatgttttattattggatgaaccaactaacgatttagacataggaacattaacagttttggaagattatttagacaattttaatggaactgttattaccgtatcacatgacaggtattttcttgataaggtagctgattcattatatatctttgaaggaaatgcgaaaatcaagcattatgtcggaatgtttacagattatctgaagaatgccgagaatgaagcagttaaaactaaaaaacaatcatctgcaacaaaagtagaaaagacagatagtgcagaaggcaaagttaagaaaaaaactaagttaacttacgctgaaaaaatggaatatgaaaaattagaattggaaatcgacaagcttgaaaataataaagcaagtttagaagaagaaatgcaacatgttgatggagctgattacactaaattagcaagcttacagcaacagattgatgaattagatgaagatattatggaaaaagttcaacgttgggacgaacttagtcagtatgttgattaa

SEQ ID NO: 143 - DNA, 1080 bp, Lactobacillus salivarius
  isolated from gut, Lactobacillus salivarius
atgaaaaaaatagatttaactggaaaaagaattttgataactggcggggctggttttattggtgctaatttgatcttgtctctgctacagacagttaagagtgtaaatattttaacagtcgacaacataaatgattactatgatatttccttaaaagaatggcgccttcaacaaatagagtcagaagctactcaacatgaagaacgtaaatttgagttcattaagggagacatttctgatgttggattagtaaatcaaatctttgctgattttaagcctgatattgtggttaatttagcagctcaagctggagttagaaattcaattactaatccagatgcctacattaagagtaatattattggattttacaatattttagaagcatgtcgccactcttatgataatgaaaatggcgtagagcatttagtattcgcctcatcttcgtcaatttatggtaatggtaaagaaataccatacaagactgatagtaatactgataaaccaatttctttgtatgctgctactaaaaagtctgatgaaatgttagctcatgtatacagtcatctttttggaattccgataacaggattaagattctttacagtttatggaccaggtggaagaccagatatggcatattttaaatttaccaagaaattgataaacgacgaaaaaattcagatttttaactatgggaattgtcgtcgtgatttcacttatattgacgatgtagttgaaggcgttaagcgtgtaatgtctggagttccagaaaagtcagaacaagatttagaaccagcttatcgaatttacaatattgggaatcatcaccctgaaaatttgatggagtttgtaaaaattttacaagacgaattagtaagggcaaatgttttaccaaaagattatgattttgaaggtcatatggaattagttccgatgcaaccaggagatgtggctgttacatacgctgatattagtgaattagagaaagattttaactttaaaccagatactagattaagagtaggtttgagaaaatttgctgaatggtatcgagatttttatgagttagggaagtga

SEQ ID NO: 144 - DNA, 1431 bp, Lactobacillus salivarius
  isolated from gut, Lactobacillus salivarius
atggatggaataatgatggaacaagcttgtacatcaattttagtaggaaagaaagcaactgttgatggttcaacaatgattgcgagaaatgatgacacatttctaccaatcactcctcaacgatttgttatgcaaccagctgtatctggacgtaaagaaacttggacttccaataaaaatggttttactgcaccattaccaagtgaagggtatagaacaacttttactcccaatgctgatgtagaaaaaaatggtgtctttggtgaaacttcaattaacgaaaaaaatgtagcgatgtctgctacagagtctgtatatgggaatccacgtgctttggcatatgatccatggatagaaaatggattggcagaagattcattacaagacatggtggctccatatatagattctgcacgcgatggtgttaagtacttaggaaatcttataaagaaatacggttctccagaaggaaatggtgtcttgtttgcggataaggatgaagtttggtacatggaaattgtaacaggtcatcattgggctgctacaagaattccagatgatgcctatgcaattgctgctaaccaagtagcacaacaaaaaatagattttaatgatcctgaaaactatatgtggtcagatggattattggaattcgtagaagaacatcatttgaatcctaataaagatgacttcaatttccgtaaaatttttggtacggatactgaaaaagatagacattacaatactccacgcgtttggtttggacaacgttacttcaccccagaagtagaacaagaaccgacttcttctgaattgccatttatctgtcgagctaatcgcttattatcagtagaagatttagagtatgtattaagttcacattacaatgaaactaaatatgatccattaggtcatggaagtgaagaagataagaaacgtttccgtccaatctcattgaatcgtacacaaaattcccatgttcttcaaattagaaataatgttcctgaagaacaagcaggattaatgtggatgtgctttggtgttccttcattcacgccatatgttccattttatgcaaatgctaatgacactgatcctagttggagtaatacaccacttgaatttgatatgaatagtgcatattggatgtatagagttttgtcaatgttagtagaatcacaccatgctcaatttattcaagatgatttagattatttaacagctgcacgtgaacaacaacatagattgattgatgaaaatgataaagctgctcaagagttaagtggagaagatttaacaagatttttaacagaaaagaactatgaaatggtagcagacatgaaagaaagaacaatgggaatgataaatcatttctttgtagaaggtttgaagctatctaagttaacatttaatatggacgctaatttataa

SEQ ID NO: 145 - DNA, 1338 bp, Lactobacillus salivarius
  isolated from gut, Lactobacillus salivarius
atgaaaattaggacatggatgttacatctgggtttaattttgactgttgttatcagtattgcttttacctggttaatctggtttaatcctactaccttctttcaaaacgttggacgtacaccagttgatacaagcagtggtgtaacgaatgcttcaaataaaaggctagatgatgtatatactccaacgagcttgatgtataacgagactactactaagaaatatcaatatttcaatcatcgttcagatattactaatcaagctaaaaagattatgaatagagttgaaataacatcattaaaaaccgtagcgaagcagaatgttcctaaatatttagccacagttaatcaaagtcatagtttgattttgaattacccagatgtattgccaataaagtatgtgtgcatcttgtttgataaggcacctaaaaagattgctgaaaataaagaaaatgtcgatcagattattattccgactggcaattcaggaaatacaatttattttctaaatagtaagaagcaaaatatttataaagtaagtgtgaaaaatctgaatgttaaatctttaatggcattgactaaagacaagcatacacagtcagtagcgactgctttggaaaatataggtgatggctatcgttggacatatccgcaaggggtaaaattaaacgaatatagttatctaattaataaagaatctgctggtaatatggtggctaagttgatgggggctaacacttcagcgacaatcacaactaagcaacaagatggtaagacggtttattctgatgacgccaatcagaggatgacagttgataataaacatggtgaagtcgaatatatcaattatgatagtaatgataaaaataagccaaaagtcagctttagtaagactttggagattaatctagccaagcttaattctctaggagttacattagatgatgttagatattcgaattatgagagtaagactggcgaagtaatttatcgtaactatattgcaggatttccaattgtttcagagtataattatgggacttatagcttacaaaatgttacttcaaatggacaaagatttatgttctctttgtatggtttacaagtaccattgccaaatactaataagcaaaagacactaccatcaacgagtgatattttaaatcgtttatcaagcataggttatagttctaatcgtgtaagagctataaaaatcgcatactcttggcaacgtaatgatagttcaagtcaagtcgtggatctggtaccaacttacctaataaaagttgatggcagatggattgattatgaacaactatttcaaaattttggaaagtag

SEQ ID NO: 146 - DNA, 882 bp, Lactobacillus salivarius
  isolated from gut, Lactobacillus salivarius
atggcggattcaaaccaatttaatttatcagaccatgactatgcgacaaaagagttatctaactcattgataagcaaaatagaatatttaaaggttttaaacgatgctattgacgagcaagacgaccgattagtttatcaattaatagacggtcaacgctactccaaagaaattttaaaagcaaaacatagcgtagcagatatagaaaatgaaagtttaattttagatgttcatgataaaataagtgcttttttgagtaaaaagttaattacttatttacgtgaaatgtatcctttcttttattttgaagagataggtgtagggcgttttcaattttattttggaaattggtggggacgacgcttatttggtgaattagatgtattgaatgtcgaattcaaatttaatgctgaagaatacgaaaagttatctcgagcatttgaattagaagtagagaataaaagatataatacagatgaaattaataaaatttctgaagagacagattctttacaagagttaatagacggacaagacagtcgtgatcaacgtaaagatgaaataagaaaagaattgaagagacaatctcaggaaaaagtaagtttctgggagcaatctaaacaaaaggaacaaagacaaaagttaatgtcggagttatcaaaactaactgatttagatgaagcagcaaataatgcgtatcaaaagattcgtgaaaatgaagaaaaagttttgaatttatcgaaagaagatacattattaggctatgaaaagcaaagtattattacaaagtttggtacatttgaaaactttattgaccataataattctctatatcgtgattatattgctgatttaattgcaagaaaagggagagtagattag

SEQ ID NO: 147 - DNA, 1911 bp, Lactobacillus salivarius
  isolated from gut, Lactobacillus salivarius
atgacgattaaatcaagattttggatttcattgatattctcattaccaatgtttttcgaaatgatattaaagccatttggctggatgctgccaggacatacctatacaatgtttattttaacaacaattgtaatggcaatttcagcaagaccattccttcatagtgcatgggcggcttttaaaaatcatcatgctaatatggatacattggtagcaattggaacagctacagcttatgtgtatagtatttatgcgatgtttacaggtcaagatgtattttttgaaagtgcagcttttgttataacattcatcttgttaggtcaagtttttgaagaaaagatgagaaacaatgctaatagttcagttgaaaaattattaaacttacaagttaaagaagctgaagtaatagtagatggtaagtctcaaatggtgccattagatgatataaaagtaggcgacgttattcgtgtgaaacctggtcaaaagatagctgtagatggagaaataatcgaaggaagttcgacagtagatgaatcaatgataacaggtgaaagtatgccagtaacgaaaaaagtgggcgataaagttattggttcaacgttgaataatactggaactttccttttcaaagctgataaagtaggtaaagatacaatgttagctcagattgttgaaatggttaaaaaagctcaaaatagtcatgctccaattcaaaaaacagcggataagattgcaaatatctttgtaccggtagtgttaattattgctattcttacttatttagtatggtatatatttttagggagtagtaatatttcttcattattatttgcagtatcagttgttattattgcatgtccatgtgccttgggaattgcaactccaacggctttaatggtaggaactggacgtagtgcaaagatgggaattcttattaaagacggtgaagtactagaagcaactgataaaattgataccgtagtctttgataaaacaggtacaattactgaaggtaagcccaaagttacagatattatcggtaataaagatgaagtattgcaaattgctgctagcttagagaaaaattctgagcatccgttagccactgcaattatggataaagcagtagaacaacagataaaattatttgaagtaaataattttacagcagttgaaggaaaaggaattacaggtataattgctgagcaacgagtagtagtgggtaacactaagcttattgaggattggaatatatcccaaaaacttcaagcacaaatgaagaacttacaatctgatgcaaagacagttgtagttgtaggtaaaaatgatgaagtcataggtttaattgcaattcaagacattccaaaggcaacttcagctaaggcaattagtgatttgaaaaaacgtgggctaaaaacagttatgttaactggtgataatcaacaagtggcagaagttattgctaatgaagtagggatcgatgaagtgatagcggatgttttaccacaagataaggcacatcatattgaaatgctgcaagatcagggaagaaatgttgcttttgtcggtgatggaattaatgatgcaccagctttaacaacagctaatgttgggattgctatgggagcaggaacagatattgcaattgaatctggtggcattgtcttagtgaaaaatgacctagaagatgtagttaaagctttaatgatgagtgaaaagacttttaatcgcattaagttaaatctattctgggcatttatctataatggcttgggaattccagtggcagcagggatcttttctggcattggtttaactttaagtccggaattagcaggattagcaatggcatttagctctatatccgtaatgataagttctttgatgttgaatagggtaaaaattgcataa

SEQ ID NO: 148 - DNA, 795 bp, Lactobacillus salivarius
  isolated from gut, Lactobacillus salivarius
atggtaaatgaatatccgcaagtaatgacaattgctggttctgattcagatggatctgcaggaatgcaagcagacatgaatacttttttggctcgtaaagtatatggtacttcaattttaacagccgcagttgcggggaattcttatggaatccatgctagtcatgctttaccagttgattttatcaaagcagagtttaaggcaattgcagatgattttaaaattttggcgactaaaaccggcatgttgacagatactaagacgattcattctgtaattgaaagttataaaaaatacgattttggaccactaattgttgatccagttattattaccaagcatggagcgatgttactggcacaagaagcatatgagacagtgcgcgatgaattgattccattggcaactgtgattacacctaacttctatgaagcacaaaagttagtagaatctgagcttcaaaatgaggatgaaatcattgaagcagctaagaagttacaagctatgggtgccaaaaatgtagttattaagggtgaacataatggtgactctgaaattgttaaagattatgttttgctcgaagatggtaagaatttctggttagaagatgagtatatcgatacagaacatatcaatggaactggcgatacttactcagcatgtatagctgcagaacttgccaaaggagcaagcattgaagaagcaattaaaatagctaaaaaatatactcatgatgcaattaaaaatgaaattgcagtaggtcataaattcggaccaatcaatcattgggtatag

SEQ ID NO: 149 - DNA, 3582 bp, Lactobacillus salivarius
  isolated from gut, Lactobacillus salivarius
atgagtttaggatttattttaggtgatgctactaaaaatcatcgtcaagtattgctagaacaaataactaactggcaagcagaagatccacaagccaagatttactacatagttcctaaccataataaatttagtgctgaagtaaaagtattagactatttaaaaagccaacaaactaatcaagacttgtttgcgacaagtaatgtacagactttctcatttacacgtttagcttggtattttatgaaagatacggctacatatcaagttaatagaataaccaatgctggcttgaatatgattgtttatcgtagtttgcaggaacatagtgatgaattgacaatttttaaaggtgaacagacacagcctggctttattgctcaattggtatcacaattgatagaactacaacaatcttgtattacatatgatgatatagaaagaatgaaagaaaacttaagccaacaagatacatctgatagtgcagagttggaagctaaattacatgatatagcgattatctatcgtgattttatgcaaatgacggacagtaagtatttaaaacctgctgatattttgccaagtttgactcagtacttacaaaatgaagatctaagtaatagttattttattatcgaaggattttcacaattcacagctcaagaacaggctataatttcagttttgcttcaacgagctaaagaagtgagaattgatttgattttgaatcgaggagtgactgatattgaagatttaagtgataagcagtcattattttatcgatcagaacgcacttactatttactttatcaacaggctagaaaagcacaggtaaaaattctgaatgatgtttatccacaggaattacgtgtggaaactcctgaattacaatctttggctaaatattggaaagaatccacagatttaaaaccaattagtgttgaaaaaattggtgataatcataatttacaagtcataaaagctgatacaagaatgactgaaataaaggaaatagctacaagaataaagcaaatggtagctttgaaagactatcgttatgcagattttctgttattaacgccggatttgaataagtatcgaaatatcattgaacctatttttaatgactataaggttccaatctttgtagatttagctaagaagatgattgatcatccacttgtggaattgttgacagctttattcaatgtgaaagcacgtcactatcgttatgtggatatgatgaggcttttaaaaactgaattgttaattccaaaaacagaatatggttacttggaaattaaacaatttagacaagatttggatttaactgaaaacttgatcttaaaatttggttttgaaggaagtcaatggctacgtaaagatgattgggtatattatcgctttggaagttctgactttggtactcaaactgatgtccaagagaaaataactaagcaagttaacattattcgtcgttatattaaggaaattttaccaccattcttcaaacaattagatgaagccgaaaatggtaaagaagcggcacaaatcttgatgaactttttgattactaatggtgttccagaacagttgattaattggagaaacaaagcactagaacaaggtgatatggtgatggcagatcgtcctgaacaagtgtggaacctattttgtgcattaatggatgaatatgtagatactttaggagatctatcatttaaggaagaagatttcttgaacttactacaaacaggatttgaaggagctacttatcgccaagttccatcaacacttgatcaagttattatttctgaaacaactgcgacacaaatgaatgatagaaaagtaacatttatctttggtgctacggacttagtaatgccaaatcgcattcaaaatacaatgttactgacagatatggatagagaattagttcaaggaacactagatgatgagaaatatttatctgacactgccgaaggacgaatggcagcagaaccatttatgaactatttagcatttatgacacctagggaaagattgtacttctcttatccagttgctggagtcaatgaagatggattaagaatgtctccatacgtaaatcgcatcatgaaacaatttgatttaccactgtatgaagctaatagtgaaccaacattggaagataaaaaagtcttgaaatttgtggcaaccaagcggacggctttgagcaatttaattggagtagctcgtcaggctaagggtcaaaaacaacctttacctgtaatgtggagatatatctatcagaagttacaagaagatgctacttatcgcagacttacgcgtaaattgatggctgggatcgaatatagtaacattcctgaaagattgaagacagaatacgcagaaaaattatatggtaaaactttgaatacctcagtatctaaatttgaggaattcttcaaaaatcactatgcctttttcttaaagtatgggttgaaattaaaagaacgtgatgtgtttgaattatcaccagctaatacaggtgaattctatcatatggctttagataaactattgaagactcttaaacaagataaagtctcaattgctgatataaataagcctcagtttgactcatatcttcaacaagttctaggtggtatggaacaattgccacaatttcaaattttacaaagttcgaacagaatgcaatttatcttgaagcaacttggagctactgtaagtcagatgggatgggctttacataaccaaggtcaaagaacgaaaatgcgtcctttagaaactgaagtattgtttggacatgtaggaactgaaaatggtttgaaggctttgacttatgatttaggtaatggtcataaggttaatgtccgtggaaagattgaccgaattgatcaaatgattatagacaaccaacgttatttagggattgttgactataaatcaagtagccataaatttaattaccaagatgcctactatggattggctttgcagatgttgacatatttaaatgccatgttacaaaatacagacttattgcttgatttaaatactggagaagagattaaaccagctggagcagtttatatgcacttgcaaaatccagttattaagcaaaaggatattttgaagaatccatatagcgaagtattgttgaaacaaaataaatatgatggtttagtcttagatgatcaagaattattaagtaatttagatacatcaattgaaaaatctggtaattctatcgtatatcctgttagaaaatatgcagatggtcattttggaggggttaagaatagcggtaatgtaattacttttgataatttaatgttacttctaaaacgaaacgaagaattaattcaagaagccgcaaaacttatttttgctggtgatgtagcattaaatccagttctatggccagatagacgctcagcattacaatactcaccatataaggcgattatgcaatttgatgaactcttagggaatcaatattatcgtttaccaaaggaaaatactgcagatattctccaaaaattagcacaagaaaattcagcagaaagtgaggtttaa

SEQ ID NO: 150 - DNA, 2361 bp, Lactobacillus salivarius
  isolated from gut, Lactobacillus salivarius
atgaataaaaaggtattaaaaactttagaatatgataaagttaagcaaaatttatatgcttttactacaacttcaatgggaaagagattgattgataagttggaaccatcatctgattatgatgaaattgctaattcactgtcacagactaaagatggggctgacattctacgaattaagggtggtatacctgttccaaatcttatttccattaagagttttttgaaaagattagatataggtgggactctcaatagtaaagaattagcggctattggacgagttttgagagctacaaatgaagttaatcgtttttttaaagatttagtagataacaaaatcaagttagaagtattatttgataatgtagctaaattggaaagtctaccagaaattagtaaaaaattattagtttcaattgaaaatgatggacatgtaactgacgatgcatctactttgttaaagagtattagacaacaaatttcagtaactgaggaaactatacgtgaacgtttaaattcatatactagaggaaccaattctaaatatttgagcaatgcagtggttacaattcgtaatgaaagatatgttttgccagttaaacaagaatatcgtagtaaatttggcggtattgtacacgatcaaagttcttcaggacaaacattatttgttgaacctgcagtgattgttgaattgaataatcgtttaaggcagcaacaggttgcagaacgtgaagagataaatagaatcttggaagaattgtctgaggagttagcaccttatacacatgaactaaataataatgctaaaattttgggaatgttagactttactaatgctaaggccaagtatgcacatagtattaaggcaacagaaccaattttatcaaaagaaaatgatgtttatctaagacaagtttggcatccattgctagatatgaaaaaagctgtaaaaaatgacatcatgattggtaaggactatcaggcaattgtaataacaggacctaatacaggtggtaagacaatcactttaaaaacattagggttggtacagttgatgggtcaatctggactatatatacctgcttttgaagaaagtagaattggaatatttgacgatatatttgctgatattggtgatgaacaatcaatagaacaaagcttgagtacattttcctcacatatgactaatattgtagaaatattaaaaggtatagatgaacaatcattagtgttatttgatgaattaggtgcaggaacagatcctcaagaaggtgcagctttggctatcagtattttagatgctgtaggtgctaaaggaagttatgtagttgcgacaactcattatccagagcttaaggcttatggttttgaaagacctaatactattaatgcaagtatggaatttgatgctaatacattacagccaacatatcgcttattaattggaattccaggtcgtagtaatgcttttgatatttctcaaagactgggactagataaaatgattgttatggctgctagacaacttacttcacaagatagtcaagatctaaatgagatgatttcagatttagttgctaaaagacatgatgcagaagaaaaagagattatgtatcgaaaatatttgcgtgaagctgaagaactacaccatgatttagaaactaactttcatcaatttgaacgtcaaaaagaaaatatgttagaacaagctagggaaagagctaatcaaattgttgaagaaaccaagaaaaagtctgacgaattgatttctgaacttagaaagatgaaaatgtcagctgcttctaacatagaggaaggtagtctaatagatgctcaaggtcgagttaatgctttacatcaagaaactaatttgaagaagaataaagtgttacgtaaggctaagcaacaacaagaattacatcctaacgatgatgttatggttaattcctatggtcaaagaggtgttctgttgcgtaaagcaggaaaccatgcttgggaagttcaattgggtattttgaagatgaaaatcgatgaaagcgaccttgagaaaattaaggttaaagatactcagcctaaacgagcagggacagtattgaaatcatctagttctagtcatgtttcaccaactttagatttacgtggtgaacgttatgaaaatgcgatggtaaaagttgatagatacattgacgctgccgttttagcaggttataactctgttactattattcatggtaaaggaacaggtgcgttgagaacaggtatcattaactatctcaagcaaaataaagcagtcaagaattttgagtttgcaagtcctaacaatggtggtaatggggcaactgtggtatatttcaagtaa

SEQ ID NO: 151 - DNA, 3600 bp, Lactobacillus salivarius
  isolated from gut, Lactobacillus salivarius
gtgaacaacttggcaggacacttagtaaaatacggtaaacaccgtgtacgtagaagttactcgcgaattaaagaagttcttgatctacctaacttgattgaagttcaaactgattcttacaagtggtttttagatgaaggtcttcgtgaaatgtttgatgacattatgccaattgaagattttcaaggtaaattatcacttgaatttgtagattatcaacttttagaaccaaagtatacagttgaagaagcacgtcaacatgatgctaattattcagcaccattacatgttactttacgcctaatcaaccatgaaactggtgaaattaagtcacaagatgtattctttggcgatttcccattgatgactaagcaaggtacattcattattaacggggcagaacgtgttattgtttcacaattagttcgttctccaggtgtatacttcaactccgaattagataagaatggtcgtactaactatggtacaactgtaattcctaatcgtggggcttggttagaatatgaaacagatgcaaagaatgtagcatatgtacgtattgatcgtactcgtaaaattccattaacagaacttattcgtgctttgggatacggttctgataatgaaatcgtagaaattttaggatctaatagcgatagcttgatgcttactttggaaaaagatgtacataagaacatggacgattctcgtgtagaagaatctttgaaagatatttatgaacgtctacgtccaggtgaaccaaagactgctgattcatcacgtagtttgttaacagctcgtttctttgatccaaagcgctatgatttagcacctgttggtcgttataagattaacaagaagttagatttaaagacacgcttattgaatttgactgttgcagaaacattagctgatcctgatacaggtgaaattattgtaaataaggatgaagttattgataagcaagttatggataaattagccccatacttagcaagagatgacttcaagacatttactttccatccatctgaagaaggtgttgttcaagaaccaatgactcttcaaattgtgaaagtatattcaccaaaggatccagaaaaggtagtaaatgttattggtaatgcaaatgttgatatccaattcaagcacattacaccagctgatatagtagcttccatgaactacttcttcaatttacaagaaggtatgggttcaacagatgatattgaccacttgggtaaccgtcgtactcgctctgtaggtgaattattacaaaaccaatttagaattggtttatcacgtatggaacgtgttgtacgtgaacgtatgtcaattcaagatacatcaactgttacaccacaacaattgattaatattcgtccagttgttgcttcaattaaagaattcttcggaagttctcaattgtcccaattcatggaccaaactaatccattgggtgaattgtctcataagcgtcgtttctctgctttgggacctggtggtttgactcgtgatcgtgctggatacgaagttcgtgacgttcactatacacactatggtcgtatgtgtcctatcgaaactcctgaaggtcctaacatcggtttgatcaacagtttatcttcttatgctcgtattaataagtatggttttgttgaaacaccatatcgtcgtgtatcttgggaaacacataaagttacagacaaaattgactacttaacagccgatgaagaagataattacgttatcgcacaagctaactcaccattaaatgatgatggttcctttgttgatgatgtagttatggctcgtaagaaagatgatgacgttgaaatttcaactgaaaaagttgactacatggacgtttcacctaaacaagtagttgctgttgctacagcatgtattcctttcttggaaaacgatgactctaaccgtgctttgatgggtgctaacatgcaacgtcaggctgttcctttgattaagccacatgcaccattagttggtacaggtattgaatacaaagctgcacatgactctggggtagcattgatttctgaacatgaaggtacagttgaatatgtagatgctcgtgaaattagagttcgccgtgacgatggttctttggacaagtataaattgatgaaattccatcgttctaatggtggtaagaactataaccaaacaccaattgtacgtgttggagacagagtagatgctgatgaagtattagctgacggaccagctatggaaaatggagaattggctttaggtcaaaatccattgattgcatttatgacatgggatggttataacttcgaagatgctatcgcaattaacgaacgtttagttaaagaagatgtttatacatctattcatattgaagaacatgaatctgaagctcgtgatactaaattaggacctgaagaaatcacacgtgaaattcctaatgttggtgaagatgctcttaagaaccttgatgaatttggtattatccgtattggtgctgaagtaaaagatggagatattttagttggtaaagtaactcctaaaggtgtaacagaattatctgcagaagaaagattgttacatgctatcttcggtgaaaaagcacgtgaagttcgtgatacatcattacgtgttcctcacggtgcaggtggtattgttcaagacgttaaaatctttactcgtgaaggtggagatgaattatccccaggtgtaaatatgatggttcgtgtttacattgctcaaaaacgtaagttacaagttggggataagatggctggacgtcacggtaataaaggtactgtttctgttgttattccagaagaagatatgccatttatgcctgatggtactccaatcgatatcatgctttctccaatgggtgtgccttcccgtatgaatatcggacaagttttggatcttcacttaggtatggctgctcgtaaattaggtattcacgtagcttcaccagttttcgatggtgctcgtgatgaagatatttggagtgcattacaagaagctggattacctggcgatggtaagactgttttatatgatggacgtacaggtgaagcattcgataaccgtatagcagttggtgttatgtactaccttaaacttgcacatatggttgacgataagattcatgctcgttcaattggaccttactcattagttacacaacaaccacttggtggtaaggcacaatttggtggacaacgttttggtgaaatggaagtttgggcattagaagcttatggtgctgcttacacattgcaagaaattttgacttacaaatctgacgatgttgttggacgtgttaagacttatgaagctatcgttaagggcgaaccaattccaaaaccaggtgttcctgaatcattccgtgttcttgttaaagaattacaagcattaggtatggatatgaaagttcttgatgctgataagaatgaaattgaattacgtgatatggatgacgaagacgatgatattgttaacgttgatgcattgaagaaattcgcaaaggaacaagaagaaaagaaagctaaagaagcagaacaagaaactgctgaaaaagaagaaactaagacagaatag

SEQ ID NO: 152 - DNA, 270 bp, Lactobacillus salivarius
  isolated from gut, Lactobacillus salivarius
acttcgctacccttccataatggtggcgcgggacggaatcgaaccgccgacacaaggagcttcaatcctttgctctaccgactgagctaccgagccaaaaattatatacttttcagtataacggtcctagccggatttgaaccggcgatctcctgcgtgacaggcaggcgtgataacccctacaccataggaccttttaaatatggaggatacagggttcgaacctgtgaccccctgcttgtaaggcagatgctctcccagctgagctaa

SEQ ID NO: 153 - DNA, 2829 bp, Lactobacillus salivarius
  isolated from gut, Lactobacillus salivarius
gtgctggaaggacttataggttggcttagacagtgctacctaaatgtttataacaaaagaatattatttaatgaagtggttaacgatgacatcgttgcaagtaaggtggtaccgcgtagtaattgcgtccttactagcaacgatgttttattgtttttgggctttaaaacagaaaggaatttgaaaatgaaagaattatcaagtgctcaaatacgtcaaatgtatttagactttttcaagagtaagggacacgatgtaatgaagagtgcaccacttattccacacgatgatccaactttattgtggattaactccggtgtcgctacaatgaaaaaatattttgacggttcagttgttccaaagaaccatcgtatcactagttcacaaaaatctattagaactaacgatattgaaaatgtaggtcatacagctcgtcaccatactttatttgaaatgttaggaaacttttctgttggtgattacttcaagaaagaagctattacatgggcatgggaattactaacaagtcctgaatggttcgatatggataaggaaaaattgtacatcacagtttatcctgaagataaagatgctaagaagtattgggaagaagtaggggtagatcctagccatatttatgaagctgaagataacttctgggatattggtgaaggtccatctggtccggactcagaaatattctttgatcgtggtcaagaaatgaataatttaccagaagatgatcctgaaagttatcctggtggagaaaatgaacgttatttagaaatctggaatattgtattttctgaattcaatcataagccagacggaacatatgaaccattgccacataaaaacattgatacgggtatgggattagaacgtgtagtatctgtattccaacatgcacgaacaaactttgaaacagacttattcttaccaattattgaaaaaactgctgaattaagtgcaggtaagaagtatggtgaaaatgcagaagcagatgtttcctttaaagttattgcagatcatgcacgtgcagttacattcgctattggtgacggtgctttgccttcaaatgaaggtcgaggatatgttattcgtcgtcttatcagacgtgcagttatgcatggtcaaaagcttggaattgatgaagcattcctttataagttggttccagttgttggaaaaatcatggaatctgcatatccagaagtgttagaacaagctgaatttatcgaaaaagttattaagatggaagaagatagattcaacgatactttgaaagatggtatgcaattattagatagcttaattgctgaaactaaagaaaatggtggtaaagaattaccaggaaaacctgtatttaagttatatgacacatatggattcccattagaattgacaaaagaatatgctaatgatgaaggccttgatgttgatgaagaaggtttcaatgaagaaatggaacaacaaaaggcacgtgcaagagcagctcgttcagatgctaagtctatgggtgttcaaaatggcttattaactgatattacaacttcaagtgaatatgtaggttatcatgaattgaaagctaatggtgtattaaaagatatcatcattgacaatgaattagttgatacagttccagctgattctagagcacaagttatctttgataaaacaccattctatgctgaaatgggtggacaagtagctgataagggtgttatcaagaaccaagctggcgaagttgttgctgaagttgaagatgtacaacatgctccaaatggacaaaacatgcatacaatccacgcacttaaggaaatgactagagaaaatacatattctctagaagtagatgttgctttccataataaagtgaagaagaaccatactgcaactcacttattagaccaagcattgagagatgttttaggttcacatactcatcaagcaggatcattagttgaaccaacatatttacgttttgacttcacaaatctaggatctgtaacagcagaagatttgaagaagattgaagatatcgtgaatgctaagatttgggaaaatattcaagttgaaacagttgttacagataaggaatcagctgaaaaaatgggtgctattgccttgtttggcgataagtatggtgatacagttcgtgttgttaaagttggcgattactccatggaattctgtggtggtactcatgttgctaatactaatgaaattggtttattcaagattgtttctgaatcaggtgttggtgctggagtaagacgtattgaagctgttacttcagaagaagcatttgaattcttagaagaaagaaatcaattattacgtcaaagtgctgatgaattgaagatagtacaaattaaagaagttccacgtaagattgaacaattacaagaacaagtcaaattgcttgaacaacaaaaacaagctttagaagataagtttgcaagtcaacaagcaggagatatctttaagaatattaaagatatcaacggcaagactttaattgctggtcaggttaacgtttcaggcatgagtcaattaagacaacttgcagatcaatggaaagaaaagcaactttcagatgtacttgtacttgctactgcaacagcagatggtaaggttaacttaattacagctattagtagcgatgcagttaaggaaggttataaagccggagatttaattaaagcaatcgcacctaaagtaggcggtggcggtggtggccgtcctgacttggcacaagctggtggtaagaaactagaaggcattcaagaagcattgaaagctgctgaagattggttgaataaataa

SEQ ID NO: 154 - DNA, 933 bp, Lactobacillus salivarius
  isolated from gut, Lactobacillus salivarius
atgaagtcttcatctaaagttatgaagggtatcttctggtcagctgtcgcttcagcaacatggggtatttcaggaaccacaatccaatttatctcacagaatcaacatattccgacagattggtttctttcgacacgtacattaggttcaggaaccattcttctaataattagttttattttatatggtaagaaaacatttaatgtattttcaacatggaaaggttttggtcacttgtttgcttatgcaactttagggttaatggcaaacttattgacattctacttagcaatccaaagtggtaatgcttctgcagcaacaatcttacaatacttaagtccactttttatagttctaggtggtatttttattaaacatcaaagacctttatcaacagacttgatagcatttatcatttcactgttgggtgttttactggcaattacaaagggtgatttaacccaaatgtctatcccaatgaattcatttttatggggactaggttcaggtattactgctgctttctatgttgttttacctagaccaattgctcaagataatccaccattggtagtattgggctggggtacattcatcgctggagtgttattcaatttataccatccagtttggataaacacaccacacattacatcaactgtggtcttatctatttccactgttattttagtaggaacaatcattccatttggattacttttatatagttctagatttgctccttctgatgttattagtattatggatgccttacaaccagtaacaacttcaatcttgagtgtgattttcctaggattagaaatgaactgggtagaaatagtaggtattatcttggtaattgttgcaatttatattttgcaacgtggccgtcgaaatatggaaaaaatcaattatcgtgaagatgaattttaa

SEQ ID NO: 155 - DNA, 837 bp, Lactobacillus salivarius
  isolated from gut, Lactobacillus salivarius
ttgataacattaggtctaacaacttggaatgaacatcctgctttgattcacaatgaagatcgtccggttacactttccgaatattctgcttactttccaacagtagaattagatacatttttctatggcattcctagaatttccactgttgaaaattggcaggctcaagttcctgaatcttttcaatttgttgtcaaagctaacaaagttctaaccttacatgaacaaagtgatattcagcacattaatttaacttttcataattttctggagagtttacaacctttaatagacaaaaatcaattaaaaactgtactatttcaatttccgccgtactttactttaaacaagaaaagtactaattatttacgttatttaaggcagaaattgccaaatatttctatttctctggaatttaggcataaaagttggtataacgatactgaaaaattagttaatttttgtcgagaattaagttttactttagttattgctgatgagccatctcgcttggaatcctcagttccttttctcccagttataactaatcccaacctgacatttttcagattacatgggcgtaacatcgaaggttgggaaaaccccggaaaaaattggcgttctaaacgtaccttatatcgttattctgacaatgaattgctagaattcaagcaagttattcaaaagttacaagaagatactaaagaaatttgtataatctttaataacaattctggtaaagacgctgctcctaacgccttaaaattacaagaattcctaaatataacatttgataatttaggaccaaaaccacctgaacaacttaatttcttttaa

SEQ ID NO: 156 - DNA, 741 bp, Lactobacillus salivarius
  isolated from gut, Lactobacillus salivarius
atgacgttaaaggttaagaatttagtaggtggttattcccaaataccagtgttgaaaggaattgattttagtgttaataatggcgaattggtgggcttgattggtctgaatggtgctggaaagtcaacgacaattaatcatattatagggttattacatgctatgaagggttcaattgagatagatggaataactattgatgaagatgcacaagcatacaagagtaagattgcttatattccggaaacgcccattttatatgatgaattaacgttaaaggaacatatagagttgacgatactggcatataatttagataaagatgaagcttggaaaaaggcaaatgagctattggaaatatttaggttacagaataaattggactggtttccggccaacttttcaaagggtatgaagcaaaaggtaatgatcgtgtgtgccttcattactaaggctaagctctttattattgatgagccgtttttgggattggatccattggctacagatgatctattaaagctcatagatgacgttaaaaaggaaggatcggctgtgttaatgtctacgcacgtactaggaacggcccaagagtactgcgatcgatttgtaatgatcaatcatggagaattgaaggcaagtggaacattggaagaattacgagctcaatttaataagcaagacgcttccctttctgagatttatttgagtttgactaaaggggaaaaggccaatgagtaa

SEQ ID NO: 157 - DNA, 1371 bp, Lactobacillus salivarius
  isolated from gut, Lactobacillus salivarius
atggatttacctaaagattttattgagaaatatcaaaatttattaggagatgaagctgaagattttttggctagtttggatgaaaaaagtgtgataggttttcgtttaaatcctttaaaacgtcattataaagatgtagattatgatttaactgctagtgttcctttcgctcaagatggatttattggtaaagtaagtggacgttcacttgaacatcaagcaggctatgtgtatagtcaagatttaagtgcgatgtatgtagcagcggtagctaatgcacaaccgggagacaaagtgttagatttatgtgcagctcccggtggaaaatcaacgcaacttgctgaacaactcaataaccaaggtttattagtaagtaatgaaattaataccaagcgagccaaaattttagcagaaaatatggaacgcataggtgctaagaatgtaattatcactaatgaatctcctgataatctcgcgaaagtatttaaggggtatttcgataaaattgttgttgatgctccttgttctggagagggtatgtttcgtaaagaccatagtgcggttaagtattggcataaagattatccagatgaatgtgctcatcgccagaagttaatcttagaagaagcgatgaaaatgctcaaaacaggtggcgagttggtttattcgacttgtacgtttgctccagaggaagatgaacaaattgtagcttggttattagaaaattatgacttaactttggaaccaattactaagtatgatggtatggacagtggacgtccagaatttgcagatggcaataaagacttggctaaaacaattcgtttgatgccacatcattttgaaggtgaaggtcaatttttagctaagttaaaatttaacggggaagctgcaagtgtaactaaaaagaaaactaagaagaaaaagaaaagtaaaactatttcaactgatgagttggacttatggcacaaatttgtagccgatttttcaagtcaggaattgaactttgctgatcaagatttacgtgttaatggtgattatctttattattacaataaaaattggttagatattaataaattaaaatacgttcgaccaggtttgatgttaggaacttttaagaaaaatcgttttgaacctagttatgccttagccctagcagtacaagaagtggctgaagaaaatgtaattgaattgtctaaaggtaaatgggcagaatacgtatcaggtaacactatatttttgagtggtaacactagaaaaaatggctggtatctattacgttgtgaagaaaagaattttgcgtttggcaaattagttaatggaactataaagaactttttccctaaaggattaagatttcaagcttaa

SEQ ID NO: 158 - DNA, 783 bp, Lactobacillus salivarius
  isolated from gut, Lactobacillus salivarius
atggcaagtgcagtgttagcttcaattggcattactggaatgatgcaaaataagcatatttctaaaactgcgatgactgaacataagagtgttcagaaggctactgtgcaacacaatacatttttttcaaaagtaagtgcagatacaatcaatcaaacagcaattaagggaataagcaatagtagctcaccatttcccaatgttagtgtaaatgatttacaaatttcttctggaatgggttggcgtagcataggtggagttcaataccaccaaggttgggatttaccagctgtacaaggtactccagttttagctactaataacggtgtggttagttatacaggctttcttccagatcaaggtaatgtagttatcgtatatttccaagaatctaatacagctgtatatttccaacatctagcatctatcacagtatctaaaggtcaacaagtaacaagtggccaacaagtgggtactgtcggaggaacaggtgcttctccagattacaatagttatgctcctcatttgcatattggagcttttaagaatgcttcaaactacattaataatgcatacccaatgccatcattaccaacaaattctgaaactgctgcagcaactgattttatttcaccagctgaaatgttcggtgttgatatgaatcagaataattggattgatgaacaaacaaatatgtatggttctaatagtgaacaacccgcatcaatctcagatggcaacaactttgtaacagttggacaagcattacaacaaatacaataa

SEQ ID NO: 159 - DNA, 3537 bp, Lactobacillus salivarius
  isolated from gut, Lactobacillus salivarius
atgaaaataaaatcacttactttaaatggttttaagtcttttgcaaataaaacaattataaattttcaagatggattaactggaattgttggcccaaatggtagtggaaagagtaatattacagaggcgttacgttgggttttaggtgaacagtcagttaaaaatttgcgtggtagtaaaatgccggacattatttttgccggctcagatacacgtgcagctttaaatagagcagaagtgacattagttcttgataatgaagatggatatctatataatcagccaaatgaaataagaattacaagaagaatctttcgttcgggtgatagtgaattcttcataaacgaaaagaaagtcaggttgaaagatgtcgtagatttatttatcgacacagggttaggaagagaatcgttttcgattatatctcaaggaagagtagagtctatttttaatagcaaacctcaagatagacgtattttaattgaagaggttgctggagtcttaaaatataaaaaagaaaagaaaaaagcagaaagtgaacttgttgaaacaactgagcatttaaagagagtagcagatatactgtctgaattaagtaggcagcgtgatcccttagctcaacaggctagtaaggcaaaagattatttgagtcaaaaagaacagtacgatttattaaatagagatagattagtcttagaaattacacaaaaaagttcggaaaaagagcaaaaagaatcggaattacaaaaagttataaaaattttatctgacaaagaaagaatgacttctgaacagagtaaacaggtagaagtattacattctagacaaaagaaattagagagtttaattgacaatgaacaaaatgaattgacggaacttgtaagacaagaggaaaaaatatctggacaacaaaatatgtctagacaagaagaaaaatttcaaaaggaaagattatctgaacttcaagagcaatatagtgctaatctagataatttgactgaaattcgaactggaaaacaatctgttaaagaaaaaatagctaatttggaagatgacagagaaaaactatctaaaaaaatattagagttagaaaaaataatagataatgtaaaagaaccagaagaaattctagagaaactaaaaagtgaattaaatcgaaagatacaagagaagaatttagtcaataatagtaataattatattgagcaagagttagaagaaaaaagtcagaatcaagctgagactaataagaatattcaaaatataacgaatgaaaaaaataaattaaaactacagctagatgaattaaaaactactcttaataataaagataatgagtatcaagaaatagttactactttaaaagaacttaaaattaaggaagtcgaactatctaaaaaggatagtgagttaaaaaataatagaaataaggcatgggatatttatcaacgtgcacagactaaattagagacactaaaaagtatttcagatagttatacaggatattatcaaggagctagagaagtactaaaagaacgtaaaaatatatctggtattatcggatctgtagcagaagaatttgtaattcctaaagaatatgctcaggcgatggaagtagctttaggtggacacttacaagatattattgttacagacgaaaatgtagctaaaaaagttatacagcatctgactcataacagactaggtagggcaacatttttaccacaaaaaacagttaaagctaggatgttgaataagcaatatagggtaactttagaatcattagatggctatattggtattgcaagtgagcttgtcaaagtgtctaaggaaaatttaaaagtgagtcaaaatttattaggaacaacagtaatcgctaaaaatatagattttgctactgaaattgcaaaaaaattaaattatggtgtaagaattgtttcgttaaatggtgatgtagtaaatccaggtggtgctataacaggtggtgctacaaagcaaaagaagtcaggtctgttagaacaaaaattacaagttgaagatttgcaatccgatatcgaagtaatgaagaaaaaattagaagatatggaaatctattggggaaaggttcacgaagagcataaaaaaattcaagataagatcgatactcttcaagttcaaaagaatagattgcaaactgatagagatgaatatcgtagaaaatttgaacttattaagatagaaaatgagcaccaatcgattaaactaaaagagttaaaagaaagtagtaagtatacaaatatagagatactttctcaaaatcttgaagaaaataaagaaaaattacactctttaacaaaagaaatagatagtttagaacagctgattactcaaaaagcgaaagatgaagagcataattcttatagtatagaaaaacaacgtgaagagattagcagttataagcaacgagaggcagttataattgaacaattaagaggattaaaactccagttgcaagaattaatgacacaagaagaaaatatttctgaattactaaagaaacaacaagatgctattgaaaaaataaaaaataaagaaaaaattgctttaagtgctaaagaagatattaaggataaacaagagtatataagaaatacgattgacagtataaagagaaatttaaaaaatgcacaggaagaaagaaagcaattacacatagaagtaaaagaagctgaggaacaattaacaagagctaacgaacttcagcgctcagcctatgaggaacaaaaaaagttaagtatacgtataagtcaatgtgatactattttggataggaatctaaaagatttatcagaaaattatggggtgacttttgaagaagtagagcatcaaatttctgaaaaagacttgaatactattgaaaagaaactcaagttattaaaattaggattagatgaattaggtgtagtaaatataggtgctatttctgaatatgaaagggtcaatgaacgctatgagtttttaaatagtcaacagaatgatttactatcggcaaaagaacagttagaagtaagtatgaatgaaatggacttagaagttaagaatagattccaaaaaacatttgaacaagtgtcgaaggctttcagtgaggtatttccagtaatgttctctggtggatatgcaaaactgagcttaactaatcctgaaaatattttagaaacaggaattgagataatggcacaaccaccgggcaaaaaattacagcaattaagcttactttctggtggagaaagagcattgacggccattatcttattatttgctattttaaaagtgcgacctgtaccatttgtaattttagatgaagcggaagcagccttagatgatacaaatgtagctagatacgcacagtatttacgaaaatttgataatgaaacacaatttatagtgataactcatagaaaaggaacgatggtaaatgcagatgttctttatggggtaactatgcaagaatcaggggtttcacaaatagtatctgtggctcttgatgacattgattaa

SEQ ID NO: 160 - DNA, 891 bp, Lactobacillus salivarius
  isolated from gut, Lactobacillus salivarius
atggagaataaaatgttagataataaaattgaaacgtttatgatggtagcccatctaaagtcatataccaaagcggcagaaagtttgtttataagtcaaccagcagtgtctcaacaaattagacaattggaagaagaatttggagtaaagttatttaactatgaaaagagaaaattatttttaacaactgaaggaaaagaattattgaaatttgcagaatcagtgaaagtgcaaacaaaaaatataaaaataaaaatgaaattatctgataagcaaagtagcccattgaattttgcaaccacgttttcacttagtaataatgatgcgtggaaaattgttgattactatagaaatcagagaagtaaaaaaattgtgtgtcaaacatttaatacccaacaatgtttagaagcacttaataatgggaaaatagattttgcattgattgagggtaattttaagcaagatgactatgataaagtaatcattagaaatgaaccatttattgcagtagggaaaaaggaattgggtatagaagcaaataaagaatatgatttacgtgaattaataaattatccattaatctatcgagaacaaggatcaggttcgttagaaataacaagacagatattgggtatgaggaatttaagtccaatagattttaaacaagaataccaaatagggagtttaagtttatttagaagaatgctattagatggagtagggataggattttgttaccaatgtttattaacagatgagttggatgatggaagtattcagaagataaagataaaaaatatggaagtggctcatcctatctcattagtgtggctaaaagggaatgatcagttaaaagaagaaatacaagtagtgaaggaaatcttaaagtaa

SEQ ID NO: 161 - DNA, 804 bp, Lactobacillus salivarius
  isolated from gut, Lactobacillus salivarius
atggaaaacaggaatttgcaagatgcgaaacgcatagttgtaaaagttggtacaagttccctgatacgtgccaacggaaaaattaatttacaagcgatagatgagttgtgttataccttgagtggactggtgaatgaggacaaagaagtggttctagtatcatcaggtgcagtaggtgtgggactcgcaaatatgggcttggtacaacgacccaagcaaattcctgaacaacaagccctggcagcgattggtcaaagtcaattgatgactatttatcaacaaagatttgcaatgtacagtcaaaagacaagtcaaattttattgacgcatgatgtattaacttatcctgaaagtagagaaaacgtgttgaatacttttaatgaacttttaaaatggaaagttataccagtggttaatgaaaatgacacagttgcggttgatgaaatggatcatcaaacaagttttggagataatgattggttatctgcagtggttgcttctggaattgatgctgatttactaatagttttatctgatattgatggattatttgataaaaatcctaaaaaatatgctgatgctaacttaatttcagaagtgacagaaattaacgaaaaaatcacaggtgctgcaggtggtacaggaagtcgttttggaactggtggaatggcaactaagattaaagcaatggatcgaatgattaatgaaggacgcaaagctgtcttagctaatggtaagagaccttcaatcatttttgagattttaaatggtaagcaaataggaacattattccataagaaatag

SEQ ID NO: 162 - DNA, 2001 bp, Lactobacillus salivarius
  isolated from gut, Lactobacillus salivarius
gtgattgagcgtcaagcagatagaaattttgaattagtttctaagtatagcccaactggagaccagccggaagcaatacaagaattaacagaaggaattaaaaaaggtgaaaaagctcaaattttaatgggagcgacaggtactggtaaaacttttacaatttctaatgtaataaagaatgttaataaaccaactttagttttagcacataataagacgttggcagggcagttatatggagaatttaaagaattctttcctaataatgcagtggaatattttgttagttattatgactattatcaaccagaagcttatgttccttctagcgatacttatattgaaaaagattcaagtatcaatgatgaaatagataaacttcgtcactctgctacaagttcgttattagaaagaaatgatgtaattgttgtggcttctgtttcatcaatctttgggttaggtgatcctcatgaatatagagaacacacaatttcattaagagtcggacaagaaattgagcgtaataaattattaaatgatttaattgatattcaatttgaacgaaatgacatcgactttcaacgtggacgtttcagagttcgtggagatgttgttgaaatctttccagcttcaagagatgagtcagcattacgagtagaattttttggcgatgaaattgatagaattagagaaattgacccattgactggagaaactatcgctgatagagaacacatcgctattttccctgctactcactttatgacaaatgaagaaagattaggaacagcgattgagggaattcaacaagaattagaagaaagaacgactgaattaaagaatgaaggaaaacttttagaggctcaaagactacagcaaagaaccacgtatgatattgaaatgctaaaggaaatgggatattgttctggaattgaaaactattcaagacatatggatggtagaaaaccaggagaagcaccttatactttattagatttcttcccagatgatttcttgattgtagtagatgaatcacatgtaacgatgccccaagttagaggtatgtataatggggatagagctagaaagcaaatgctggtagattatggatttaggttacctagtgctttagataatcgtccattaactagagaagaattcgaaaaacatgtaaatcaaataatttatatgtcagcgacaccaggaccttatgaacaagaaaaaacgtcacatgttgtacaacagatcattcgaccaactggattattagatccagaaattgaagttcgtcctattatgggacaaatggatgacttagttggagaaatcaataaacgggttgaacttaatgaaagaatatttgtaacaacgttaactaagaaaatggctgaagatttaactgattatttcaaagaaatgggaataaaagttaaatacttacactctgatataaagacattagaaagaaccgaaattgttcgagacttaagaatgggaaaattcgatgtattagtaggtattaatcttttgagagaaggaatagatgtgcctgaagtttcattggtagcaattttagatgctgataaagaaggatttttacgaaatgaacgctctttaattcagacgattggacgtgctgctcgtaatgcaagtggtcatgtaattatgtatgctgacgatgtaacaccttctatggaagcagccattaaggaaactaagagacgtcgtagtatccaagaacagtataataaagatcataatattattcctaaaacaattattaaaccaattagagcggctatttctataagttcaaaagttaataaatcagatacaaatattagtgatacagtagattttgctgatatgagtaagaaggaacaattagaaatgatttctaatctagaagaacaaatgcgtgaggctgctaagaagttagattttgaagaagctgcaacattaagagatactgtaatggaattgaaagcacagattagttaa

SEQ ID NO: 163 - DNA, 978 bp, Lactobacillus salivarius
  isolated from gut, Lactobacillus salivarius
atgcataaatataattggggtattatcggaactggttggatcgcacatgaaatggctgacgctttgaatgaagttaatggcgaaattcacgctgtatctaatcctaatgaagaatctctatataaatttgctaaagaaaaaagcgttaagcacacttttataaatcctgatgaaatgatcacagatccagatgtagatattatttatatcgctaccccacatatatctcattatgactatataaagaaagctttgaatgcaggaaaacatgtttttgctgagaaagctattactactagcgctaaacaattagatgaggttattgccttagctaagtctaaaaacttaattttaactgaaggatttactctttatcacatgcctatctacgaaaaagtaagagacctaatatctagcggtaaattaggcgatatcaaactcgttcaagtaaacttcggtagccttaaagactatgatccaaataatcgtttcttcgcaaaagagttagctggtggtgctttacttgatattgggggatatgctactgcctttgctcgtatgttcttaaatgaacaacctgaagtaactctaacaacggttaaattcttcgaaactggagtagatgaacaatctggtatcattttaaagaattctcaagaacaattagctgtcatggctctttcaatgcgcgctaaacaacctaaacgtggtgttatatctggcacaagaggatatgtagaaataaataattatccacgtgcaacagaagccaaagtaacatacactctagatgctcacactgaaaatcacgaaacaataactgcaggcgattctgctaaagctttaaattacgaagttatggatatgcaacgttatatatcacaaggtcatgatgacggtcagctatcactttcacaagatgtagctcatattttaaatcgtgttcgtgataattggggtatgaattatactaaataa

SEQ ID NO: 164 - DNA, 690 bp, Lactobacillus salivarius
  isolated from gut, Lactobacillus salivarius
atgaaaattttaattgttgatgatgataaagatattgttgaattattaagtatatatgttgaaaatgaaggatatgaagtagaaaaagcatataatggtaaagaagctttgtctaagttgaacatgaatcctgacattgcattgatgatcttagatgtgatgatgccacaaatggatggaatggaagtaattcgtgaagtaagaaaagaatcacaaattccagtattaattttatctgctaaaacggatgacttggataaaattcaaggtttagtacaaggtgcggatgattatgttacaaagccatttaatcctttggaagttatggcacgtgtaaaatcattattgcgtagagctgaacataatgttaaaaataatgaaccagatcaaatcgaaattgggccactcattataaagaaagattctcatgaggtaaaaactttagaaggtaaggaaatcaaattaactgcactagaatttggaattttacacttacttgctagtcatcctaatcgagttttctcagctgatgaaatctttgaaagagtttggcaacaagaatctgttgtatcagctaagaccgtaatggttcatgttagtcatttgcgtgataagattgaagatgcaactaatggagaacaagttatccaaactgtttggggtgttggatataagatagagtcacactaa

SEQ ID NO: 165 - DNA, 750 bp, Lactobacillus salivarius
  isolated from gut, Lactobacillus salivarius
atgcaagatacgcaaatgcaagaattaatagattctgtcatgttagctggaaaaattatgattgaaagtggagctgatatggcaagagttgatgatactttaaaacgtatagctagaaatggtggaattaaagagccaaaaatttttgagaccaccaccggaatcatgatgtcagttccagattataaattggcacaggtagaaccaattcaaaaaagaacaattgatttagaaaaagtatcaagagttaatgatatctcacgtgcttttcaattgaaaaaaatcacagttgaagaaatgaaggtaaaattggaatttattgataaaaaagcgccattttttgcttggacatggcaagtattggctgcagcaatgataagttgtactctgatgataatgtacaacggccattggcaagattttatcacaactgcagttattggtggattaggttatgcttgctattactttatcaatacaacatttaaaataaagtttgtaagtgaatttttagcttcattagtaattggtgttttatctgtattagctgttagaaacaacttaggaatatcagtaggtatgataattattgggagtgttatgccgttagtaccaggagtaccaattaccaattctgtaagggatgttttagctggtcatttattaagtggattagctaggggaacagaagcattattatcagctagtgcaattgctttagggattgcgatggttctaagattcatgtaa

SEQ ID NO: 166 - DNA, 993 bp, Lactobacillus salivarius
  isolated from gut, Lactobacillus salivarius
atgaaagatgtagctaaagatgctaatgtatctgtggcaacagtttcgaattatattaatgggaaaaaagttagacctgaagtcgaagaacaagtcagacaatctattgaaaagttgcattatgtaagaaatgcagctgctagggcactgaaaactagtgaatctaaatatgtagtttttgttttacctacagtttggtctccatttttttcagaattaacattttgggtacaacaatatttaaatgatatgggatataaattaatactcagtgtttctgaaaataattattctaaagagaaatcatatgtaaaaatggctgaagagcaaagagtagcagggataatatcaatttcttactctgatttaaatagccatgttccagctaatattccattagtatcaatagaaaaagatgatacaggaatgtttccattagtaacatctaataattatgatggtggtaaaattgcagcatctgaattccataaaagaggagtaactagtgcaatatatgctggtacattacatgaagaattttcaccaatgattgctagaaagtctggatttatagatcagtgtaataatttaggaatacattatagcattctagatgttccatcttctaaaaatactgaagactttcataaatttttaaaccagctatcagagtcagtaaaagataaagaagcagattttggaaagctgggaatatttgcttattctgatgaggttgctattcacataaaagaaaagctagatgaagagaaaataaaagtaccagaacaagttcaaattataggctttgatggtagtaaaatatatcctaatacaaaattaactgtgtcttctattagacaggatgttcaacagatagcaaataaagcaactgaaatacttgataaacaaataaagggaaattcagaaagagaagcatcacgaataatggttcctgtaaattttcaacaaggtttaacaactacatcaatatag

SEQ ID NO: 167 - DNA, 2085 bp, Lactobacillus salivarius
  isolated from gut, Lactobacillus salivarius
atgataattcttacaaaaaggcaaaaagaaattttatcgatattgttacgaatatcaaatgggacaacgattaaacagcttgaagaaagcgtcaatgttagtcgaagaaccatttatcgtgaatttaatgagctaaaactagatttagagcgaagaggactgacaatttctaacattgatgggaaatatgtacttcaagggcaagaaagagatattgaacaattgcgtgaagacattggtgatagtcctagccaacaagaaatgtcagtatctgaaaggcaaagtattttggcggcgatgcttttactagaagatgagccacaaaaaattgttagtctggcaatgtcgctaaaagtaagtgaaggtactgtacaacgagatttaacggaagtagccttggcacttggaaaatatgggataactttaattaagaaaaaaggtgtaggcatttcagttaaaggtactgaatttcaaagacgtcaggtactatgtggtatcttattgagtgagatcaatgattatcgtttctttaagtatattggcgacgatcaagatgttgggggaaacaattacttcttgagattattaccgaagaaaagaattcaattagtaacccaagctctaaacaaaagtgtattaaagaaaataaatatcaaatcagaccaccaatcaatgcagctaatattattaacaaccatttgtttagaaagagctgcttcatctgataatttgggtgaaattaaggctattgatggttcgttgaaatatcaatcattggtttatcaatttatggctgagtattcacaaataaagccgttaaaactagatagaaaagaaattatctatttagctaatcaattccaaagttgtgataatgagagttctccgacattttatgataatgatcaagaactggctttatcattacaaataaagtctttcgttcaaacagtttctgaaaaaatgaaatgggattttcaacgtaatccagcatttttgaaacgtctgacaacgcatattgctggtttggtaagtcatcaggttgaaagattacctaatacgagaattgaaactttaactagattaagcgaaagataccaagatttatttaatgctattaaacaagcgtggaaagttagtttcccagatgaaaagttagcacaatctgaactacaattattgctactgtattttgctaatgaatacactagtcgtcattatcgtggagatttgaaagcgctagtaatttgtgaaaatgggattggtacatcatcgatcttaggacagagattaaagcaagaaattccagaagttaagaaggtaaaaatttctaaaattgcacaacttcaagaccttgatttaagtagttatgatttaattttatctactttaaaattgccaggatttccaagaaaatatcaaattgttagtccattattattggatgatgaaattagtaatatcaaagattatttaaaagattaccaagaaaactacatcagcaaagaagcagaagataataatgtttatttaaataattccaagttacaaccaactaaaagattgaatgggattgcgataggagccttattctgtacggaattggtaaacggaattgaagtaatcagattaaataataaggcgactgaaagtttatcacaggtaattaatgaaattactgggcgcattggacaaggaattgtaaaggataaaaaacaagtagctgcaaatttgaaacgtagaatagatttagctccgattggtattccgaatagtaacatggccttgttacatactagtagcccagaagttaaacgttgttattttaccgtaattgatttagaccaatctctaaagatgaaagctatggatcaaactgaaattgaggtttcaagaatgttattaatgttagggcctgaaagattatcagatattgagcaagatgtaatgggaatggtaagtagcatgattgtgatgagcgatgatactttgaaattatttgcaactggtacgaaggaagagttacaaaatgcgattgctgtaaggttcttacaagaaataaaatcagctataccaattagataa

SEQ ID NO: 168 - DNA, 984 bp, Lactobacillus salivarius
  isolated from gut, Lactobacillus salivarius
atgaaaaaatctgttgaaattttgttgcaagaagctatatcactaaaagcaagcgatatatttttctttccaaaaaatgataggtaccaaattaaggtgaatgttttaggaacgaatcgcataataaaggaatgcagtaaagaatttggaggacagttgattaattatttgaaatttcaatctaatatggcggttagtgaaaaaagacgtccgcaacttggatcatggatatatagcgatgaaaaaaatgaagtcttttgtagactatcaagtgtaggagattttttagggaatgaatccttggttgtaagactgatatttcctagtactttttttgaagaaaattatttttttgaagagcagatttacactttacaaaaagcttgtatcaaaaatggattaattgttttttcagggccaatgggttcaggtaagacaacgactatgtacaatttagctagaaagttagctaatgaaaaacatgttatgagtattgaagatccaattgaaatatatgagcctaattttttacaattacaagttaacaataaagctcagatgtcgtattctgagttactgaaagtagcattaaggcatcatccagatatatttttaattggagaaattagagataatatgacagctaaagtagcaataaatgctgctttgagtggtcatctgattttgacaacagttcatgctcgtaatgtatatggtgtttatcaaaggttgaaaaacttaggtattagcgatgaagaacttcaacaaacgatgcaggtaatctcatatcagagattaattccaacaatagatggaggagctaaagtactgtttgatcaaatagaaggaaaagatttagataaagatatcattcaaggaaatattcaaagtagaatgactaaagactggagagaaaaacttgagtattgttaccttaataactggattaataaagaaagttttgaaacatttattgaaggataa

SEQ ID NO: 169 - DNA, 2037 bp, Lactobacillus salivarius
  isolated from gut, Lactobacillus salivarius
atgttggtgaatttgggtgattcagtcggagttttacgaggtgttggtcctaagaaaatacaggctcttaataaattaggagttaatacgattgaagatttattgacattctatccttttagatataatgatattgcggtcaaaaatttagaagagataaatagtcaagaaaaagttacgctgaaaggaatagtggcatctgaacctgttttagtaagatttggtagaaaaaagagtaggttaaattttaagttattaattaatcatgacgtgattggtgtaacgttttttaatcaaccatggatatcaaaacaggtaactacaggacaaaagctagctgtatatggcaaatatgatgctttgaggcaaagtttatctggcataaagataatctctagaaagactaatgattttgtgggagtatatcgttcgtctaaagatatcaaggaaagtgtagttaagcaattagtaaaacaagcatatgatgaatataattcctatattagagatgttgttcctgaaagcattcgtataaaatatcatttagagaatagaaagcaaatgattcatgatatgcattttccttcgacgaaaaaggaggcagatttggctagaagaagtgcaatatttgatgaattttttagttttgaagctggtcttcaacttttaaaaagggataatcataaaaatatggggttgaggattaagtataataatgaaaaattgaaagagttcattaaaggattgccttttgaattaacgaaagcacaaaaaagagtagtaaatgaaatttgtgcagatatgttaagttcaaatcatatgaatagattgctacaaggtgatgttggatccggtaagactattattgctgcaattgctatgtatgctacagtaactgcaggttttcaagcagtattaatggctccgacggaaatattagctcagcaacacgcagaaaaattagctaatttatttgagcaatatgggataagtgtagctttaatgacaagttcttcattgagcagagtaaaagttaagagagaattattaaagcatttaaaaaatggtgatattgatattgtcattggaacacatgctgttatccaagataatattgaatttcacaatttaggattagctattactgatgaacaacacagatttggtgttaatcagagaagaattttaaggaaaaaaggagttaatcctgaaattttagctatgactgctactcctatccctcgtacattagcaatcactacgtacggggagatggatgtgtctataatagatgaacttccaaaagggagacaacctgttaaaacaagctgggttaagaagaaacaagtaaaaaatgtatttgaatttgttaaaaggcagctcggattaggaacacaagcctatattatttcccctttagtagaagaatctgaattattagatttacaaaatgcagaagaagtttttgagaaggcaaaagaatactttggttctgaaaaagtagcattattacatggaaagatggatgctaatgaaaaagaacaggccatgcaagcttttaaaaataaggaggtttccatccttgtttctacgactgttattgaggtaggggtagatgttcctaatgctactgtaatgatcattttggatgcagatagatttggtctagcccaattacaccaacttcgtggaagggtaggacgtggtagtaaggaatcatattgtattttagtggcagatcctaagagtgagtatggtaaagaacgtatgaaaataatgacggaaactaatgatggattcttaatttcgcaaaaagatttagaattgcgaggtcctggtgaagttctaggaaaaaagcagtcaggtttacctgaatttaaagtgggggatccagtagtaaatttgaatatattacaagttgctcaagaggaagctcataatgttgtttttagtcctaattttgaaacaaaggaagagaattttgaattaatcaagcatttgaatagacagtttacccaagaggaaattattgattag

SEQ ID NO: 170 - DNA, 1281 bp, Lactobacillus salivarius
  isolated from gut, Lactobacillus salivarius
atgaatccaaaatttgaagaacaattccgtcaagaaggatttaccgaacctacgttaattcaaaagtatgtatatcccaaattagctgaaggaaagaatgtagtaggtttagctccaactggttccggtaagactttagcatattcattaccattgctagaaaaaatattacccaaagatggaagtcaattattaatcatggctccttctcaagaattggctgcacagttaacaaatacgataagaccatgggctaaattattagacttaagtgttattggtttgttaggtggtgctaatgtaaaacgacaaattgaaaaactaaagaaacatcctgaagtagttattggaactccaggtagattgttaaatttaataaaactaaagaaactgaagcttcataaaattgaatctattgttattgatgaagcagatgagatgttaggtgatgaagatagcttaaacgatgtacgcgaaatcgttagtcactgtccatctgaagcacaaattagctttttctctgctactgaagcacctattctttctgaattgcatcgttggtttggtgttgatgtagaaaaaatagatgttcgaaaagaagataatacacgtggtgaagtaactaactatatgatagaaaccccaacacgtaaacgaactgaaatgttaagaagattaggacatgttgatgatttttatgctttagttttctttaaacaaacagctactttacgtgatgtagcagaaaagttacttcatatgaaagtaccagtagctattttgtctagtgaacaaagacaagtagatagacaaaaatcattaagacagttacgtaagagagaaataagatttgttttaacaactgatgtagctgctagaggattagatttacctgatttaccagcagttgttaattatgatttacctaaggatactaatacttacattcatcgcgcaggaagaactggtcgtatgggtgcagatggtattgttgttaacttggggaatgaacatgatttgcgtttattcaaacaattaatgtctggaacagattttgtgatagaaaaaggtatattatatgctggaaaattaattccagaatctgaaaaagcattgattgtagtagaagatgaaagacctaataaaaaagcaacaaagaaaaaaattaaagataagaatcctactcgtaaggaagaaaaggctacagaaaagaagaagaaaaagcgcaagcgtaatttgaaaaataagggcaagcgtcatggacgtaaaaaagataagtag

SEQ ID NO: 171 - DNA, 2379 bp, Lactobacillus salivarius
  isolated from gut, Lactobacillus salivarius
atgcaaactaataaaccatttacttataaaatacctgaaaatttgcagggacaactagaaaaaggaatgagggtagtagttccctttggaaagggaaacagattgattcagggatttattataaattttaagtctagtagtgaaaatatagataatataaaagaaattgatagtgtattagatttagaacctgtattgaatgaagaaatgttggaaattgcagattggttgtcaaagtatactttttcattcaaaattaggtgccttcaagtaatgcttccaagtattatgaaagctaaatatgagcgaaagtttacttatattggagagcaagatgaaaaagttaaagagctattttcaggcaaatctgatttattagatagtgataaaaaagtaaattctagtacgataaataaattattacagttaagaaagcaaggaaaaataaaagtagactacattgtaaaaaataaggctaaagcaaagttagtctcagtggttaagacaaaattatctttacaagagtatgagaatgagttaggaagtatttcccctaatgccagcaaacaaaaaaagttactaaatacattaaaagagtttcctgtggggtcaaaaatacggcaaagtgaattgagggaaaaatacaattttactaatgctgatataaaaaatgctagtgaaaaaggatggatagatgtagtaaaagttgaaaaatatcgcgatccatttgctaactataagagttattatgaaaaaaagcataagcttacacaagaacaaagtaaagttgtgaaaaaattagataatgatatcgaaaacgataaagcgcgagtatctttgcttcaaggggtaacaggaagtggaaaaacagaggtatatttacaagtaatagatactgctcttaatcaagggaaaacagctattgtattggttcctgaaatatcgttaacaccgcaaatggtaaaaagatttagagctaggtttggtaccaaagttgcagttttgcatagtgggctttctataggagaaaaatacgatgaatggagaagaatagagagagaagaagcacaggtagttgtaggagcgcgatctgctatttttgctcctttgaaaaatttaggagtcataatagtggatgaggaacatgaatctagttacaagcaagatgaaatgcctagatataatgcaaaagatgttgctaaatggcgtggaatataccactcatgtcctgttattttcgggagtgcaaccccatcactagagtctagagctagggcacaaaagggagtatatgattggttaagattaactaaaagagttaacgatcaaaagctacctaaagtacaaattgttgatatgagagaggcagtaaaaacctctccaattccagatttttctcttaaaatggttaattcaattcaggaaaaactagataaaaaggaacaaatagtgcttctattaaatcgtagagggtattcgacgtttatgatgtgtagagagtgtggttatgtaataaagtgtcctaactgtgatatttctttgacagttcatttagatagcagatctttaaagtgtcattattgtggatatgaagcgagaataccatatggatgtcctagttgtagtagtaaaaaaataagatattatggtactgggacacaaaaaattgaaaaagagctaaaaggtctatttccacaagctcgaattttgagaatggatgtagatacaactagaaaaaaaggagcacatgagaaactattaagaacatttggagatgggaaggctgatattttacttggaacgcaaatgatagctaaaggactagattttccaaatgtaacttttgttggagttttaaatgcagatacatcgcttgggatatcggattttagagcaagtgagagaacttttcaacttttaacacaagttagtggacgtgctggacgtgctgataaagatggagaggttattattcaaacttttaatcctgatcattatgctataaaactagctcagaatcacgattatgaaaattttttctataaagaaatgaaacttagacataatttaaattatccaccgtattactatacattaaagataacagtaagttctaattcagagtcattgacggctagaactatttttaaaataaataatgaagtaaggatgaatgtctctaaaggaactattatattgggtccgactccacagacggttactaaaataaataatcgttattattatcaaattgttattaaatataaaaaagaaacaaaattaattaactatttacaagatttgcttctttcaagtcaaataattgaaagagaaggtatacaaattgtgatagatagagaaccattgaaatttaattaa

SEQ ID NO: 172 - DNA, 1149 bp, Lactobacillus salivarius
  isolated from gut, Lactobacillus salivarius
atggacattttaatggaaaataaaaaattacacattgcattgttatttggaggaaactcatctgaacatgacgtttcaaaacgttctgcacacaatatttatgacgctcttgataaagataagtatgatgtatctgtctttatgtttactaaaaaaggtttcttgcttggtaataaagactctatgcgtatctttgacggagaaaatgaagatgatgttgttgcagaagttatcaaagatgttgatttctccaacccattggcaaatatccaaaatttagccgaagttaaagatgttgatgtattttaccctgttatccacggtaacatgggtgaagacggtacagttcaaggattattccgtttattaaataagccttggattggtagtggtgttgcttcttctggtgtttcattcgacaaggatttaactaagaaattacttactttgaatggaatcagaaatacaaagtatgttttagtaactccagaaaataaagctgactatccatacgctaaagtagctgaagaattaggtgaaacattatttgtaaaacctgctcgtcaaggttcttctgttggtattcataaagtaagaaatgaagaagaatataatgctgctttagaagatggtttcaagtatgattacaagattttagttgaagaagcaatcaagaatccacgtgaagttgaatgttcagtactaggtaatcgtgatatcaaagcatccaagttaggtgcaatccgtattcctgaatcagatgatttttatgactacaacaataaattcgttgatgcatctggtgtggtatttgaaatgcctatcaagttaccagaaaaattaactaaagaaatccaacaaatgtccttagatgcatttagagcattggataaccgtggtttagctcgtatggacttcttagttgatgaaaatgatgttccatactttggtgaagtaaatactttaccaggctttacaaacatttccttatatccacaattatgggaagtttcaggtattagttatagcgaattaattgatcaattgattcaattagctattgatgaatttaacgataacgctaagattcactatgactttacagaattaggaacagaaaaagtgggtaagaagattattggcgaataa

SEQ ID NO: 173 - DNA, 969 bp, Lactobacillus salivarius
  isolated from gut, Lactobacillus salivarius
gtgtcaaaaacacaaaatcatcaaaaagttattttagtcggtgacggtgctgttggatctagctatgcttatgctatggctttacaaggtactgccgaagaatttggtatcgtagacgttgttaaagaacgtacagaaggtgacgctcttgacttattcgatgctacaggtttcacattccctaagaagatctatgcagcagaatactctgactgcaaggatgcagatttagttgttattactgctggtgctcctcaaaaacctggtgaaactcgtttagatcttgtaaacaagaacttgaagattttatcttctatcgtaaaaccagttgttgaatctggtttcgacggtatcttcttggttgcagctaaccctgtagatatcttgacatatgctacatggaaattctctggattccctaaagaaaaagttatcggttccggtacttctttagatacagcacgtttacgtgttgctatgactgaaatgacaggcatcaaggatcctcgttctatgcatgcttacatcatgggtgaacatggtgactctgaatttgctgcatactctgctgctacaatcggtggtcgtccattcttagattgggcaaaagaacatggtgtctccaaagaagatttagataagatggaagatgacgttcgtaacaaagcttacgaaatcatcaacaagaaaggtgctacattctacggtgttgctgctgctcttgcacgtatttctaaagctattttacgtgacgaaaatgctgtattaccagtttctgcatacatggaaggtcaatatggtttaaacgatatctttatcggtactccagccgttgttaacggtactggtttacatgaagttatcgaagtacctttgaatgaagaagaaagcaagaagatgacagaatctgcagctactttgaagaaggttcttacagatggcttaaaggcacttgaagaaaacaagtaa

SEQ ID NO: 174 - DNA, 846 bp, Lactobacillus salivarius
  isolated from gut, Lactobacillus salivarius
atggaaaacaaacagcttctcgtagcagaagatctgtctgctgtaggggatctttctctaacagttgccacccctatacttcaatgtcagaacattcctgtagcggtactgcctacaagtgtcttatcaactcaatctgaaggatttggtactcccgctattttaccaacagagaattggattaaatctactttcgatcattggtcaaaagaacaacttgatttttctgggatattaattggttattttaataatcaagttgttgggcaagaattacttcattttattgaaagtcattcacttgatttagtagttatcgatcctgcatttgctgatgatggtgctttttatcccggtttagatgataatcaccttgctacaataaaggaattgttacaacatgcgactgttaccacacctaatctaaccgaagctaaattcttaacaggattaactgaacttgataactcctatgaaagtttgtccaagttactgttagcaatgaaaaaactaattcatcctggcggaaatgtggtaatcactgatattgttttcgaaaataagcatggctgtgtttatgaacaagatggaaaagtagcgttttgttcatatcctcaattgcctggccatttttatggaagtggcgatattttttcagccttactaacaagctttctatggcatggaaaagatttccatcaagctgtcaaaaagactactaaattaacctttaatgctttaatggaaacagctacatcgcatcgcgaacgtcgctatggaatcaatctatctcgtttattacaactattaattcttgaaaacgaaggtgaaaattatgaaaactaa

SEQ ID NO: 175 - DNA, 1977 bp, Lactobacillus salivarius
  isolated from gut, Lactobacillus salivarius
atggcgatgaattttgatgataatgaagaattagtaaataagcaggttgacatgaatgcttattcgcataacttattaaaagaaaaatatcctacgaaacaagatgtgattactgaaattatgaacttagaagcaattttgcatcttccaaagggaactgaacactttgtaagtgatttgcatggggagtatacagcatttgatcacgttttaagaaatggttctgggagtattaaacagaaaattcaagattacttttcagatagaatgacagaacaaacgatgcaagattttgctttgctaatctactatcctgaagatgaattggctttagtaaagaaaaaattacgtacagaaaatgagctacaacaatggtacttagataacatttcccacttattagaatttttagaattatcaggaagcaagtatacgcgctcaaaggttcgtaaagcactaaatcctaattttgtatatataacagaagaattattatataacgatcctcaagaatttaataaaagaagttatattaatcagcttttgaagaatattttgaaattagatcaagcagataaatttattattgctacctgttacacaattcaaagattagtagtagatcacttacatgttctaggcgatgtttacgataggggagaagaaccagacaaaattatggatagattgatgaattatcattctgtcgatatgcaatggggaaatcatgatttactatggctaggtgcaatggcaggctcaaaactatgtatgttgaatttattgagaatttgtgcaagatataataatttgaatatcatagaagatgcttatggaattaacttacgtcacctttcgagatttgctgaggagcaatatgaggataatcctcaatttagacctaagttgactaatggtgatgggtatagattcaacggcgaaaagctacaaatcacgcaaattcatcaagctgttgcgatgatgcaatttaagcttgaagggcaagttatagctagaagaccagaattggaaatggatgatcgagatttacttaataagatagattacaagaaaaatgtaattagcttaaatggtaaagaatatccgttacaaaatacttgtttcaacacagtagaccctaaaaatcctagtgaattaacagatgaagaaaatgcgattgtagatgaattattaatttccattcaacattctacaaaattaaaacgtcatctagatttcatgatgaataaaggtagtatgtaccgtacatataatggcaatctcttattccatggatgtattcctgcagatgaaaaaggaaatttctgtagcttgaagattggtagtaaagaatattctggcaaaaaattgtttgatttttctgaaaaaatgattcgaaaagcttactctaagccaaatgtaaaagatgattttgccactgattttatgtggtatttatggcaaggggctctttccccactgttcggtaagaaatctatgactacttttgaacgttattttattgcagataaagcttgtcatgaagaagtaaagaatccatattataaattaagggaaaataaggatttctgcatcaaaattttacaagaatttggatttgctggcgatgatactaatcatattatcaatggtcacactccagttaaaaggggacataatgcaatctgcgcagagggttatatgttggtaattgatggaggatactccaaagcctatcagccaacaacagggattgctggatatacattattgtataattcatatggcttgcaactagtttcacatcaaccatttacctcaaaacaagatgctattagaagtgggaaagatatcgtttcaacggttagagtagtaaagcatgaattacaaagaaaatccgttgcggatactgatattggtgaaaatattaaagaaaaaattagagttttgtataatttattgagaaattatgattag

SEQ ID NO: 176 - DNA, 900 bp, Lactobacillus salivarius
  isolated from gut, Lactobacillus salivarius
atgggaattttgcttaatttttgtttggaatctaatatcattactaaaaaagttagcactgatactaacattttcaaaaagtatatcgataacttcaattgggatgaattactttctaaagttataacaacaactattttgttattgttagtttcgttgctattttatatttttcattatattggtaagaaaattatcaaacgagcttttaaaaaaaatcgtttagttgaatcattgtcttctggaagaattaatacagcttacacattatcacaaaatatcttccattattttattttgttcttctatttttatgcggtattatctttgctaggaattccaataggttctttaattgctggtgccggaatcatgggtgttgcaataggtttaggtgctcaaggatttgttactgacgtggttactggattttttattcttttagaacaacaatttacagttggtgatgacgttaagatcgggactatttctggaaaggtagcagcttttggtttaagaacgacacaaattcttgactatgatggtactctccattacatacctaatcgaagcatcacaattgttagcaatctttcgcgtaatgatatgcgagcccaaattgatatccatgtaaagcctaatcaagattttgataaaattaagactgctatacaaaatgtaaacaaatctttaactcccaaatttgatgatattaccaaaaaaccacaaattctaggtgtagttgagactccaaatggccttgtttacagagtaattatttttactaaaaatggtgcccaagctcctgttcaaagggcatttctcgcaaaatatttagaggctttaaaacaagctggtttagagatgcccatttctcctattaatctatcagctaagtaa

SEQ ID NO: 177 - DNA, 819 bp, Lactobacillus salivarius
  isolated from gut, Lactobacillus salivarius
atgattttgatgagtaataataaattaacggtaaaagaaagaaaaaatatgtttagaagatggattttttctgcaggattagggtataactatgaatcccaacaggcaccatctgttgcattttcaatgagaaaggctttaagaaagatttattctaatgatgatgaatatattgatgcaatggataatcattataaatattttaatgtaactccacaaatgggaaatgtaattttaggggcaactttggcgatggaagagaaggatggtattgaagctaaagatgctgttcaatctctaaaaacatcattaatgggtcctctctcaggtgtaggtgattctgtattttggatattaattccaactattatgggatctattgcagggtatatggcacttcaaaaaaatgctgttggagcagttttatggatgttaatgtatatagctttttattggctaaaaatgtggttattcaatttaggatatgagtcaggaacaaaattaattactacgcttggagaaaaaattaatgtatttacagatgcaatttcaatcatgggattgatggtggttggatcattagtaccagcagttgtaaaagtttatacaccattaaaatttgctacgggtaaagtttctttgtccttgcaaaaaggaatatttgataaaatcatgccaggattacttccagtttgtttagcattattagtgtattggcttttagggaagaaatcatggacaccaactagaattattttattaattatcctaatttgtttgattggtgcagcaacggggattttaggtatagctgcataa

SEQ ID NO: 178 - DNA, 1659 bp, Lactobacillus salivarius
  isolated from gut, Lactobacillus salivarius
atgaatgattggaaaaagaaaggtgtagtatatgaaatttatgttcaaagtttcaatgatactaatgatgacggtataggagatatacagggagtaattcaaaaattagattacttaaaagaattaggagtaaatattttatggctaactccaatttttgaatcaccactagttgataatggatacgatatttcaaactatcaaagtataaataatatctacggaacaatggaagatgtggaggagctaataaaaaaatcacatgactataatataaaaattgtgatggatttagtagtaaatcatacttctgatcagcacaagtggtttcaagaatcaaagaaaagtaaagataataaatatagtgaatactacatttggcgtgatcctagacctgatgggtcagcaccaacaaatcatggttccgcatttggaggatcagcatgggagtatgttccagaaagagatcagtactatttacacttatttgctaaagaacaaccagacttaaattgggataataaagaattaagaaatgaaatttataatatgatgtctttttgggcagaaaagggtattgatgggtttagaatggattctattagctttatatctaaacctcaaaaatttacaaatgcaccagtggtagataataaagaatatggcgcatattattatggaatagccaatggaaataatattcacagatatttaaaagaaatgaatgaaagagtattaagtaaatatgatcttataacaattggggaaactcctcatacaaatacggaagaaggatccaaatttttagattcaaatgaattagatatgatctttcaatttgagcatatgcatgtagactatggtaagtatggtagatattctgatgtatcatttaagatgagtgatttaagagaaagtataaaccattggcaagaaaatcttacatggaattctaattatttaggaaatcatgatcaacctagaatagtttcaagatttggaaatgacaaaaagtatagagaaaagtcagcaaaaatgttagcaatgctaacattatttcaacgtgggacaccatttatttatcaaggtgaagagataggtatgactaatgtggattttcagtctatagatgatatgaaagatttagaagcgcacaatacatatgattttttgacaagagtgggtatatcaagcgaaaaagccttagatatggttaacaggaagacaagagacaatagtaggacacctatgcaatggaatgctagcaaaaatgcaggtttcactgatggacaaccatggatacgaataaataataattataaaaatattaatgtggaaaaagatttattaaataaagattctatttacaaattttaccaagaattaatttcattaagaaagagtaacgatattttgataaatggcgattgtaaattgctagatttaacagattctgatattataacctttactagaaataataatggggagaaaatcttggtgatttgttcattttcggataaaagaattaaattcgatattccaaaagagtataaagcaatgaaattattaataagtaactatgacagcgctgactttgaaggggatgtgacaacttacctggagccttatgaagggagagcttatataattggttaa

SEQ ID NO: 179 - DNA, 1011 bp, Lactobacillus salivarius
  isolated from gut, Lactobacillus salivarius
atggtaaagatgaaaaaaattgctgttgacgctatgggtggagattttgcaccacaaagtgtagttgagggtgtagaaaaggcgagaaataaatatccggatctcagatttatgttatttggtgatgaacagaagataagaaaaattctgacaagtgataaaaatattgaaattatccaaactactgaagttattgacatgaatgatgagccagttaaagcaattagaagaaaaaaagattcttccttagttagagcagcatatgctgtaaaagaaggaaaggctgatgcattattttcttgtggaaatacaggagcattattagcagctggcttattaattgtcggtagaataaaaggaattgctcgtccaggattactgtcaactctaccagtattaactaaagaaggtggggcatttaatcttttggatagtggggctaatgctgacaataaaccagaacagttatatcaatatgctttattggggaaatattatgctgaaagtattagaaatatcaaaaatccaagaataggtttgttaaataatgggacggagccacacaagggaagtaaattaacacttgaagcacataatttaatagcagctgatagtagtattaattttgttggtaatgtagaatctaaggatattttgaaaggtgtttgcgatgtagtagtagcagatggctttactggtaatgcagtcttgaaggctatagaaggtacagccggtacagctatgcatctcttaaaagatactataatgtcagctggtctactaggaaaaattggtggtttattattaaaaccaagtattatgaagattcgtaataaaatgagtgcatctcaatatggtggtgcagtattattgggagctaaggccccagttgtaaaggctcatggtgcatcagatgcagaaacagtatattatacagttaaacaaatcaatgatatgctagaaaatgatatgttatcgaaatttacagattattttaacaagaatgtataa

SEQ ID NO: 180 - DNA, 1527 bp, Unknownn
  isolated from gut, unidentified
atggataaagacaaaagaatagaggagcttgaaaaggaaaatcaacaacttcataaaaagattgaagaattgtctgaaactattaagcttctcaatgcccgtatttttggaaaaaaaacggaaaaattagataaaaatcaactttcatttttttcagaggctgaattagaagaattagatatagattctgatatttcatctaaagaaaatgaagaagttgaagtagagcttagagtagtttgccaccgaaaagttaaaccacgtggtcaacgagctgagtttcttgatactttagtacaagtagatgtcgttcatgatcttgaacaaaaaaattgtgctgattgtcatgaaaaactcactctaattggcaaaaaatgtgtttatcgagaggtaggcttgaaacaacctgagcttttttgtcgtaatcattatcagcaaacccataaatgtgaaaattgccacccaaaaggtggcgataaaatagttgccggtaaagtacctactagtcctatttttccacatagttatttttccagtagtgtattggctcaagtagttacttctaaatatttaatggctgtaccattgaatagacaagcaatatattttaaacatattggcttaccaatagatacaaagcatatggcacgtgccatcattaaattgagtgaacagttagaaacggttcacgatgaacttactaagattttattgaaaaatccggttattcatatggacgaaactccttttcaggtgttggaagaaaagaatcgaagtaaatcgtatttttgggtaatgagaacgacagaagaattttcaaatcatcaaatagtggtgtttaattactctagtagccgaaagcaagaaaatatttctaatctggttggagcttacactggagcaattatgtgtgatggttataatgcctatagcagtgaaatgtatccacaaattacatatggtagctgtttggtgcatatacgcagacattttgtggaaatagtcaaatctttaaaacaaggaagaggatcatatgcagtaagagcggtagaattattaaatcgtatttttaaagaagaaaagaagcttgagtatcaaaatgcagaagaaaaagtactgaagcggaagcttcatttgaaaaaatatgttgatgaattctacgattttctggatactatccctaatcctagcagtaaattaaagaaagctgttgaatatgccaaaaaatttcagcctagattagaaaatatatataaaattggcgaactccctctatcaaacaatccgatagaacaagtgattaggctatctaccttagttcgtaagaactcattgtttgcgagaagcgttgatggtgccaaagctagtgcaatattttatagtttagttcaaacagccaagttgaatggcttagatatattcaagtatttcaactacattttctcactattagaaaaacgagaaaatgtcaaggttggagcttatttgccatggaattctaaagttaaagaaatttgtacaaagtaa

SEQ ID NO: 181 - DNA, 954 bp, Lactobacillus salivarius
  isolated from gut, Lactobacillus salivarius
atggaattagaatttttaggaacaggtgctggatcaccttctaagagtaggaatgtatccgcagttgcattaaaattattggatgaaatcaaaaagatttggttgtttgatgtaggcgaaggaacacaacaccaaattttaaacacaacaattcgtccacgtaagattgataaaatatttataactcatatgcatggtgatcatatttttggattacctggctttttgagtagtcgttcatttcaaggcggcgaaaaaatgggaccattaacaatttatggacctaaaggaatttctgattttgttaatattagtttaaaggttagtcaaacaaaattatcgtatgaattaaattttgtagaacttgaagaagaaggtttacttttagaaaataatcgatttaaagtttacgcttataaattagatcatcgtattgaatgttggggctacagaattgaagaaaaggattatccaggtgaattacaagttgaaaaacttagagaagctagagttccatctggaccaatctatagtcgtcttaaagctggagaagtagtaacacttgaagatggtagaactatagatgggaaagactttataggtaaagctaagaaaggtcgaattgtaacggttttaggtgatactagacaaacacctaacttgaaattacttgctaaagatgctgacgtgttagttcatgaaagtacttttggtaagggtgaagggaaattagcacgtaattatcatcactcaacttgtgttcaagcagctactttagctaaagaagtaggtgtaaaacaattactgttaactcatatttcagctcgttatgtaggtaagatggtaaaagttttagaaaaagaagctaagaaagtatttccaaatactaaggttgttaaagattttgatacctttaatattccttttcctgaaagaaaggacgatgagcaatga

SEQ ID NO: 182 - DNA, 2319 bp, Lactobacillus salivarius
  isolated from gut, Lactobacillus salivarius
atggatagtaatgaaaattctagactttctcgtgtggcaaaacgtcgcgaagaagaaagtcgaaataaccctcgcaagcctaataaaaatagtggcttagtcaaaaagattattttaggcgctttaacagcacttttggcactttttgttattggagctacggtatttttcgtttatgctaaaaatgcccctgagctttcagaaaacaaacttacaagtgccggtaattccgttatctacgacgctaatggtgataagataacttcacttggaaatgagaatcgtacttacataaagacggaagacattcctcaacaattgaaggatgctgttgtttccattgaagatagacgtttctataagcatcacggtgttgatcctgttcgtatcgtgtctgctgccctttcaaacgtcactggttcttccgccggtctacaaggtggtagtactttagatcaacagttaatcaagctttctttcttctcaactaagaagtcagatcaaacgctcaagcgtaagtcacaagaagcttggttagcgatgcaattggacaaagaatattccaaggaacaaattttgactttctacgttaacaaagttttcatgggatatggcacttatggtatggaaactgcagccaagtattattatggtaaatcattaaagaatcttgatttagcacaaactgcaatgattgcaggtattcctaacgctccttctacttacaatccatattcgagtcctaaattagctactcaacgtcgtaatgatgttttagatgcaatggtagctaataaaaagatctcacaatctcaagctaatgaagctaagcaagaggatgtaacagatggtcttgtccaaacacatgaacaagaaagcacaacttcacaaaaagcaaaaatttctgactcctatctaaaagaagtaattgctgaagctaaggaaaaaggctatgatccttattctggaaacttaaagatttacaccaatttagatatggatgcacaaaagaaactttataacatcgttaatactgactactatgtagccttccctaacgatactatgcaagttgcgacaacagttgttgatcctaataatggtaaagttattgctcagattggtggacgtaagactggcgatgtaacttatggtttaaaccgtgctgttcaaactgaccgctctagtggttcgacagctaagcctgttatggattacgcaccagcaattgaatatctagattgggctacttaccacgctttgaaggataccaagttctactatcctggaacatcaactcaattatatgactttgataatcgctacaaaggtacaattaccatgcgtcaagctttaattgaatctcgaaacgttcctgcgattagagctctacaagcagttggtatgactaaggctaaatcgttcttgagtaatcttggttatgatactaaaggtttgtccttacaaaatggtattggacttccagcatcaacattacaaaatgcggctgcttatgctgcttttgctaacggtggtacttactatgaaccaacttacattgataagatcgaaactgcagacggtcaagtaaatgactactctagctctggtaaacgtgtaatgcaatcctcaactgcttacatgattactgatatgttgaaacaagttattacttcatccaatggttctggtactgcagctaatatttctggtttatatcaagctggtaaaactggtacaactgcttatccatctgatgtcagtggtcaattcccatctgatgcagcaatggattcttggttcgatggatatactaaacattactccatttctgtctgggtcggatatgatcaccagtatgaacctggtaattatgttccgaataactccaagctagcacaacagatttacaaagtgttgatgacttacctatcccaaggagtttcaaatactgactggactaaaccaagcaatgtttactctagaacaattaatggtcaacgtgaactttacctagctggttcagctgctcctacaatcactggtaaaggaagttcttcaggaatcaatgaatcttcatctagctcttcaagttcttctagtgataaagaatcttccggtagcacttcttctagcgatgaaaagtcttctggtagtgattctagcagtagtgctagcgaaagcagtccttctactgcaagcagtacaccagctaacagtagtgcaacaactactacaggtggtaacaacaatacacaaaacaataacactccagcaacaccagctggaaataatggcggtaaccaagccggacattag

SEQ ID NO: 183 - DNA, 1272 bp, Lactobacillus salivarius
  isolated from gut, Lactobacillus salivarius
atgggactttttgatagaataagaaaagctttttctagtcaagatgatgaagaaaaaataaaacaagaaactgttgataacgatgaagagagtatgaagagcgaagaaaactcatctgattcagatagtaatgtagtttctgaagaaaaaacaagtgaagatgttgaccaaagtgttgattcacaagaaaaaaatagtgatgaatctgaagaagataatgatgaaatcttagatttaaacggagataatagcgaatttgttgaagaagagaattcgaatgattcaagtgaacaaaatgatagcttgaaagttgaagaggaagtctcaagtgatgaagaagagcgttatgataaagggttagaaaaatcacgaaaaggttttggcgcaatgataaattcattgttagctaattttagacatgtagatgaagatttctttgaagaattagaagaaactttaatagaagcagatgtaggctttgaaacagctatgaagattagcgatgaattaagacaagaagttaaattgagaaatgcaaaaaagaaaaatgagatttctgatgcaattattgaaaagcttgttgaaatttacgaaaacgaaggaaaagaggaagataataatttacacttttctagcgagggaccaacagtttttcttttcgtaggtgttaatggtgtgggtaagacaacaactattggtaaactagcccatcgttataaaatggaaggaaaaaaagtaatgctagctgcagcagatactttccgtgctggggcaattgaacagttagctgaatggggacgacgtgtaggtgtaacagttgtaaaaaaagttgaaaagagtgatcctgctgctgtagtatttgatgcagtaaagaaagctaaagaagaagactatgacattttattagttgatactgctggtcgtttacagaataaagttaacttaatgaaagaattagaaaagattgctagagtcataacaagagaaattccagatgcaccacatgaagttttattggctttagatgctacaacaggacaaaatgctttaacacaagcaaagcaatttaaagatgttactaatgttacagggatagttctaactaaattagatggaactgctaaaggtggtattgtacttgcaataagaaatgaattacacttacctgtaaaattagtgggattaggtgaaaaaatggatgatttacgtgatttcagtccagaagaatatgtcgtaggattattcaaagggttagttactccaagtaaatag

SEQ ID NO: 184 - DNA, 2658 bp, Lactobacillus salivarius
  isolated from gut, Lactobacillus salivarius
atggttaacaagacaaacaacaaagaagaagatgctcgtgtatacactgatggtttagtagaaaaagcattaaaagctgaacaagaatattctactttctcacaagaacaagtagataaaattgttgcagctgctgctttggcaggttcagaagctgccttgattttagctcatgaagcagtagatgaaactggacgtggggttgtagaagataaggatacaaagaaccgttttgcaactgaaaatgtctataatgctattaagaatgataaaacagttggtgtaattgaagaagataagattaaaggcgaagtaaaaattgcagctccacttggtgttttagcaggtattgtacctacaacaaacccaacatcaacagcaatgtttaagtcattattagcattgaagactagaaacgcaattgtattcgctttccacccacaagctcaaaagagttcagcacatgctgcaaagatcgtttatgatgcagctgtaaaagctggtgctccaaagaacattattcaatggattgaagaaccaagtctagaaaagacaacagctcttattcaaaatccaaagattgcttctattttggctactggtggtccaggaatggttaatgcagctttgaagtctggtaatccatcaatgggtgtaggtgctggtaatggtgctatctacgttgatcatacagcacaccttgacagagctgttgaagatttacttctatctaagagatttgataacggtatgatttgtgctactgaaaactctgcagttgttgaagctcctatctatgatgaatggctaaagaagatggaagaaaaaggagcatacgttgttcctaagaaagactataagaagattgaagatttcgtattcaatgatagacatggtgtaaatggtccagttgctggtaagccagctcgctggattgctgaacaagctggtgtagaacttccagaaggtaaagatgtaatgttatttgaactttctgctaagaacatcggtgaaaagctatcatctgaaaaactttctccattattgtcagtatataaagcaaaagatcgtgaagatggtattaagaccgttgctgcattattagattatcaaggtgcaggccataatgctgctatccaaattggttctcaatccgatccatttgtaaaagaatttggtgatagaactaaagcagctcgtatcttggtaaatcaacctgattccattggtggtattggtgatatttacacagatggcttacgtgcaagtttgacacttggaacaggatcatgggggaagaattcattgtcacataatttatcaacatcagacctattaaatgttaagacagttgctaagagacgtaacagacctcaatgggttcgtttaccagaaaagatctactacgaaaagaatgctatcagctatctacaagatgaaactgaagatatcaaccgtgcattcatcgtagctgacccaggaatggttaagtttggatttgtagacaaagtttacgatcaattagcagcaagagaaaatgaagttaagacagctctttatggaactgtaagacctgacccaatgttaggacaaacaattgaaattgctcaacaaatggcacaatttgaaccagatacagttattgctatcggtggtggttccgcattggatgctacaaagattgctcgttacatctacgaatactccttagatcaagaaccaggattcttagatagctacgaaaaagttagtgaagtatttaaagaattacaacaaaaattcgttgatatccgtaagagaattgttaagttccatcatgctaagaagacaagaatgtttgcaattccaacaacatctggtacaggttccgaagtaacaccatatgctgttattacagatgacaatacacatgttaagtacccattaacagactacgaattgacaccacaagtatcaatcgtagacccagaatttgttatgactgttcctaagagaactgtagcattgtctggattggatagtttatcacatgcccttgaatcatatgtatcagttatggcatctgacttcacacgtccatggtcaatgcaagctatcaagttagtatttgaaaacttggaagcttcatacaactacgatccaaaacatcctacattggaaggtgaaaaggctcgtgaaaacatgcactatgctgcaacattagctggtatggcatttgctaacgcattcttaggtatcaaccactcaatcgctcataagactggtggggaatttggattaccacatggtttggcaatttccatcgctatgcaacatgtaattaaatttaacggtgcttctggtcgtgtaaagcgtacaccattcccacgttatgaagtatatcgtgctcaaaaagattatgcagatattgctcgtgcattaggcttgaaaggcaactcagatgctgaattagtagatgcattatgcaacaagattaacgatttaatgaagaagttagacgttgaacctaagttatctgcaaatggtgtaactaaagaacaatttgataaagctcttgataagatggttgatcgtgtttacgatgatcaatgcacaactgcaaatcctcgtcaaccatacttggaagaaattcgtcaattgttgatcgatcaattctaa

SEQ ID NO: 185 - DNA, 864 bp, Lactobacillus antri
  isolated from gut, Lactobacillus antri
ttgtttatttatttgtctgctaacgatataattaaactagataaaggaggtatcaagatgaaaattattacttttactgccatcaagggtggtgtcggtaaaacaaccttgactttaaattatggtgattggttagccaaacatggcaagaaggttctattaatcgatttagatcatcagtgtaatttaacaaccgtttttgaaaagactcgacgaaacaatactatcgctgaagcatttaaagaagacgataatgctcaaaaagtaaaaattgacagtgtcggaccaaatctagatttaatcgccggttttatagacctagatgttttgggaagttatctagaaaataacagtaacaaagaaatgatgttattcatgtggtttaaaaacaactccgattcattaaacttaaccgactatgactatatcttaattgatacacacccagattttagtaccatcactaaaaatgctattgctatcagtaattaccttcttagtcccatcacacccagtgagcatggctacaatgctaagtttgacctagaaacacgactcgaaaaattcagaaaatcactttttgattatcgaactggcgaaacttacgtagacgcaaaacttttctttatcgttaatatgattagacataatacaagtatgtctcgcgatttgctaaaacatatagaaggtgatgaaacagtcgcaactataattccagaaagagagctctttaataaagctactgcaaggcacacttcgatatttgaattagccaatcatgataaatccgttttaaagcaaaatcaaaagttcataaaaaaagccgatcatctttttcaagaattagcaagtaaaaccaagtaa

SEQ ID NO: 186 - DNA, 1116 bp, Lactobacillus salivarius
  isolated from gut, Lactobacillus salivarius
gtggatactatagaaaaggaaagattgcttatgaaaaaactcactatcattagttcagtcataataagttcattactcatattgactgggtgtggatctaattctagtaagaagtcaaatgtaacttctaaggttaaagttgttaaacaatcatcaagtaagaaaagtcaaaaaggtgtagctaagaagaaatcaggttctttatggaataacgataaggacagccacctagaagattttatgaaacaatggggagaagtcatgaaccaaacctacacaaagtatgatggaaccaataatattcaaacggcttcaggaatgaattatcctcaagattttaatagtgctacagtaaatggacaaaatgtttcaatggcatgggataaaaaaggaacaggtaaaaatgattacaatgttgtagccatctataactacaataaatcttcaagttctagtataacttatgcatttactttagctgatggtgaacctattgttttagtaaatgagggtagtgggaataactggagtgaaactaagaataaatcacttaaagaaaatttcgtgaatatctttgatggtaaagctactcatgttgaaaagccaaaagtatcatcaagtagtagtacaaaaagttcgagttcgactaaagcaacagaagatttaggcgaaggacgtggaggatacgtaattacgccagaagcaatgagagggacatggtattctaaagatgaaaatggaatgagaaaattagtgatttctgaccatgaaattacatttattagcccagatggggaaacaaaccacgctattttatataaaagaaccaatgatataccttctgatgtcagtgagtctgaacgtcaaagtaaggaagaatggaaaagtgctggtaatataggtactaatggcattagtatgagaggttggtatcaacaacaaggtggaggtgaacatttctctacacatgaagaagaaataaatggacaaaaagtaccacttgttctctacggttttggagccaatgatgctacagatttagtttactatccgagcgaagatttagccaaacaacaaagtgatgttaaatatggggatatagattataaattttaa

SEQ ID NO: 187 - DNA, 642 bp, Lactobacillus salivarius
  isolated from gut, Lactobacillus salivarius
ttgaactttttaattgatttcattctacacatcgatgcacatttagttaatattgttaatagctttggtaatttaacttatttaattgtttttggagttatttttatcgaaacaggtgccgttataatgccatttttacctggtgactctctattatttgctgctagcgctctatcagctagtagtgagtatcatctaaatatttggctttttattatactattttggcttgcttctgttactggcgactcactaaactatttcattggtcataaagttggacgctctgtttcacaacatcacttttttggtaaatttattaaagaagaaaacatgaagaaaactgaagtattttttgaaaaacatggtggcattgctatctcattagcaagatttatgcctattatcagaaccttatctccttttgtttctggtggtacaggagttaaatattctactttcattaaatataatttactaggagcaacagcttgggttctcatttgttgtggtgccggatacttttttggtaatattccggttgttaaagaacatttttccttagttattattggaataattgtagtttctttaattcctgctattgtaggagctctcaaaagtaaactttcaaaaaattaa

SEQ ID NO: 188 - DNA, 1332 bp, Lactobacillus salivarius
  isolated from gut, Lactobacillus salivarius
atgttacctatggagaaagttcttcgtgacccaatccataattacatttacattcaacaccaagttattttagatttaattaatactagagaatttcaacgtttacgtcgtattcgacaattaggagtcgcaaattatgtatttcatggtgctgaacattctcgttttacccattctgtcggtgtctatgagattactcgcaaaatttgcgatttatttcaacgtaactacccttcaaaagaaaaaggagacggtctttggaatgatgatgaaagattagtcgccttatgtgcagcacttttacatgatgttggtcatggtgcttattcacatacttttgaacatatttttcataccaatcatgaaaaaatgacgactgaaattattacttcatctcactctgaagttaatgctgttttacgcaaagtggctcccgattttccagaaaaagttgcgagcgttattgaaaaaagctaccctaatcctcaagttgttcaaatgatttctagtcaaattgatgctgatcgaatggactaccttttaagagattcttatttcactggtacaaattacggaacttttgatctaactagaattttaagagttatgaaaccataccctgatggaattagctttgatatgagtggtatgcacgctgttgaagattatatcgttagtcgttttcaaatgtatcaacaagtgtatttccaccctgtatcacgctcaattgaagttattctgagtcacttattaaaacgtgccaaatatctttataaaaatggtaaaacaaattgtctcggtccaactaatctactctttccgtttttcgaagataattttagtttatcagactacttgaaacttgatgatggtgttttaaattcttacttctctctttggcaagatagcgatgataaaattttgagtgatctggcagaccgattcttaaatcgcaaacctttcaaatctgtaagagtaagcgaagatactcgttacttactccctactcttcgaaaattagtagctgacgccggatttgatagtgaatattatacggctaccaatgatagttttgacttgccttacgacacttattcaccatcacaaaataagcatcgcactcaaatagagcttatgcaaaaagatggcttattagtcgaattatctcaagtaagtaatttagtagccgctatttctggtaaagtttctggcgatgaacgtttcttctttccgaaagaaatgaaatcatctgaacaacaattggaattattcggtccaatatattctgaatttcagagttatctaaaaaatgacacattaatcaaaaagtaa

SEQ ID NO: 189 - DNA, 1479 bp, Lactobacillus salivarius
  isolated from gut, Lactobacillus salivarius
atgaaattcatatatcaacaaatgttagcttttttgtctattataattattttgtctggaacgttagcgatggtcttttttcatttaactaaggaaatgacgtatgaaaatgcctggcaacagatgcaaggctatgcttatactttaagaaaagaagctctcaaattgacgacggataaagctgggaagacaataattgtattgaatgtctcacaattaaaagctacagaaaaactattatcagcacaaaacacacattttactatttatacaagtagaacagatgtgttatatcctgacaattcagtcattcgtgagaatagaagtattagtaaggctgattggaaaaagttgacagcaggtaatgttgttaagagaaaacaggactttagaccaagaaaaagtaagagtgaagtagatgggtcggatgttaaaataacggatatttacgccccttgttttgattatcagggaaatttagtagctgttattaaagtaggtgaagacttatctaatatcacacagaacctacaaattataagacgaaatgtagttttgaccgttgcctttgcaattttagtaggagttattttaagtatcataattgctcatttcttaactaaaaaaatagctcgattgagaaatgctacggacctagttgctgcgggaaattttgatgtgcatttagatactaatggtgacagtgaattggataaattaacattggacttcaattcaatggtacaatcattgcgtgaatcaaatgaagaaataaagcgtcaagaagaacgtagacgccaattttttgctgatgcagcacatgaaatgaggacaccgttaactactattaatgggttacttgaaggcttggcatatgatgctattcctgaagaaagtaaagagaaaagtattgaattaatgcgtaatgaaactaaacgtttgataagattagtaaatgaaaatttagactatgaaaaaattagatcaggacaaattgaactttccaaaactgagtttgatgttgttcaagttttaaataatattattaagcaattaagaaataaagctgaacaagtaggagataaatttgaattgtatacacctgataaattaatggtttatgcagattatgataggttagttcaaattatttttaatattacacaaaatgcgatacaatttacagaaaatggtgtaattagcatctctgctgaaaaaggaaatgaagaaacaattattcgcatctctgataatggaattggtatgaacgaagaacaattaagaaatatttgggaacgatactataaagctgatccttcaagaaaaaataccaagtatggcgaatctggactaggattatctattgttcatcaattaatgcaattacaccaaggaagcgttactgttgaaagtaaggaagggaaggggacaacctttactttacgctttccaaataaaaataagttaagtaaaatttag

SEQ ID NO: 190 - DNA, 759 bp, Lactobacillus salivarius
  isolated from gut, Lactobacillus salivarius
atgcatgaggatatattactatctaatgaacgaattgatcaattgtattcatcaaagataaaaattattcaaagtagcgaagttttttctttttcaatagatgctgttttattggctgactttgcagactcattgaagaaaaagaattctaagatagtggatctatgtgcaggaaatggtgcagtaggtctttttttgagtcagaaagtgaatggaaaaataatccaagtagagattcaaaaaagattagctgatatggctagaagaagtatattactgaataatttagaagataaaatcacaatcttaaatgaggatttaaataatttacaaggtttgatatcaaaagattcggttgatatggtggtatgtaatcctccgtatttcgctaatttggaaacaagtaaaaaaaatcctaatcagtactatgctattgcaagacatgaaattaaggtaactctagaacaagtcatagaagttacaagtggacttttgaaatttggtgggaaggctaattttgtatatagacctgataggctacttgaaatgttagatttaatgagaaaacacaatattgctccaaaaaaaattcaattagtatatccaaaaaaagataaggaagctaatattgtattagttcaaggtataaaagcaggaaaagatggtgggattcgttaccttccacctataattgtgtctgaagataatggaaaatatactaatgttatagaggaacttttatatggtaaaggaaaatag

SEQ ID NO: 191 - DNA, 2853 bp, Lactobacillus salivarius
  isolated from gut, Lactobacillus salivarius
atggataacgaaacattgaaggaagcgatgcttaacggcttgtatgctgatgattattccggacatgaattattaactcctaaaatgttagttaatgctaatgatcaacatatctggacaagtctgaaacaagaattaaaaacatgcaaaagctttatctggtcggtggcctttataactttggatatgttaactcctttgaaagttgttttggcagatttggataaaaaagggataaggggcaagatcgttacaagtacgtatcttaattttaaccaacccaaagtatttactgaattactaaagttaaaaaatgtggatgtctatcttgccgaagaatctggttttcatgcgaagggatatatgtttgaacattcagattattatacgatgattgttggcagtgctaattttactagagccgcgatgttgagtaattatgaatgggcgataaagctaacttcaacggaaaatggcagtctatatcagcagacttactcagagttagagcgaattatagaaaattcccaggtgttgacacaagcttggatagataattataaagaagtttggcaaaatttacgagtaacagaaaagtccactaataacaaagccaaaagtgagatagttcctaataagatgcagatggccgctttaaaagagctagaaaagatagttgaagaaaagaaacataaggctttagttgtatctgctactggaactggtaagacttatttaggagcattcgcagttaaggaataccaacctaaacgctttttatttgtagttcatagggaacaaattgctaaaaaagcgatggaaagttttaagaaggtaatcggtggaagtgacagattgtatggaatgttgagtggtgatagacaagatattcaagcgaagtatattttttctaccattcaaacagtgagccaagacaaaatattagcccaattaccaagtaattatttcgattatattttgattgatgaggcacatcgttcagcagcgccatcttatcaaaaaatcatgcattattttaaaccagatttttggttgggaatgacggcgacacctgaaaggatggataatcaggatgtatatgccttatttgattataatttagcttacgaaattagattgcgtgatgctttagaaaataaaatgctcagtccatttcactatattggggttcaagattatgaagaagatggtattacagtagatgaaacaacaaatctacgctatttaacagcccctaagcgtgtgaaatatattttggatcaattagattattatggttactctggactaaaagttcatggcttggttttctgtagtcgtcaagatgaggcattagaattggctcaggcttttacagatgcaggacatcaagctaaagccctaactaatcaagatggtaatgaacgtagaagagcagtagttagagaattagaggaagggaaaatagaatatattattaccgttaatttgtttaatgaaggtatcgatattccttgtgtcaatcaagttgtgatgttacgaaatacacaatcaagtattgtatttattcaacaattagggcgtggattaagaaaatatccaggaaaagatttcgtaacagtactagattttattggtaattataaaaataattatttgattccaattgctttaactcaagataatagtcgcagtattgacgaagctaaagcggagttaagggtcccaccagtaattgatgtttcaacgattaattttacggaaattgctcaagaaaagattttgcaatcattggataaagtgaagttagattcaatgaaggaattgagaacggcttatcaagatttgaaaaataaacttggtaaagtgcctttgctacaagatttttatagatttgggtcagtttctccaattgtttttgctagtaacggaaatcttgataactatgatattttcttgcaaaaaatgggagaagattctgagttgaatttgtatcaaggacaagttttaacttttataaccaaagaattattgaatggaatgagacctcacgaactcatattattagatctattgactaaaaataaagtatgcagtttatctgattatgagcaagaattacaagaaaaacaaatttacttcaatatggaattaatgaattctgttgaaaatattttgaacttatctttctttgatgtgaaggctggaaagacaactaaagctgaacagtatggtggaattcctatcgtagaaaaggtcaatttgttagattatcaacttaatgatcaaattaaaacaagtttgaataatcctaaattctatcagttatggcaagatgttattcaaacaggattattattgaatgaagaataccaaaataaaaagcagtttacattctatcaaaaatacactcgtaaagatgtatgccgcttattaaattgggaaaaagacgtcagtgcaccaatgtatgggtatcgtgtaggtgaaaaagaatgtccaatttttataacttataagaaagattctgaagataagcgaaatgccaaatatcgtaatgatttacaaaatggcaaaagattgagatggtataccagatctcctcggcatatagattcagatgaggttcaacgacttttagcaaaagatgaaatgggaaattataaaataaaactacatctttttgtaaaacgtagcgatgccgatggaaaaggtttctattatttgggagaaggtaagattgtatcagatagtgttcgtgaagaaatcgttgggaaaaagacagcagtaggaatgaacatagagttacaacacccattagaaactaaaatgtatgatttgttatttgctgaataa

SEQ ID NO: 192 - DNA, 585 bp, Lactobacillus salivarius
  isolated from gut, Lactobacillus salivarius
atgtcagtaactaaagaaaacttagaaaaatggttagaaatatttggtgatttaattgaaactaacaaggcatatcttagtgatttagatacaccaattggagatggagatcatggtaataacatggctcgtggtatggctgcagttaaagaaactttagcaagtaagcaaccagaagatattgttggagtatttaaggttacagcgatgtccttgattagtaaagttggtggtgcttctggtcctttatatggaactgcatttttagaaatggccaaagctagtgctaagacagatgatttagcagaattaatgaaattagctttagctggaattaagaaacgtggtggagccgaagctggagataagacaatggtggatgtttggacggtattagtaccaaaattgaaagataatagtctaactcaagcagatattgatgcagcagttgaatctacaaaggatatggttgccaagaaaggtcgtgcttcttacttaggtgaacgttcagttggacatttagacccaggtgctgtatcaagtggttacctatttacagcccttttagaagcgggggttatgtaa

SEQ ID NO: 193 - DNA, 1509 bp, Lactobacillus salivarius
  isolated from gut, Lactobacillus salivarius
gtgtgtgctcttttattatctagacctctgagaataaaaagtttggaggaagacgtaatgtctgaaaatagtaatcaaggagaaataaaaagatccttgaaaactcgtcatgtttctatgattgcccttggtggtagtatcggaacaggtttgtttgttgcaagtggttctgcgatttctacagcaggacctggtggagctttggttgcttatatagcaatcggattgatggtttacttcttaatgacttctttaggtgaaatggcaacatatttgccagtcacaggttcatttgcaacatatgcaggaagatttgttgatcctgctttaggatttgcgatgggatggaattactggtttaactgggctattactgttgcggttgacgtttctacaagtgcaatagtgttacgttattggttccctaatattcctagttgggttttcagtttgattgtattattagtaatttttgctattaatgccttgtctgtaaaatcttttggtgagacagaatattggttagctttgataaaggttataacagttattgtctttttgattgtaggtttattaacaattattggaattattgggggtcatgcaacatatttagaaaacttcacttataaaaaggctccttttgttggtggtataccggcagtcttaagtgtattcgtagttgctggattttctttccaaggaacagaattgataggtattacagctggtgaatctgcaactccagaaaaaagtattcctaaggctatcaagcaagtattttggagaatcttattattctatattctagctatttttgttatagcttgtttgattccttacacaagtcctaatttattgggatcagaagctactgatattgctattagtccatttactttagtctttaaacgtgcaggattggcttctgctgcagctgtgatgaatgctgttattttaacctcagttatttcagcagcaaattcaggaatgtatgcttccacaagaatgctattttctttgagtttaactaaagatgcacctagagtattctcactcgttaataatcgtgggataccaatgccagctttattaggaactacatttgttgcgttactaacatttttatcaagtatttttggtgataagatttacacattcttggtaagtgctagtggtttaacaggttttatagcatgggtaggtatagccatttctcactatcgtttccgtagggcatttaaaaaacaaggtcatgaacttagcgaattacgttaccatgctaagtggttcccattcggtccacttttagcattagtattatgtatcttagtaattgtaggccaagatttgaaatcatttgctaatcttgattggcaagctataagtgttacttacatgtctgtaccgttattcttgattttatactgttactataagataaaatataaaactaaagtaataccactggatgaagttgatttaacacctcataaagtagaaaaataa

SEQ ID NO: 194 - DNA, 1146 bp, Lactobacillus salivarius
  isolated from gut, Lactobacillus salivarius
atgactttacaagaaaatgaattaataaaaatccgaagagatcttcatcaaataccagaaatcggtttggaggaatatgaaacttctgattatttgttaaaaataattaacggcttaccacaagagaatttagagataaaaagatggaagacagctatcttggttcatcttaatggtgaaaataagaattataccataggttatagaactgatattgatggattaccagttgaggaaaaaacaggtttgccattttcatcaaagcatgaggggagaatgcatgcatgtggacacgatattcatatgacggttgctttaggtgtattaagttattttgctagtcatcgtcctaaatataatatgacatttattttccaacctgcggaagaaaatgcaagcggtggaatgaaactttatcaaagtggtgaattagacgaatggatgccagatgaaatctatgcattacatgataatccacaacttcctgctggtacaattggttgtcgtaaaggtactttgtttgcaggtacatgtgaaatacatgtgaaatttattggtaaaagtgggcatgctgcatatccacatcaagctaatgatatggtagttgcaggagctcaattcgttaaccaaattcaaactattgtaagtagaaatgtcgatccgattcaatcaggtgtagttactttaggtcatttttctgcaggaacaacaggaaatgtaatttctggtgtttgtcaaatagatgggacaatcagagctttaactcaagaaaataatttgcttattcaaaagcgtgtacgtacaattgctgaaggaatagcacatagtttcgattgtgaattggaaatcgatttacatcaaggtggatattatcctgttgaaaatgatgataacacaacagaagctttcattaattatatgaaaaatgaagatgatgtagattttgttgaaacattacctgcgatgacgggagaagactttggctatttaatttcaaaaattccaggaacaatgttttggttaggagtagatagtccttattctctacattctgaatatttagcacctaaagaagaatcgattatgttaggtgtaaatgcaattacaggttatcttaaaaatagacaagaaagcttaaataaatag

SEQ ID NO: 195 - DNA, 807 bp, Lactobacillus salivarius
  isolated from gut, Lactobacillus salivarius
atgaaaaaaataaaagtttgtattttttctacttgtctagttgatttactttttcctaaagtagggatggcgatggtagaagttttagaacgtttgggttgtgaaactgtattacctgaaaaacaaatttgttgtggacaaccaacatataatagtggctattctaaagatagtatgaaaacgtttaaaaatgaaattgatgcattactaagtattgatgctgattacattgttggtccttcgggttcttgtgtttttatgattaaagaatataaggatatttttaaagatgatcctgagtatggtcctaaagccgcagaaatagatagcaaaatttatgaatttacacaatttatttaccgagttttaaaagtcgtagattgtggtgcggaattagatgctaaagtaactgtccatcgttcatgccatatgacgcgtttgataggcgaaagaacagctccatttgtattattggatcatgtaaaagatattgaaagagttcctttaaagaatgtacagttatgttgtggatttggtggtactttctcagctaaaaggccagaactttcagtagaaatggttgatgaaaaagttaagaatattgttgatacagatgctgagatcctaattggaacagaagaatcttgcttgatgaatattgtaggtagaatgaatcgtttaggatataagataaaagcgatgcatattgctgaagtattaaaccataatgttgatataaatagaattaaatatattaaggatacagatcatgttgttataccagctaatggagaaggggtgttttaa

SEQ ID NO: 196 - DNA, 1854 bp, Lactobacillus salivarius
  isolated from gut, Lactobacillus salivarius
atgagaagattaaaaagaagccgatacattacgggatttgacggtattcgaacgctggcagttattgcagttattttctatcatttgtttccttacgcaatgcaaggcggcttgatgggagtttctatattcttcgttatttctggatatttaataactgatttgttgttacaagaatgggaacaaaatcgaaaaattgatgtcaaagctttttatattaggcgtatgaaaaggttgtatccaggattgataacaatgttagttggaacgatagcgtatataactttgtttcaaaaagagttattggctcatattcgaatggtttttctgacaaatttgacctcaatatataattggtatcaaattcatacaggtcaatcatattttgataaatttgcgattcagtctccttttacacatttatggtcgttatctattgaaggacaattctatttgttttggcctttattgattatattaatgtgtaaatacttacctaagaaaagtgttagattctttctgttaataggattgagtttactatcagctttagaaatgatgcttttatttaaggtaggtagtgatccttcacgtgtttactacggaacagatacacgtgtattttcgatattaataggtgcagctttagcaattgtttggccaagtagcaagttaagtcaaaaacttcctgatgtgagtcgacgaattcttaacataacaggtattgtgtgtgctttattagtaatattatcattctttaaaatgaatggtgaaaaagcttttgtatatcatggtgggatgtacttattttcaataatctctgcaatacttgtcgcaacagtagcacatccgggagccaatatgaatatctggtttactaatccagtttttacatggataggtaggcgtagctatggaatttatatttatcagtatccagtgatggttttctttgagtcaaaagttaagaatattgctgcacatccttggttgtatggattaatagaaatagcaataatacttgctataagtgaattatcttatagatatattgagatacctttgaaaaactttgattacagtcaaactctaatcaaagttaaacaagtctttaaacgagataaatcacatttaaattctaaaattggtgtagctgtgggagcaattatatttttgattgctggtgctggtttagtgcaacagccaactaagaaaccacaggataatgctttggcaaaacaaattaaagaaaacaatgccaaagttaaaaaaagaaattctgaattaaagagtggcaaaaagcaatcaactgaacaagtttcttcatcttctagttctgaagtgaagaagtatcagttaaccgctgctcaagctgataaagcaagaaatatgaagattacagcagtaggagattctgtattagctgatggagctagttcattacaagaaattttccctaacatgtatatcgatgctaaagttggtaggcagtcagctgaagcagcaaagatagtacaacaattagcgcaaactggaaaattggaacaaacagtgttgataagtgaaggcacaaatggtgcttttatgggacatgaaattcaagatattatgaatgctgctggtaaagatcgccaagtatattggattaatgttcatgtaccaacaagacgttggcaagatcaagtgaatcaagatttggcatcagctagcaaaaagtataagaatttacatataattgattggtttagctatagccaaaatcatgctaattggttctataatgataatgttcatcctaatccacatggcttggaatattatggcagttttgttgctaaaaaaatagttaaataa

SEQ ID NO: 197 - DNA, 1761 bp, Lactobacillus salivarius
  isolated from gut, Lactobacillus salivarius
atgaaaaagaccaagatcgtaagtacccttggaccagctagttctgacctagatacaattgttaagttaatcgaagcaggtgcaaatgttttccgttttaatttctcacacggtgatcatgaagaacacttaggccgcatgaatttagttcatgaagctgaaaaaattactggtaaaacagtaggtttcttattagatacaaagggtgcagaaatccgtacaactgttcaaaaagaaggcaagattcattttgcaatcggtgatgaagtacgtatttctatggacgattctattgaaggtacaaaagaaaaaatcgctgtaacataccctggtttatacgatgacgttcacgaaggtggacatgtattgtttgacgacggtttgattgatatgcaaatcgaaaagaaagacgatgcaaacaaagaacttgtatgtaaagtattaaacgaaggtacacttggttctcgtaaaggtgttaatgctcctggtgtttctatcaacttacctggtattacagaaaaagactctgatgatatccgctttggtttagaccaagacattaactacattgctgcttccttcgtacgtaagccacaagatatcttggatatccgtgaattacttgaagaaaagcacatggaacatgtacaaatcttccctaagattgaatctcaagaaggtatcaacaactttgatgaaatcttgaaagtttctgatggtttaatgattgctcgtggtgacatgggtgttgaaatcccagctgaaaatgttccattggtacaaaaatcattgatcaagaagtgtaacttagctggtaagccagttatcacagctacacaaatgcttgattctatgcaagaaaacccacgtcctacacgtgctgaagcttctgacgttgctaacgctgtatttgatggtacagatgcaacaatgctttctggtgaatctgcaaatggtgactaccctgtagaatctgttgctacaatggcacgtatcgacatcaagtctgaaaatgcattacgtcaacacaaagcattgacattagatgcatttgataagacagatgttacagaagcaattggtcgttcagttgctgaaacagcagaaaacttgaacattaagacaattgttgctgctacaaaatctggtcatacagcacgtatgatttctaagtaccgtccaaatgctgacattttagctgttacatttgatgaccgtacacgtcgtggtttaacagttaactggggtgtacaacctgtattggctgatgctccttcatcaactgatgaaatgttccaattagctacagaagaagctaagaaggctggtttagctaaggaaggcgacttgatcttaatcgttgctggtgttcctgtaggtgaaaaaggtactacaaacatcatgaagatccaattaattggttctaaattagtttcaggtcaaggtgttggtgatgaaactgttataggtaagacagttgttgcaacatctgctgatgaagcaaataagaacgctgttgaaggtggaattcttgtaacaaagacaactgacaaagattacttaccagctattgaaaaatcatctgctttaatcgttgaaaacggtggtttaacatctcatgcagctgtagtaggtatctctatgggtattcctgtagttgttggtgctaaggatgcaacatcattgatcaagagcggtgaagttgtaacagttgatagccgtcgtggtattgtataccatggtgcatcaaacgctctttaa

SEQ ID NO: 198 - DNA, 411 bp, Lactobacillus salivarius
  isolated from gut, Lactobacillus salivarius
atgataagagatataaatcacgatgttaaaattctttctaaaaaaagtacgcctgcttcaaaaaatgatatagctatcgttcaagatttagttgatactttaacctatcatcgtgatcattgtgttggcatggccgctaacatgattggtaaaaataaatgtattattgcgtgtcaattcggtcctttaattgttgctatgattaatccagtaataactaaaaaatctcaaaaatattctacttctgagggttgtctttctttaactggtgagcgtgaaaccacccgttttaataagattgaagttagctacttaaaccaatcttttcaaaaagttcatgctacttttgaaggctttaatgcacagattatccaacacgaaatagatcactgtaacggtatcttaatttag

SEQ ID NO: 199 - DNA, 978 bp, Lactobacillus salivarius
  isolated from gut, Lactobacillus salivarius
atggctaaaacaacaatgattaaagctattacagcggcaatggatgaagaattaaagcgtgatgacaaggtcttagtatttggggaagacgttggtaaaaacggtggtgttttccgtgcaactgatggacttcaagaaatttacggagaagatagagtgtttgatacaccacttgctgaatctggtattggtggtttagcagcaggtttagccttcactggttttcgtccagttcctgaaattcaattctttggttttgtttttgaagtaatggattcaattgcaggacaaatctcccgtgaacgttatcgtatgggagcaactcgtaagatgcctgttacatttagagctccatttggtggtggggttcatacacctgaacttcactctgatagtttagaaggtttgatggctcaaacaccaggtttacgtgtagttattccatctggtccatatgatgctaagggattattaatttcagctattcgttctgatgatccagttgtattcctagaacatatgaaattatatcgttcagttaaagaagaagttccagatgaagcatacatcgtaccattggacaaagcagcagttaagcgtgaaggtagcgatgtaagcatcataacatatggctacatggttcaagaaagtttgaaagcagctgaagatttagctaaagaaggaattaacgctgaagttgttgatttacgtacagtatctccacttgatgaagaaacaattttagcttctgttaagaagacaggtcgtgttgtacttgttcaagaagcacaagcacaagcaggaatttctccagcggtagcttcattaattgcagaaaaaggtattctttcattagaagcaccaattggtcgtgtgagtgctcctgacacaccatatccatttagtgaagctgaaagtacatggttaccgaataagaaagatatcgtagagaaagttaaagaagttgtgaacttctaa

SEQ ID NO: 200 - DNA, 978 bp, Lactobacillus salivarius
  isolated from gut, Lactobacillus salivarius
atgtgtacaagtgttagtgttatttctgaagatggaacacatgttatgggaagaacaatggattggtatgatctttatgtgaaacctatgtatgttcccaggggatatcagtggaaatcagcatttgataataaaaaatatataaacaaatacgctatagttggtggaggttttcaagataataattatattgatttaagtgatggaattaatgaatgtgggttgatggcccaaaaattgacattttctaatggagcacaattggttgatgataagcatgatgataaaatccaacttgaagcatatgaatttgttacttatatacttggaaatttttcttcagtaactgaagtagaagaaaatatagagaaaattgaactaatgagtaatgtaattaataatacaaaacatggtggatcagagttacattttagtctttcagatgagagtggacgaaatattgtagttgaacctagtcagcacccaatgagaataattgataatcctttaggggtagtaactaatatgcctaaatttgagcgtcagttggcaaaattagaaaattatatggaatttactgatgaatttaaagaaaattcgattaaatatggaaaatttcatgtaactactggaaaactgggtggcaagaagacaccaccaggatcttactctccaagccaaagatttattcgtgcatcttatttaaaggaacttgttgatatgcctaaaacacgcgatgaagccgtatcgttagcatttggtatattagatacagtttcaattcctaagagtaaagcacatagaccgacgtatacagtttatagagcagttgcggtatcagaggataggacttattattatcaagcaaatgggcaagctacggttagtggaattaaattagatgaagagctagtacaaaatacagaaccgatagtatttaatgtatcgaatatatggaatccacaaatgttaagttaa

SEQ ID NO: 201 - DNA, 1008 bp, Lactobacillus salivarius
  isolated from gut, Lactobacillus salivarius
atgtataattacactgtttgtactactatagaggtatataaaattcgaagggagaagagtgatttgcatatatttcatgatgctaagggttctggtcatgcaaaaattattttaattggtgaacatgctgtcgtatatggtcatccagcaatcgctctgccattaaaaaccgtaaccgcaactgcaagtattaaagttataccatcatcaagtgaacaaattattacaagttcttactatgatggttcagttgatgatatgcctaaaaatatgctcggtattaagaaattaattttaaaattagtttctgatttacgtatagaaaatggatttgagttacatttatccagtcaattacccgcagaaagaggtatggggtcttcagctgccgttgcgatttctattattcgttgtttttacaacgctaccgatactagaattaatcataaaaaactattatcatacgctgatattgctgaaaaagttactcataacaatcctagcggtttagatgctacaactagtgctagcgataatcctatctggttaattcgtaataaagaaattacacctattccaattaacctggatgcttatctactaattagtgatagcggtattaaaggtcaaacaagtgaagcaataaaaattgttaaagaccaacttaatacagacgaaatatcaacttcatcaaagttagctgcattaggtagattagcacaaaccactagagatcaactggctaataatgatatagtaggactcggaaaaacatttactttagcccaaaaagatttgatttctttaggtgttagcactcctaaattagataatcttattaatatagcacttaaaaacggttcactaggtagtaaacttactggtggtggtcgtggtggatgttttatcagtttattgaagacaaaaaaagaggcagaagtacttgctaaaattttaaatcaacacggggttactaaaaattggatagagcccctatcgaatctttag

SEQ ID NO: 202 - DNA, 1950 bp, Lactobacillus salivarius
  isolated from gut, Lactobacillus salivarius
atggctgtaaatacagaagaacgccacggacaagaatcgttagaaaatcataaacacatgtttaatcaaggtgtgaactatgaactctataattttttaggtgttcataaaattagtagagatgatgaaaacggttatgtttttcgcgtttgggctcctcatgctaaacaagtatgggtatgtggagactttaacaattgggataaatctcatccgatgattttagatgagaaatctggtatttggagtatcgaggtaaaagaatctagagaaaatcaatattataaatatctagtcaaacaagcaaacggtagagaaattatgaagacagatcctatggcacaggtatatgagaaaagacctgagacagcagctgtcgtcaaagaattggaaccgtttaaatggaatgacggtctatggcgtggcagacaaaaacgtatgaatcattttaataatcctatcaatatttatgaagtacatgcaccatcatggaaagaacatgaagatggtagtttgtatacgtttaaggatttaacagcagagttaataccatacgtgaagaagatgggttacactcatatcgaatttatgccattgatggagcatccccttccagcatcctggggttatcagttaacggggtactttgctttgtgttcaagttacggtacaccagatgagtttaaggattttgttaatgaatgccatcaaaataatattggtgttttggttgactgggttcctggtcacttcagtattaatgatgatgctttagcatattatgatggaactccaacttacgagtatgaagatccagacagagctaagaatataggttggggagctttgaattttgatttaggtaaaccagaagtgcaatcattccttttatcaagtgccttttattggcttaacgaatttcatttagacggtatgcgagtagatgccgtatcaaacatgatttacctagattatgatgaaggcccatggaaacctaataaatacggagatactcgtaatttagaaggatatgctttcctacaaaaattcaataaagttgtgaagttcgctcatccagaatctttgattattgctgaagaaagttcatcaggtacacaaatatcaggaactattgaatctggagcaataggatttgattataaatggaatatgggttggatgaatgatgtattagaatttttcgaaatggatccatattttagaaaagataacttgaatttagttacattttcatttatgtactggcaagcagaaaactttgtattacctttatcacatgatgaagtggtacatggtaagaagagtttaatgcataagatgtggggagacagatatcgtcaatttgcacaattgagaacactttatacatttatgattatgcatccaggtaagaaattacttttcatgggtggcgaatggggacaattcttagaatggaaatttgatcacggattagagtgggtagatttacaagatgaaatgaatgctaagatgcaacatttcacttcagttttaaaccacttctacaaggaagaaagaccattgtgggaattgggtcaacaagatgctacgttagaagttatagatgctgataatcataatgatacagttttaagctttattcgtcatggtaaacgtaaaaaagatttcttgattgttatcttaaactttacaccagttgaaagaagaaacttcagaattggtgtcccatatgagggtacatatactgaaattttaaatactgagatgaaggaatttggtggaacatgggtagagcataatgctgatagtgttagcgaagaagttaactttaaagattatgaacattctattactacaacagttccagctttaggcgcaattatattgaaacctaaagatattaaggtaactcgtcgaagttctaagaaacactcacataagaaataa

SEQ ID NO: 203 - DNA, 1326 bp, Lactobacillus salivarius
  isolated from gut, Lactobacillus salivarius
atgtctgcaattacagaaatttatgcacgcgaagttttagattcacgtggtaacccaacagttgaagctgaagtatatacacaagatggtggtttcggtcgtggaatcgttccttctggtgcatctacaggtgaacatgaagctgttgaattacgcgatggtgacaaagatcgttacatgggtaaaggtgtaacaaaagctgttgctaacgttaatgatatcattgctaaggaaatcgttggttacgaagttactgatcaagttgctatcgataaagcaatgattgctttagatggtacaccaaataaaggtaagttaggtgctaacgcaatcttagcagtttctattgctgttgctcgtgcagctgctgacgaattacaagttccattgtacaactacattggtggtttcaatgctcacgtattgccaacacctatgatgaacgttatcaatggtggtgctcactctgataacaaggttgacttccaagaatttatgattatgcctgttggtgctccaacagttaaggaagcaatccgtatgggttcagaaacattccatcacttacaaaaattattagctgctgatggtaaagtaacatccgttggtgacgaaggtggttttgctcctgactttgcaaacaacgaagaaccattagaataccttatcaaagctattgaagctgcaggttacaagccaggtaaggatattgctattgctgttgacgttgcttcttctgaactttgggacaatgattccaagaagtacaagttacgctggtcaacaggtgaagaattcacaactgaagaattcatcaaatatcttgaaggcttagttgctaagtacccaattatttctatcgaagatcctatcgatgaaaacaactgggatgactgggtaacaattacttctgaacttggtaagaaagttcaattagttggtgacgacttcttcgttacaaacacagaatacctacgtaaaggtatcaagatgggtgctgcaaactctatcttaatcaaggttaaccaaatcggtacattaacagaaacaatggaagctatcgaaatggctaaagaagctggctacacagctattgtttcacaccgttctggtgaaactgaagatacaacaattgctgacttagttgttgctacaaatgcaggtcaaattaagactggttctatgagccgtacagaccgtcttgctaagtacaaccaattaatgcgtattgaagatcaattaacagacttggttgctaagtacaagggtatcaactcattctacaacttgagtgaacaagctcgtcaagacatcattaacaagtaa

SEQ ID NO: 204 - DNA, 828 bp, Lactobacillus salivarius
  isolated from gut, Lactobacillus salivarius
atgaaacttatttcatggaatatcgattctttgaacgctgctttaactagtgattctgctcgtgctaaacaatcacgtgaagtcttagcaactattattgatgaaaatccagatataatagcaattcaagaaaccaaattatcagctacaggtccaactaaaaaacatcaaactattttagctgaacaatttccagattatgaaattgcttggagaagttcacaagaaccagctcgtaaaggttatgctggtactatgtttctttataaaaacaatttaaatcctactatcagttatcctgaaattgatgcacctgaaccaatggattctgaaggtagaatcatcacacttgaatttgatagtttttacgttactcaagtatatactcctaatgctggtgatggtttgagacgtttagctgaacgtcaggtttgggatgaaaagtacgctgactacctagtttcattggatcaaaataaacctcttctttctagcggtgatttcaatgttgctcataaggaaatcgacttagctcatcctggtaataatcatcattctgctggctttactgatgaagaaagagctggctttactaacttgcttaataagggctttacagataccttccgctatgttcatggcgatgttaaggatgtttactcttggtgggctcaaagaagtcgtacaagcaaaattaacaactctggttggagaattgattattggctagcaagtaatcgtattgctgataaaattgttcgttctgaaatgttagattctggcgaacgtcgcgatcatactccaatagtattagaaattaatatctag

SEQ ID NO: 205 - DNA, 852 bp, Lactobacillus salivarius
  isolated from gut, Lactobacillus salivarius
gtgaagaaaatagatagagcaaaattatttattcaaaataatatggaaattttcaggtgtcctttttgtcaaaataaaataaccagtttacaagataacagtattgtatgtattaatggacatgttatcaatcttaataaaaaaggaacattacatttattaactcatggtgtgaaaagtgactatgataataaagaattgtggaatgcaagacgaactttgttacaagccggtctattttcaccaattattgagcagataatgaaagaattaccagcaaaaaaattaaagataattgatgtaggttgtggagagggcacaccattaattaatttagcaagatcaagagagaagtataatgatatcctaatagggtttgatatttctaaggatgcgataaatttagcaacacaaaatgagttacatccatttttttgtattgcagatttagcaaatcttccatttatggataatagtattgatgctattattgatattttttcaccttcatcttacggagaatttttaagagttctgaaaaatgaaggtaagttatataaagtaattcctaatgcaaattatttaattgaactacgacatcttttatatggtgatacaggttcaagaaaatcaagttatagtaacgataaggtgttaaatttattttcaaaacattttcctaactttgaaagcaagcgtataagatacaaatttaatttaacaccggaaaattttaaaaatttattgttaatgacgccacttagttggggtgcaagtaacgagcaattagaatatgctaggcaaaatccattaaatgaaataactgtagatgttaccttattaatagcatag

SEQ ID NO: 206 - DNA, 834 bp, Lactobacillus salivarius
  isolated from gut, Lactobacillus salivarius
atgagtagttttgttgctaatgaggaagagataagaaactttctttgtcgtcctaacatgaagaagcaagatggaataatgtttgcctatgtaacttcagctgagaagttaactgaattggtgcctaaacctttgaaagttgtagcacctgtcatcatgggctacgtcacccatatgggagatccaacttttgctgctccatatgatgaagctgtattgtatgcgtttgttagttaccaagataagataatgggagcctacccatttgtcttatatctaagtggtgaaggtgcagaggaggcgatgattgctggtcgcgaaggtgcatgtatgcctaagaaattggcagatgatattaaaatagaaaaatcagaaaataaagtacaagctaaaataatcagacatggtacagaaattttgaacttaaagtgggaagctggagtgcctaatgatattgaaacagttaagaaaatgtttggtagccaagtgaaattaggtgaaccatcagaaatggcaagtttcttcattaattacgatattgaacaacaagatgatggatctaataaatttgtaaatactgagttaattgcaactcaaagtacaggcttaactactgatatggaaattggaaaaatagatatgaaacttacttccagcgaagacgatcctttagctgaattagaagtacttaagccagttggtggcgcacattacaagatggactattccgttatgcataagactctgaagctagactctcttaatccagaagaaattgctccatacttgattaccggacactatgatagaactttcgtaactaagcaagattaa

SEQ ID NO: 207 - DNA, 1341 bp, Lactobacillus salivarius
  isolated from gut, Lactobacillus salivarius
gtgagtaaagaatatttaacggtaagtgctctgacaaaatatttgcatactaaatttactcgtgatccttatttaagaagggtatatttaacaggtgaaatatctaattttagacgtagagctacacatcagtactttagtttaaaagatgataatgctgtgataagtgtaatgatgttccaaagtgccttttcaaaaataaagtttgaaccagaggaaggaatgaaagttttggtctctgggagagttgatttatatgaaaaatccggaagatatcaaataattattgatacaatgcaacctgatggagtaggtgcactatatcaagcatatgaacaactggtaaaaaaattacgaatagaaggattatttaatgaagaattaaagaaacctttggttaaataccccaagagaattgctgttattaccagtccatctggtgcagttattagagatattattactacaacgcatagacgctatccaattgcacaactagttttattcccagctgttgttcaaggagatgatgctgctgattctttagttggaagattaaaacaagtaaacgaagaaggaaattttgatacaataattattggtagaggcggaggatcaatagaggatttgtggccttttaatgaagaaaaggttgctagggcaattagtgatagcaagattccagttatatcttctgtaggtcatgaaactgatacaacaattgcagatttagtagcagatgttagagctgctacacctacagcagcagctgaattagcaacacctgtattgagtgaagaaatagtgaagattaagcagtatcgtttaagaataatacaagttctaaaaaataaaatatccaattatcaacagattttagataaagtatgtagttcatatattttgcaacaaccagatagactatatacagggtatgcgcaaaatttagattcattgattaatagaaaaaatcaagcttttaaaaatttagtttatcaaaatgaaaaacaattacagttattagaaagtaatttacaacataataatccaagcattagaattaaagatgaaaaaaataatttacaacagttattagaaaaaatgcatctagggatgttaggtgtttttaatgataaaagctataaattagaaaaattaatgtcatctttagatatgttaagtccattgaaagttatgaatagaggatatagttatattttaaaagatggtaaaacagtaaaaaatgttaaatcattacagccaaatgatgatgtaacactttattttgaaaatggtagtgctgaagctagaataacaaaaattagagaggaaaaagaataa

SEQ ID NO: 208 - DNA, 1458 bp, Lactobacillus salivarius
  isolated from gut, Lactobacillus salivarius
atgctaaaaaaagcatttatttttattgtcagttgcttatgtactttattaatttttactaacttgaataataatcatgttaatgcagacactaaaacctacaatatcgggacagatgttacttatcccccttttgaattcgctaataagaataatcaatatgttggaatagatatcgatttaatgaaagctatcgctaaagaagaaggattcaaagttaatattcgaccaattggatttaactctgccgttcaatccttacaatccggacaaattgatggggttattgctgggatggctattactgatgaacgtaaacaaaaattcgatttctcaaagccatactataagacaggtttcatcatggcagttgctaaaaatagtaacattaccagtctcaaacaactacgtggcaaacgtgttgctttaaaaactggtactgccgctgctaactatgctctttcattgaaagataaatatggctttaaaactgtaacttttgatgattctgacaacatgtacaatgatgttgttaacggaaactctgttgcttgttttgaagatatgcctgtaatgcaatatgctattcaaactggcactaagttaaaaattgttactaaaccagctcaaagtggttactatggttttgctgttatgaaaggtaaaaaccaagaacttctacataaatttgatgatggtttagctaagttaaagaaaaatggtggttatgataagatcgtaaatcgctacatcaaccaaaatacaattgctgaacaaaagaaagctaacgaaaatagcaacaatgaacatacctttattggtttgttaaaacaaaactctggcgttttccttaacggtctttggaaaacaatctacctaactattttgagtattatcggcgcaactatctttgggattatcattggtttcttaggagtaattcctaataagttcgctcaaggggtttcaactactgttatttatatcttccgtggtcttccattgctagtacttgccctatttatctataacggtattcctagcttaactggtactaagattccagctttcatcgccggcatcatcacccttactttaaacgaaggtgcttatactgctgcctttgttaaagggggaattgaagctgtcgataaaggtcaaatggaagctgcccgtagtttaggattatcatttggtaaagcaatgaagaagattatattaccacaagggattaaaattatggttccttcattcgtaaaccaatttattattacgttgaaagatacttctattctttctattattggtattctcgaacttacacaaactggtaaaattatcatcgctcgtaaccttgaaggcttcaaagtttgggcaattatcggattaatgtacttaatcgtaattacagttttaacttggatttctaactatttacaaaagaaaatgaataactaa

SEQ ID NO: 209 - DNA, 1371 bp, Lactobacillus salivarius
  isolated from gut, Lactobacillus salivarius
atgaagaaaaaattaccagttagtaaaaatgaagatttaattttaacaattgaagacttaacttatcaaggaatgggtgtggctaaggtagatggttatcctttgtttatagaaggtacattacctcaagaaaaaattaaggcacatgtggttaaagttactaagaattatggctttgctaaagtgatagattttattgaaaagagtccggatagagtagaaaatgaagataaaatatatcttcaaacagggattgctccactacaaaatttaagttattcagctcaattgaaatttaaacgtaagttagtaactgatttgctacaaaaagtgcatttggataatttagaagtggcagatacgttaggaatggatacaccttactactatagaaataaggctcaagttccagtaagagaagttaatggtaagttagagataggatttttcaagcgcaatagtcatgactttgtggcgatggaacatttcctcattcaagataaaagaatagacgaaattttgctaaaagtaagagacattttacgcatgagcaagattactgcttataacgaaaaaaagcatactggaatgatacgtcacattttagtgagaagaggatattattctcatgaagcgatggtagttctagttagtcgagtaagaaaaattccaaatcttgatcaaattgcattcttaattcaacaacaatgtccagatgtaaagagcgtaatgttgaatgtaaatccagataaaacaaatgttattttaggaaagaaaactataaaattagctggtaaagatacaattcaagatactttgaatggcttgaaatttgatatttcagcacaatctttctaccaagttaatccacagcaaactgaaaaattgtatcaattagcaattgaaaatgcagaattaacaggaaaagaaacggttattgatgcatattgtggaattggaacgatctcattaaatatggctaaatttgctaaaaaggtatacggtgtagaaattgtccctgaagccattgaagatgctaagcataatgctagtctaaatgatctagataacttggactttgaagttggagaagctgaagtgtggatggaaaaatggcaaaagcaaggaattaagccagatgtaataatggttgatccaccaagaaaaggtctaacttctagtttgattcaaagcgcagtggcgatggaacctaaaaaagtcgtttatgtaagttgtaacccagcaactctagtacgtgatattcaagaattcatggaactaggataccaagttacaaagcctattcaaccagtagaccagttcccgcaaacaacgcatgttgagagtgttactgtgttggagcatgtgtaa

SEQ ID NO: 210 - DNA, 882 bp, Lactobacillus salivarius
  isolated from gut, Lactobacillus salivarius
atgagttttaagaaaattacaattgccggagcaggtacattaggtagtcaaattgcatttcaagccgcattttatggatttacagtatctatctggaatccgcatccagatcgtgcaattagaagattgaataaagttcagaagatgtataaacaagagatggggattacggatagtgatgtaaaaagagcgatgaagaatattgttgagattactaatgatatggaaatcgctactaaaaatacagaatatgtgattgaatcagttccagaaaatctagaaataaaaggaatcttttaccaaaagatgtgtcaggtactaccaaaagatgtaattttagcaagtaatagttcaactttggttcctagtcagttagtaaaatttgttgatagaccagaaaagtttttgcatatgcattttgcaaaccatatctggaaattcaatacttctgaaattgtgggcaatgaaaaaacggataaagaagttattgataaagtggtagaattcgctaaagaaatcaatatgttaccaattgttttaaagaaagaacaatctggatatataatgaattctctatcggtaccatacctgaatgcagctctaggattgtgggctaaaggggttgcagatccaatgacgattgataaggattggatgaaagctacaggttcgccgatgggaccattcatgtcactggatgcaattggcttaaggacaacatatgcgatctttaatgcacatgctgaagatgcagcagctaaagcaattgctgataaattgaagcaaatgattgatgaaggtcattacggcattgaagctggtgaaggattctacaagtatccacatccagcctatgaatcagcagattttttgaaagtttaa

SEQ ID NO: 211 - DNA, 1068 bp, Lactobacillus salivarius
  isolated from gut, Lactobacillus salivarius
gtgaatttaggaggtctctttgacttagatgctttagaagaaaagattgcagaaaatgaagcaaggatggcagagccaggattttgggatgatcaagaaaaagcacaagaggttattgctgaaaataatgatttaaaggcaaaatttgagacatttcatgaactagcggaatctatttcagatttaggagtatcgttagagttattacaagaaattccagatgatgaggaattacaagcagatttagaagaaaattatcaacatgctgaaaaattgttacaatcatatcaattaaatatgttgttaagtgaaaagtatgataagaataatgctattttagaaattcatcctggagcaggtggtaccgaatctcaagactggggatcaatgctactaagaatgtatacacgctgggctagtcaacatgattttaaagttgaaactgtagattatcaaccaggcgatgatgctggtataaaaagtgtaacgcttatgatagaaggaaaaaatgcttatggttatctacgaagtgaacgaggagttcatagactagtacgtatttcaccatttgattctgccggaagacgtcatacctcatttgcatctgttaatgttatgccagaacttgatgattctgttgaagttgagttaagacctgaagatataaaaatggaagtctttcgtgctagtggagcaggtggacagcatattaataaaacttcttcagctgttagacttattcatataccaacgggaatagttgtttcaagccaggcacaacgttctcaatttcaaaatagagcaactgcagaaaatatgttacgtgctaagttatatcaattggagatggaagaaaaagaaaagcaacgtgctgctattcaaggagaacaattagatattggttggggttcccagattagatcatatgtcttccatccatactcaatggtcaaagatcatcgcactgattatgaaactggaaatattcaagcagttatggatggagatttagatccatttatcaatgcttatttacaatggaagctgcaacaagctaatccacaataa

SEQ ID NO: 212 - DNA, 528 bp, Lactobacillus salivarius
  isolated from gut, Lactobacillus salivarius
atgaacacaacatttttactaagtgctactgaacaaggtgttgcatggggagattttattttctacatcgtaacattcttgattttgcttgctctagttaaaaagtttgcatggactcctatcacggatatgatggaaaaacgtgcaacaaaaatctctaatgatattgattctgctgaacaagcgcgtcaaaaagcagaagagttagttgaaaaacgagatcttgctttgaaaaactctcgttcagaagcttctcaaattattgatcgtgcaaagaaaaatggagaacaacaaaaggctaatattgtaagttcagcacatgaagaagttcagacaatgaaagctaatgctaagaaggatattcaacaagaacgccaagaagcattagatagtgtaaaaaatgatgtggcagagttatctattgaaattgcttcgaagattattcgtaaagaactaactgctgatgaccaaaaggccttagttgattcatatatcgaagggttgggaaagcaaaatgaaactagataa

SEQ ID NO: 213 - DNA, 2793 bp, Unknownn
  isolated from gut, unidentified
atgaccgtatatgctgatagcaagacaaatattactcagaacggtacggggtccgggactgttattaatcaacaggaagaaccgcagataagtaccgttaatagtaataccacagataatactagttcttcggacgatcaggcgtctcagaaacaagttactaatacagaagcacaaccgagagcaccaactgacaataatcagccagttcaggaggaccgtaattatataagtaatagtcaatactcgacttctaatagtggggctaatactaatcagggtccatcagttaatagtatttctaagaataatagttccccatctgcacataataaaggaactagcgttgatattacaattaccaatcagagatcatcaactaaggagatctcaggtggaggaactacagaattctcttttgacttttctgttcctaattcagtaagatccggagattatacgacaatatcacttcctaatgagttggattttactagagatcaatcatttaatgtctacgctcctgatggggtgactacggttgctagtgcaattatcaataaagaaaaaaagacgctggtcttaacatacacagactatgtagataaacataatgatgttaccggccacattaatatgcaaataatggctgatacagaaaaggtgaagaaagacactgtacttcctgcaacaattaaaataaacgggaatgtagttactatcgatagcacgggtataagctataaagttaataaaggtgatagtaatattgatttttataaatatgggtggatggattatgataataatgaacttagctaccgtattattataaacacaactaattctgaacggaataatgttattattaaggatattcttaattctgctggagttaattatgaacagtcaagcataaaaattgcaactggaacctggtttaaggacaaaaataactattggtcattggctaactataaagaagtaactgaaaaatatacccctgaattcaatggctcatctttttctgtgaatcttggtaatatcaatcagggtttccttatcacatataaggtaaagccttctcataagttgattaacggagaacaaattaaaaactcatcaagttatctatataataatcataagatgaacgagtacactaatacagtatattatcaagaggcaaatggtactgcaaacggatataactatagtttaacaataaaaaaggtggatgaatctggcaatccattacatggcgctatctttgatgtaattcgacagtcaaccggagaagttgtaggaactatcacaacagattcctcaggacagggcactatctatgggttgttacgtgatagttaccaattgaaagaggtcagtgcacctaagggatatcaattagcagatacggtaatcgtaacttctacaaattttgattcaaaaggtgccgttattaaaattatcgataagattgagaaaacctcagtttctggaacaaagacttggaacgataacaacaatcaagatggaatccgcccaagttcaatcacagtgaacttattggccaatggtcaacaagtcgcaagtaagacggttagcgctagtgataactggcaatatagttttgacaacctagctgcttatgctaatggtaagaagattacctacacagttacggaagatgcagttgcggggtacacaagtactgttgatggttacaacgtaaccaacaaccacactcctgccactgttaaggtatccggaacaaagacttggaaggataacaacaatcaagatggaatccgcccaagttcaatcacagtaaacttattggccaatggtcaacaagttgcaagcaagacggttagtgctagtgataactggcaatacagttttgacaacctagctgcttatgctaatggtaagaagattacctacacagttacggaagacgcagttgcggggtacacaagtactgttgatggttacaacgtaaccaacaaccacactcctgccactgttaaggtatccggaacaaagacttggaacgatgacaacaatcaagatggaattcgcccaagttcaatcacagtaaacttattggctaacggtcggcaagttgcaagcaagacggtaagcgctagtgataactggcagtacagttttgacaacctagccgcttatgctaatggcaagaagattacctacacggttacggaaaacgcagttgcggggtacacaagtactgttgatggttacaacgtaactaacaaccacactcctgccactgttaaggtatctggcaccaagacttggaacgataacaacaaccaagatggaatccgcccaagttcaatcacagtgaacttattggccaatggtcaacaagtcgcaagcaagaaagttagtgctagtgataactggcaatacagttttgacaacctagctgcttatgctaatggtaagaagattacctacacagttacggaagacgcagttgcggggtacacaagtactgttgatggttacaatattactaatacccataatccgacaacgcctaagaagccccaggttcctaataacccgacaacgcctaagaaacctcaagttcctaataatggaaataaggtagtaccaaaagatttcactcaaggtaaaacgtacgataaaacaagtagattacctcaaacaggtgatagatcatcaataggtatgatgttcgttggaatagtaatgttactattaagcttaggtttagtagttataaacaggtttactatctga

SEQ ID NO: 214 - DNA, 1008 bp, Lactobacillus salivarius
  isolated from gut, Lactobacillus salivarius
atggtgttcggaatcggaacgaaaaatataggaattgatttaggaacagcaaatacaattgtgtatgaagaaggtaagggtattgttttacgtgaaccttctgtcgtagctaaaaacacaaaaacaggagaggtcgtttccgttggttcagaagccagagatatgattggtcgtactcctgaaagtattgtagctatcagaccaatgaaagatggtgttattgctgattacgatacaacagtatcaatgatgcaatattacattcaaaaggctttaggaaacaaagctaacaagccttacgtaatggtatgtgttcctagtggtgtaacagaagtagaaaaaagagctgtcatagatgcaactcgagtagctggtgctagagatgcttacacaattgaagaaccttttgctgctgcaataggtgctggattacctgttatggacccaactggtaatatggttgttgatatcggtggtggtactactgatgtagcaacaatttctttaggtgggattgtatcaagtcgttctattagaatggctggtgataagattgacgaagcaattatttcttacgtacgtaaaaacttcaatcttttaattggtgaacgtacagctgaacaattaaaaatggacgtagcatctgcatcagttgaagctgctaaagatattgaaagtcaaagtattcgtggtcgcgatttagtatcaggattgcctcaaacagtcgaaattgaagctgttgacgtagctaaagcaattcaagaagttgttcaagaaattattgcagcaatcaaagaaacattagaagaaacttctccagaaattgctgctgatgttatcgatcacggaattgtccttactggtggtggagctttattgaaacatttacctgaagttatttcagaagcaactaaagttccagtatttgtggcatctgaacctttagactgtgttgctattggaacaggtgaatcattgaagagtatcgaagtcatgaaagacaaataa

SEQ ID NO: 215 - DNA, 1914 bp, Lactobacillus salivarius
  isolated from gut, Lactobacillus salivarius
atggaattcggaaaaagatataaagctaaagactatgatgtaattgttgttggggcaggacatgctggatgcgaggcagccttggcttcagctagaatgggtaatgaaactttactaattacaattaaccttgaaatggttgcatttatgccatgtaatccatctattggtggtccagctaaggggattgtagttagagaaattgatgccatgggtggcgaaatgggacgtaatattgataagacttacgttcaaatgagaatgttgaatacaggtaagggacctgctgtacgtgctttaagagcccaagctgacaagcgtcaatattctattgaaatgaaacatacaattgaacaaacaccacatttaactttgcgtcaaggaattgttgatgacttgattattgaagatggtgaagttaaaggtgtagtaaccaatactggtgcttgctatggtgcgaaatcagtagttttaacaactggtacagctgctcgtggaaagattatcattggtgaattaatgtattcttctggtccaaacaatactcaaccagctttagaattatccaagaacttagctaaattaggatttgaattaaagagatttaagacaggtactccacctcgtgtcgatggaaatactattgattacgacaagacagaagaacaaccaggtgacgtagaacctaaccactttagttatgagtctaaggatgaagattacttaaaagttaaggatcaattatcatgttggttaacatatactaacgaatatacacataaaattattcaagataatttagacagagcaccaatgtttactggtgttattgaaggggttggacctcgttactgtccatcaatcgaagacaagattgtacgtttttctgacaaacctcgtcatcaattgttcttggaacctgaaggacgtaataccgatgaatactatgttcaaggtttatcaacatctttaccagaagaagttcaacaagaaatggtacgttctattgatggcttagaacatgctgaaatgatgcgtccaggttatgcaattgaatatgatgttgtttcaccatatcaactaagaccaacattggaaactaagttgatcaagggactatacacagctggacaaactaacggtacttctggttatgaagaagctgcaggtcaaggctttattgctggtgtaaatgctggtcgtcgtgctaagggactagaagaaattactttgaagcgtagtgatgcttatattggtgttatgattgatgatttagtaacaaagggaacaaacgaaccttatcgtcttttaacttcacgtgcagaatatcgtttaattttacgtcatgataatgcggatttacgtttaacagaattaggtcatgaaattggattgatttcagatgaacgttatgctgcttttgaagagaaaaaagcacagattgaagccgaaaagcaaagattatctaaaattagaattaagccaaacgcggaagttaatgcttttgtagaggctcatggcgatcgtgaattaaaagatggggtacttgcaactgaattcttaagaagaccttatgtaacttatcaagatctattgaaattcatcccagcacctgctgaaccattagatagacgtgtaattgaacaaattgaaatacaattcaagtacgaaggatatatcaagaaagaatatgctaaagttgaaaaactaaagcgtatggaagctaagaagattccagcaagaattgattactctcgtattgaaggaattgctactgaagctcaacaaaaattagctaagattcaacctgaaacattagcacaagctggacgtatctcaggggtaaatccagctgacttgtccattttagctgtttatattgaacaaggaaagattgctagagtcgacgattag

SEQ ID NO: 216 - DNA, 1137 bp, Lactobacillus salivarius
  isolated from gut, Lactobacillus salivarius
atgccatcacgaagagatgataattatgttgttcaaagtgatgagaatggttatatagatacagagcatatgactcgttctcaacgctatcatcaacgtaataataaaccgaaaaaaaaaggacataaattactatggtcagttatagttattgtagtagcaattattgggggattttatgcttatagaaaatatactaatgctaaacaagctgctaatgcaatttatagttcaactcaagttacaaaggccagaaatgttagtgacgctttgaagaagaaaagacctatctcaattttgctaatgggtactgatactggagctttaggacgtgattttaaaggaagaacagatacaatgatactttgtgtcttgaatcctgaagacaagaagatgacgttagtatcattacctcgtgatactgaggtagctgtttatggttatgaagattactttccaagcaagataaattcagcatacgaatatggtggatcagcaacagcagttaaaactgtgcaaaaattcttaaatgtgccaattgatttctatgcaactatcaatatgggtgggttagaaaaattaattgacgcagttggaggagttaaagtagaaccaaccattagctttacctatgatggatatactttcaaaaagggtaaggaagttaatatggacggggaaaaagctttggcatatgttcgtatgcgccatgaagatccacgcggagattatggtaggcaagaacgtcaacgtcaagtattaactaaacttgcatttaagagttcagggttaacaagcttagttaatcaaaagttcctaagtactatttctaagcagatgaagacagacttaacatttgatgatttattaacactaggaactaagtatcgtgttgctacacatgatatggattcagacttcttacaaggaacttctgaaatgattaatggagaatcttttgaagtagcatcaacaactgaaaaacaacgtattactaataagcttagagaagcacttggtttatctaaggctaaaacaggaaatacactttccagtgataatgatgtgaatatcagttcagaaggcgaagatactaattatagtaatgatgataacacttattatggtggatattag

SEQ ID NO: 217 - DNA, 765 bp, Lactobacillus salivarius
  isolated from gut, Lactobacillus salivarius
atgagccaagtagcgctagaattaaagaacattaatactactgtgaatattggaacacctgaagaaaaaagaattttaaaggatttgaacttaactttagagaaaggtgatttcgtaacattactaggaacaaatggtgctggtaagtcaactttattgaatgtaatcaatggatcattgaatactacttctggtcaagtagttctaaataatcatgatttgactaagttatcagaagttaaacgcgctaaatatatcgctcaggtatttcaagatcctaagatgggaacagctccaagaatgacagttgctgaaaatttattattagctactaaacgtggtcaaaaaagaggtctaaggctcagagggttgaagaaacatttagcagagttcaaggaagaaacggcacaactacccaatgggttgtcagatagactgaatacttttgctggtagcctttctggtggtcaaagacagacactaagtttcttaatggcaacaattcaaaagccagaattgttattattggatgaacatactgcagctttagatcctaatacgagtcaccaattgttagaattaacaaatgaagttgtagaaaaagaaaatttaacatgtatcatgattactcaccaaatgaaagatgcactaaagtatggtaatcgaactgtgattttaaatgatggtaaggttgtgctagatgctaagggtgcagaaagagaaaagttaactgaagaagatgtattaaaatatttcgcaaactaa

SEQ ID NO: 218 - DNA, 1056 bp, Lactobacillus salivarius
  isolated from gut, Lactobacillus salivarius
atgtttttgacactgtggcaacgttttttaggaaacgaacggttaaggcgatttacagttttactatttttagtaggagtgctgtatctagctcgaagtatgatgagtttaatcttactaacctttattttttcgtttctagttattagcttaaatgatgcaattagaaagaaaatagatattccttctaaattaattgtcatcattgtttatttgttgatgataggtggtatttacttagcaataactatctacctaccaaaattagttacacaaacggaaaatttggtaaattacattgttaagttctataatcacccacctaagggaacaaatgatgtgattaatatggtcacgcaatacattagtcaatccgatattatgaaacaaatgcgtggtggtatgtcaattatcgttaagtatttggcaaatattggaacgatgggaatgacgtttattatggcgttattactaagctttttctttacaattgataaagatgatttgtttaagttttcaaaatcatttttaaagggtccatattcatggttctttaatgacgtttactactttgctaagatttttgttaacagttttggagttgtattagaaactcaatttattattgctttaattaatacggcaattacaacaacgattttagcatgtatgaagatgcctcaattgttcagtttagcgttattaatattcttcatgagtatgattccagttgctggggttatcatttcagcaattccgatgatgttaattggttacactgttggtggggtaaagtatattatttatatcatcattatgctttgtgtggttcatgccttagaagcatatgtgttaaatcctaagttaatgtcaagtcgaacagaattaccaattttctacacatttgttgtactatatgtgtctgaacatttatttggaatgtggggattaattgttggtatcccagtatttacattccttttggatattttaggggttaaaagcgaccatattcgcagagaaagactaaagaaattcagagagaaggtaaaatag

SEQ ID NO: 219 - DNA, 1347 bp, Lactobacillus salivarius
  isolated from gut, Lactobacillus salivarius
atgagtggtgaagaagccaatagtatgttgcaatctgtgatgaagcatcatcatatgcaaatgccatggcacaattttacgccagataatagcaatactcctgctaagagggcaactttaaaagaaaaagctaccttggtaggaagagtagggattatgcttctgtcgtatggaactggtgcttggcgagtgcgagattctatgaatactattgccagagagttaaatgtttcatgttcagctgatgtaggattggtatcaattgaatatacttgtgttgatgaagaagggcatggatatacacaagccttatctttggcaagtacaggtgtaaatactgacaaattgtcagaaatggaacagtttgtcatggacttcaataaaggtgggtctgatctgagctctgaacagatccatgaaatactagatgaaattgagcgtaagccaggacactatacagctattatggctggtttagcggcagcttctgcatgttgcgccttcgtatttttactaggcggaggtctagtagaaatgttgtgttcttttgtaggagctggttttggaaattatattcgtagaaaaatgattgagcgacgcatcactttattagcgtgtgtgtctgttagtgtggcagttgcttgtatattctatttgatagcctttaaatctttggtagcaataatgcatgtttcattacaacatgaagctggatatatcggagcgatgttattcgtaattcctggttttccatttattactagtggacttgatattgctaagctcgatatgagatcaggtttagaaagaatgatgtatgcgattatgattatcacagttgctactttagtaggctgggtagtagcgatggcagttcatttaaaaccagtgaacttcattccattagatctaggagtaataccaatgatgctcttgcgaatccctgctagttttgtcggagtatttggattctcaattatgtttaatagtacaattgagatggcaacctgggctggaataataggggctattgctaatacacttagattagaattggtagacttaactaatattccggcgggagcggctgcatttactgctgcgttggttgctggactactagcatcactaattaaaggttacccacgtatttcattaacggttccttcaattgtgattatggttcctggattatacatgtatcgtgctgtatataatataggggtagcttcgattaatgtgggagcaacttggttaactgaggcagctttaatcgtaatgtttttaccactaggattaattaccgcacgtatattgactgataagaaatggcgttataaagattag

SEQ ID NO: 220 - DNA, 918 bp, Unknownn
  isolated from gut, unidentified
atgaaaaataagaggtatttaaataaaatcttattaaccgcaatacttgtattatttgggagttgcatttctgttaaagcggatataaattcgaatgaattaaatgctaaattaaactcagaaataacaacacaaaaagcgcaacttgcaaatggtcagttacctaaagcaaatacgcatcagtctgatggaaagacgatagtaagtagtggaactatggttttgactaatcaagatcaaaacaagaatcgtaattatttaccatggatgagctttgctgctacgccagaaacagtaactacccttaaatatcatataggggaagattattatgatggtaactttcgtttcacattttatttggattcaatagaaggaccagctccttatgcggttgatgcagcaattgttctatacacggagccatcactacaaggaccagtttccataaataagacgaatttgattagtaaagtaggcaacataacaacaggagcaatcggttctgtggaagttcccgcaaagacaacattttgggcagctgggggagaatatggtgcagagtctacttcggggaatgttgctttttatcccataactcaaggacctattgaattacaaaataaattagcccagaatttcccagaatatgttgatccagtctcgcataaagatgcagagtctccgcttagaacagattggactcggctaggtcagtctcctagttggaatggacgccaagcttttattaatcgatttaatgctacttatggtactcaatctgctgattggtggtctgctcgacaaattcatcatattcgtccaagaatttatggtggtacagatgattttaataatttactccctgttcccaatgcaaatcattatttaataacaagttggtttagaaactattaa

SEQ ID NO: 221 - DNA, 1014 bp, Lactobacillus salivarius
  isolated from gut, Lactobacillus salivarius
atgaaacaacaaacaagaaatacacctaaaattgttgtcataggtggaggtactggccttcctgttattttaaatggtttacgtaagagagatgctgatattactgctgttgttacagttgctgatgatggaggatcttccggaattatcagagattatattaacgtagttccgcctggagatattagaaatgtattagttgctttatctgatctaccagatgtatataaagatatatttcagtacagatttaattctaaagaccagttcttttcagggcatgcaattggaaatcttataatagctgcactatctgaaatggaaaatagaggaatttttaatgcagtgcaagagttatctgaattaatgaaggtagatgggcatgtctatccggctgctaatactccgttagtgttgaatgcagaatttactgatggtagtaaaatctctggtgaagcagaaatttcagcagctggaaaaactataaaaaaagtatgggttacaacaaatggtgaaggcaaaccagaggcgatgccagaagtaattgatgccattatgaatgctgatcagattgtattagggccaggaagtctatttactagtatcttgcctaatttaatgattgaaaatgtgggtcgtgcagtttgtgaaactaaggctgaagttatatatatttgtaacatcatgactcaaaagggtgaaactgaacatttttcagatgcagatcatgttaaagttttgaatagtcatttgggtaaaaactttattgacacagtgttggtaaatactgaaaatgtgcctagcgattatttagacagacaaaaatacgacgaatacttatatcaagtaaaacatgatttttcaggtttacgtgaacaaggaacaagagttatttcagataacttcttattaatgcgtgatagaggaattttccataatggagatcaggttgtagatgaactgatgagacttactggaagacccaagtcatggaacgacgatgaatttaattag

SEQ ID NO: 222 - DNA, 1257 bp, Lactobacillus salivarius
  isolated from gut, Lactobacillus salivarius
atgacttatgctgaaaaggtattagatggaattgaaaaaggaaattatgaagaagcacgtaaacattttggctggtctttaagaaaagattcagatgatatgatatatagtttggcagaagaactatattctttgggattttctaatatggccaaacgtacctatcaaaccttattggaacgttatcctgacgaagatagtttgaaaacagctttggcagacatcgccattagtgaaggtgaagatgatgaagctttagaatatctaagcagtattacaccagactctgaagcatatcttcaagctttattagtttcagcagatttatatcaaacacaaggaatgtttgaagtaagtgaacaaaaattattgcaagcattagatctagctccagatgaagaaattatacgttttgccttagcagaattgtactacaatatcaaacaatataaacaagcaattcctatttacttagatcttatcaagcaaggtaatttctcaatttcacaagtaaatctagtacagagattgggaatgtcatatgctttatcaggacaatttgaaaaagccttggcatacttggaacaaattcatagtgaagaaagagacgatgatacacagttccaattaggaattactcaatatgaattgggacatattgaagatgcaattagtagttttgaaaagttaagggatacttctccagattatgctacaacttactcatatttagcagtagcttatgaaaaagaaggacaacttcaaaaagcattaacaaccttacaagaaggaattgcagtagatgaatacaatataaagttgtatcaaaaggctagtgagttagctgctaaattaggtcaacgtgatgaagctgagcgttatttactaatagccttagatcaggaacctgataatttaacaattgtaattatgttgagtaatttacttattgagtatggaaaattcgaacaaaatattgaattactaacagattatctagatcaagatgaaatcgaccctcaactatattggaacttaggtcgttcatatgctaatttagataactatgatgatgccattaagtattatgatgcggcttctgaacaaatttcatcgttagaattcttaaaagatgctgcaattttttatcgtaatgctggcgatagacaaaaagctaagatgttcgttgatgaatatctagtaagtcaacctaatgatagtgaaatgttagaattacaagatgaattgttatattag

SEQ ID NO: 223 - DNA, 969 bp, Lactobacillus salivarius
  isolated from gut, Lactobacillus salivarius
atgattaaaaatttagttaatcataaaaattttagtaactatcactgttatattggagaatccgttatgagttttgaaattaatcatattaaatatatccaagccattgttgaaaatgacttcaatattactgcagcggctcataaaatacatatcagtcaacccgctctcagtaaatcaattaatttaattgaaagcaaatatcatgtgcatatttttacaagagataagcatcgattagttggactaagtcaacaaggtaaaattctctatgccatgatgttagatattctagagaaatacgaagaattagaaaatgaattgcatcaacttggaactgaaccttcgcttattaaatttggagccattgctagtaccccacagattttatttcctggtctcttcattgattttgaaagtacacatcctaacatccacattgaaattattgaggatggtggtgtaaatatcttacatgatttcttacaaaaaaaatttgattttgctttactagttaatccttttgaattaccacctgatttagctgatgtgcatttagttgctgaagatgagattgttgcctttcttcccctaggacatcctctcacttcaaaagcaatactaacttgggaagatctagctgaatatccgcttgtctctttatcagacaaatatcagacctactttaaagtaatggaacaatttagaatacgtggactagagcctcattttgcatatacatcatcttcatggcaatatctaacagatgctattcaacgcaattttgtaattactttaatgccatcgctagtcccaacattttcctctactgataacattattattaaacgaattaaaaatcctgcatcatttaatttgtttttagctagattaaataagaaacactattcaaaagaaaataaacttttctacaactttcttaatcaacatttaccaaaattaaaataa

SEQ ID NO: 224 - DNA, 645 bp, Lactobacillus salivarius
  isolated from gut, Lactobacillus salivarius
atggattggcaattatttttgaatccctacgaacaaaccgtaaatgaattaaaattaaaattaagagaaatgagaaagcagtatcgtcaaactgataatcatgcaccaatagaatttgtaactggacgaattaaatcagtagatagtattaaagaaaaaatggtaagacgacagttaacagaagatagattagatgagatggaagacatcgctggtgtaagaataatgtgtcagttcgttgaagatatttatcaagttgtatcagatttacgtaaacgaaaagatatgacaattattgaagaacgagattacattacaaataacaagtctagtggatatcgttcttatcacatcgtaattaattatcctctacaacaaattgatggtgaaaagattatcaaggctgaaattcaaatcagaactttggcgatgaacttttgggcaacaattgagcattcacttaattacaagtatcaaggaaaatttcctgatgagatagcagctagactgcgtagagcagctgaggcggcttttcaattagatacagaaatgtctagtattaatggtgatattaaagaagctcaacagattttttcacaaaaaaaaggttatacagatagttcgctggatgatatagacaactaa

SEQ ID NO: 225 - DNA, 945 bp, Lactobacillus salivarius
  isolated from gut, Lactobacillus salivarius
atgatcgaatttgaaaaaccaaaaattcataaaattgaagaagataataactacggcaagtttgttatagaaccgcttgaacgtggttatggtacaactttaggtaactctttacgtcgtatcttactttcttcattaccaggtgctgctattacagacgttcaaattgatggtgttcttcatgaattttctactattccaggtgttcttgaagacgttactttaatcattttgaatttgaagaaagttgctttaagtatggaatctgaagacagtcaagcattagaaattaatgttactggtccgatggaagtgactgctggagatatccagagtaatagtgatgtagaagttcttaatccagaacaatatatttgtacagttgctgatggggctgaacttcatgttcggatgaatgctaataagggtcgtggttatgtttcagctaatgataataaggctcttgcagatgatatgccaattggtgtattacctatcgactctatttataccccgatcgaacgcgttaactaccaagtagagaaaacacgtgttggtcaaaaaaatgattatgacaaattaactcttgatgtgtggacaaatggttctatcactcctagtgaagctattagtctttctgctaagattttaacagaacacttggcattgtttgttgatttaacagatgaagctaagaatgctgaaatcatggtagaaaaagaagaaacgcataaagaaaaaatgttagaaatgacgattgaagagcttgatttgtcagttcgttcatataactgtctaaaacgtgcaggtatcaatacagttcaagaattaactaataagtctgaagctgacatgatgaaagtacgtaacttaggacgtaaatccttagacgaagttaaggctaaattggcagatcttggcttgtctttacgtcatgatgactag

SEQ ID NO: 226 - DNA, 1026 bp, Lactobacillus salivarius
  isolated from gut, Lactobacillus salivarius
atgagtaaatggaacagtattaaaatcgtaaaaggctcaggtggttggggtggtccaatcgttgtaacaccaacagaagaaaaacataaagtagtttatgtaacaggtggtaacagaccagatattgttgatacaattgttgaattaacaggtatggaagctattgatgggtttaagacagcaattcctgatgaagaaatcgcattagcaattgttgactgtggtggtactttacgttgtggtatttacccaagtaaaaatattttgacagtaaatgttcttccaacaggtaagagtggtccgttagctaaatacattactccagaattatatgtatctgctgtaactccaaaacaaatttcattagtaaatgctgaagacgcagaagcaattgttaagcaacaaaatgaaaaggttgccaaaaaagaaaccgcagctgataaagaagacggaatagatacttctaagacattgacacaacaaggtcacggtggcggatttatcgccaagattggtattggtgtaggtaaagttgttgctacatttaatcaagctgctaaggaatcagtacaaacagttttgaatacaattattccatttatggcattcgttgctttgctaatcggtattatcatgggttccggtattggtaactggttcgctaaaatcatggtacctcttgcaggtaacgtttggggcttgatgattttaggtttcatttgttcattgccattcttatcaccattgcttggaccaggtgctgtaattgcacaagttatcggtactctaattggtgttgaaattggtaaaggtcatattcctccacaatatgcgttaccagcattgtttgctatcaatactcaaaatgcttgtgacttcattcctgttggtttaggtcttgaagaagctaagccagaaacagttgaagttggggttacatctgtattgtactcacgtttcttaaacggtttacctcgagtatttgtagcatggttagctagtttcggattatattcaggaaaataa

SEQ ID NO: 227 - DNA, 1074 bp, Lactobacillus salivarius
  isolated from gut, Lactobacillus salivarius
gtgctaaaagaggtggttggtttgctaactgaaagacagttgttgattttggaaacaataatccgagattatactgatttaggacagcctattggttctaaaactttgcaagaacaattacctatacgtgttagttcagctactattcgaaatgaaatggcagttcttgaaaaacaaggttttataactaaagagcactctagttctggtcgaattccttctcttaagggatatcgttattatgttgataatttagttaaacccgttaaaatagattcgaaatctgtaagaagtattcaatctctatttggaaatgaatatcgtagagttgatgaaataatagaaatgtctgcaaagatattgtctgatttaactaattatacggcgataactttgagaccagaagctagtgatttaaaactcgaaggattcaggatggtaccattaggaaatggccaagtaatggttattctcgttgccagtgatggatcagttgaaagccaaatttataatttacctaataacatagatggagagtctctagaagctgttattaggctaattaatgataaattggtaggttcttcccttagtgaagtcacttctaaactacaagaattgcagccgttacttactaaatatattgaaaaatctgatggatttatcgatgtatttggtggaatcttagataaagctatcaaagagcagttttatattggtggaaggcgaaatttgttgaattttgctaacggtaataatttagaacagatcaaatccctgtattcattaattgacgatgaatcagataagattggtgggttagtagataatacgactaatccacacgatcatcatggaatttcggttaaaataggcgatgagatgtctgataggttattgttagattacagtcttgtatcggcaacttacaatgttgggagtcatggtcgaggcatgattgctattctagggcctactaacatgccgtattctaagatgataggattggttgaagttttccaaaaagagctaactaaaaaattaattgattattaccgaaattttgataagtga

SEQ ID NO: 228 - DNA, 1182 bp, Lactobacillus salivarius
  isolated from gut, Lactobacillus salivarius
atgcaaatttcacaaagagctaaaaatatacaaccatctgcaacgcttgcactatcaactagagctaatgcaatgcgtgctgaaggaattgatgtaattaatttaacggtaggagaacctgattttcaaacacctaagaatataagagatgctgctattgttgcaattaatgatggaaaagcagattcatatactcctgtattaggtataaaggaattgagggaaaaagtagcagaggttactaacaaagattacaacactaactttacgagtgataatgttgccgttacaactggtggaaaatttgctttatatgctatagcacagtgcttgctaaatcagggagatgaagtgattattccactcccatactgggtaagttatggtgagcaaattaaattatcggatggaaaacctgtatttgttaaaccaagtaagggactaaaagtaacagcatcagatttagaaagtgctagaacagacaaaacagtagcgatgatcttaaattcaccacaaaatccatccggtttagtatatacaaaagaagaattggaagaaattggaaattgggctgtaaagaatgacatagttataatttgtgatgacatgtatggaaagttggtttataatagtactcggttcgtatcattaatggatttaagcgatgatattagaaaacagacaattttagtaagtggattatctaaatcttatgcgatgacaggctggagagttgggtatgcggtagctgatgcagagtttattaaaaagattgctgcagtagctggacactctacaagtaatttgacagcagttagccaatatgcagctttagaggctttaaatggtgatcaaagtagtgtgtcaactatgcgagaggcttatgaagaaagattaaataagatctataaagaacttaaaggaattccgggatttgtgtttgattcaaaacctcaaggagctttctatctatttcctaatgttgctaaagcggcagagttggtaggttgtagtaatgtctctgaatttgcagaatttttattagagaaggcacatgttgctgtggttccaggagttgcatttggaatgtctgattacattagaataagttatgctgcaagtttagatgatcttgaagaagcggtaaagcgcattaaaatgtttgttgaagaaagaaaatag

SEQ ID NO: 229 - DNA, 621 bp, Lactobacillus salivarius
  isolated from gut, Lactobacillus salivarius
atgacaaaatcagagaaacgtcaacatgatattcttcgttatatattttcacatgtatctgatagtggctacccacctactgttcgtgaaatttgtaacgctgttggtttatcatctacttcaaccgttcatggacatctttctaagcttgaaagtaagggcctcattaaacgcgatcctactaaacctcgcgccattgaaattactttagcaggcttagaaatgttggatgagttacctaacaaaactcaaattcccattgtaggtactgttactgctggtgaacctattttagcagttgaagaaaatagagattattttcctctaccaccttattttgaatctgctgatgatcttttcatgttatctattcgtggcgagagtatgataaacgctggtatcttagatggtgatcaagttattgttcgtaagcaatcttctgcaaataatggagaaatagttattgctatgactgaagagaatgaagcaacttgcaaacgtttcttcaaagaagatggatattaccgattacaacccgaaaatgatacaatggatcctattatcttagaaaatgtaactattttaggaaaagttgttggattatatcgtgatcttatttaa

SEQ ID NO: 230 - DNA, 1488 bp, Lactobacillus salivarius
  isolated from gut, Lactobacillus salivarius
atggcaactttgtatcgtagtacacgtgacgcttcagctaatagtatttcttcgtctcaagctgttcttcaaggaattagtcccgatggtggtttgtttgttccggttgattttcctaaattagatctagatttatcacaattaccattgctatcctatcaagaattagcttataaaattctccaaccttttttcagtgactttaccgaagatgaattacgttcatgcatcaactctgcttatggtagtaattttactagtaaggagattactcctgtttcctatcatgctggcaatatttaccttgaactatttcatggccctacaattgcttttaaagatgttgctctgcaattattgccctacttattaataacatcagctaagaaaaataactctaatctggagaacgtcatcttaacagctacttcgggcgatacaggtaaagctgccatggctggattcgcagatgtagaaaatacgcaaattattgttttttatcctaaatacggcgttagccctattcaagaaaaacaaatgcttacacaaactggtaaaaatgtctatgtggttggtattactggtaatttcgacaatgctcaaacaaatgttaagcagatttttaataattcaactttaactgatgaattactaaaaagtggttatcaattctcatcagctaactctattaatattggtagattattaccacaaattatttattacttctatgcttatggacgattattagctgataataaaatcaagttaggcgataatgttaatttcagtgttccgactggtaactttggtgatattttggctggattcttcgctaaaaaacttggcttacctattaataggctactatgtgcatcaaatgaaaataatgtcttaactgaatttttcaaaactggtacatataataagaaacgtgatttcaaagttacaaactctccttcaatggatatccttgtatctagtaacttggaacgtttattattctacgctacaaatggaaatgcaactttagtggctgaatggatgaaccaacttgaaaaagaaggtaaatatactgttgactcagatacacttaaattccttcaaacacatttctacgctggttcggcaagtcaaactgatactaaaaatgagattaagcaagttttcactgagagtaattatgctatcgatcctcatacagctgttgcttcctttgttactcgagaatataaagaatcaactaatgatctttgcccaacagttacagtatctacggcaagtccgtataaatttccacaaacagttctagctgctttaggagcagataatgcgactggagatttagatgacgtacaaaaattagttgatttaattaagctacctctacctaagacagtcgctaatttatttaaagctaaacaattacatgatactgttattgaacctgatgagatggaaaaatatgttaaagaattactgatttaa

SEQ ID NO: 231 - DNA, 1131 bp, Lactobacillus salivarius
  isolated from gut, Lactobacillus salivarius
gtgggaactactttaggtataggtggaattcagagagtaatttcactttttgcaaatgaattagctaaaaggcatgaggttacaatttcttctttcgatacgcctgaaaaaatatctaattcaagttacaaattagataaaaatataaattttgttgaatttccaaaaagcaaaattgcgtctaatattctttatagaattatgaggaaaatactatttaaagttgtaaggaacgacaaatttttagagaggatagattttcctaaatttatgcgaaaaagactggtaactttttttaatcaaggtgaatatgatgtcgtaataggtgttgcttggcttcacagtctttggctagcaatggttactccagaaataaaagctagaacgataggttggcaacacaattcatatgatgcttatttttgtacacctgggcgatatgcctggaagaaagataatctttttagaaagtatctttcaaaccttgatgaatatgttgttttgaatgaaataactaaagaaaagatagatgctaactttggaattgattcaactgtcatttacaatcctaagagttacatttctaaagaaaaatcagacatgagaaataaagtctttctagcagctggccggatggtttatgccaagggagttgatactctggtcgaagctttcaaaatttttgctcaaaaaaattcagattggaagttattgctagtcggtgatggagaggaacttccaacaataaaagataaaattaaagaatatgggctagagaaaagaatccttactcctggaaaaactagtgatataaagaagtacttcttgcaatcttcggtattacttttaccgtcaaggtgggaaggaatgccaatgatagtgcttgaatcacttgaaatgggatgtccaattgttgcatttgatattgatgcaatgagactcctagttactaatgggattgaaggattgattgttaaagaaaaacaagatgccaatgcttatgctcaagcaatgttaaaaatagctgaaagtgaagatttacgaaagcaaatgcatcaagcagcacttcagaaagcaaatcaattttctgtaggtaagataatgagtgaatgggaaaagatacttaagtaa

SEQ ID NO: 232 - DNA, 1332 bp, Unknownn
  isolated from gut, unidentified
atgacggaacaatatgatgtcgttgtaattggtggtggcccggctggtaacgcgatggcaagtggcttacaggcgcaaggtaagtcggtgctgatcgttgaagctaacttatggggtggtacttgtccgaaccgcgggtgtgacccgaaaaaaatcttgttgagcgccgttgaagcccaacaggcagcccaacatctccagcatcaaggcttaacaggaacaccgacgattgattggccggccctgatggcgcataaacgaggctataccgatggcattaatgatggcacgcttaaggggctgcagcaccaaggtatcgcgaccttacatggtcaggcccattttcaaaacgacggccagctagcagtcggtgaccaagtcgtaagtgcgacggattacgtgattgcgaccggacaacgcccagcaattttgccgattaccggacaagaatatttcaagactagtacggactttttagatttggatgagatgcctaagcgcgtgactttcgtgggtgggggctatgttggcttcgagctggcagcgattgcgaatgctgccggcgccgatgtccacgtgattcatcataatgaccggccactcaaagccttcgatgcggaccttgtccaagatttgatggcggccatgactgcggacggtgtcacttttgacttgaacacggacctccaagccatcgaacagaccgacgccggcctgcaattgacggcacctgactttgagctgacgacggacctcgtgattagttcagcggggcggattccgaatgcggaccagttaggactcgaaaacgtcggtgtcacgtttaaccgtcacgggattcaagtgaacgatcgactacagacggctaatccgcatatttacgcgattggtgacgtgagcgatacgcccgtacctaagttaacgccagtagcgggttacgaagcgcgttacttggttcaacaactgacccagccgggagcggcaatcacgtatcccgtcatcccgacccaagtctttgctgcacctaagctagcacaagtgggccttagtgcgacggatgtggctgaccagccggataaatatcgcgtgaatacgctggatatgaccaaatggttctcttattaccgttttggcgcacgacaagcacaggccaaggtcattattgatcaggctagcgggcaagtcgtcggtgcgacactgttgagtgatgtcgcggatgaaatgatcaattacctgacgttactgattgaaaaacacgtcactttagcccaattacaacaactcgtattagcctacccaacaccagccagtgacctgcagtatctgtactag

SEQ ID NO: 233 - DNA, 2196 bp, Lactobacillus salivarius
  isolated from gut, Lactobacillus salivarius
atggtagatttaattacagtagataaagaaaatcgagtttttcatttgcataatgagcaactgtcatatattttttcaattgaagatggcgatacgattagtcatttgtattttggtaaaagggtaaaaagttatcatggacaattacgttatccacgagtagatagaggattttctggtaatttaccaggtagtttagatagaaccttttctaaggatactttgccacaagaatatagtagtgccggtgagatggattatcgagttccagcaacagtagtgcgtcaaaaagatggctcaaatggattaatgctaaaatataagacttacaaagttgaagaaggaaaacctgaattgacaggacttccagcagcttatgtagagtcagaatcggaagctaatactttgatcgttacgcttgaagacgagaaaagtggagttttatttgacttactatatacaatatatcgtgattatccaattattacacgttcagttaaggttaagaatctaggacaagaaaatgtaaacttggagaaagttgcatctatgcaaatagatttttctcaacgagactttgatgtaattagtttaccaggagcacatgtaaatgaacgtcatttggaaagacaaaaattaggatatggaatccaaacatttggtagtattcgtggtacttctagtcatcaaatgaatccatttgttgccttggttgatagtaatactgatgaattcaatggtgctgcatatggttttgcgttagtttactcaggaaaccatgcttttgaaattgaaaaagatcaacttgatcaagttcgattattagtaggaattaatagttataatttcaattggcaattaccagcaggggaaagtttccaaactccagaagtattaatgacatatactgataatggattgaatgctatgagtaaagcatttcatagtattatcagagatagaattacacgctccaaatataaatataaggaacgcccaattctagttaataattgggaagctacatattttgactttgatgaagataaattaaagccaatcgtagacgaagccaaggaactggggatagagatgtttgtattagatgatggatggtttggtcatcgcgatgacgataattcatcattaggtgattggaatgtatacgagaaaaaattccctcaaggcttaaaacattttgcagattacgtacacagcaaagatttgaaatttggtatttggtttgaaccagaaatgatttcaatggattcagaattatatagaaatcatcctgaatatttgatgcaagttccaggaagacaaccaagtccatcacgtaatcaatatattttagatatgacaagaaaagatgtcagagatgacatagttgatcaggtttcaactattattgctgataatgacattgactatgttaagtgggatatgaatcgtaatttatctgatatctattcacaaaatctacctgcagatagacaaggtgaagtttatcatcgctatgttctaggggtttatgatattttagaaagaataactagcaagttcccagatgttttatttgaaggttgctctggtggcggtggacgatttgatgcaggttttgtttactacatgccacaaagctggactagtgataatacggacgcgattgccagattaactattcaatatggtacaagtttagtatatccaccatcaatgatgacagctcatgtgtctgcagttccaaatcatcaaactggtagagtgacaccaatcgatactagaggtgcagttgctatgagtgcagtctttggttacgagttagacttaacaacattaacagacgaagaaaaagaaattgttaaaaaacaagtaaatcaatacaaaggtattagaaaattagtccaatacggagatttctatcgtttacaatcttctaaagatggaaataaaacagcttggatgtttgtaagccctcaaaaagatgaagcagtagtaatggtatgtaaagttttagcagaagctcaacctgtattaacgaaaactaaattatatggcttggataccaataggaactaccgtgatgttgaaactaataaggtttatggtggcgatgaattaatggaattaggattctatgatcctattatccgtaatgactatgctgctacaatgtatcattttaaagctgaataa

SEQ ID NO: 234 - DNA, 930 bp, Lactobacillus salivarius
  isolated from gut, Lactobacillus salivarius
atgttactactagctttaattcctgtttttatgggaagtggactagctatccaaactgcaattaattccagactaggtagtgtatctggctcttcctttcttgcttcaatgatttcatttgtagttggggctatctttttaaatgttctgctcatacttacaggtacttctcctttagtaagtacgaccacgattactagcaacccttggtggatttggctaggtggtgttttgggagtaattggtttaactaccaatattttgctttttcctaaattaggtagcgttcaaacagctgtactacctatctttggacagattgttatgggacaaattattgatcaatttggtttgtttaaatctccaatctctaaatttactattatcaaactagttggtttagtgttggtggcaggtggtatgctactagcaacaggatctttcatgcctaaagataaaatggctaaaaagcaacatcatttactaccttatcaattattaggaatattcgcaggtgttttaatggctactcaaactgctattaacggtcacttaggcgttattttaaaatcatcattacatgctgcgatgatttcatttactgttggtgctctattgctaataattattgtactgatccttcctgtacagatttcaaatttaaagttagcttaccaagattttagtaagcaatggtggctttggattggaggatttttaggtgccatatacgttctaggctgtgcttggctagttccacaaattggcaccggtcaagtaattgtattggtattattcgggcaacttttcttcagtgcaattattgatcaatggggcctacttcattccaaggttaatcctattaatctaatgagaatcttaggccttattactatgtttattggtgtagtcgtactgcactttatctag

SEQ ID NO: 235 - DNA, 807 bp, Lactobacillus salivarius
  isolated from gut, Lactobacillus salivarius
atgataaagcatatatttacagatatggataaaacattgttgaatgataagggacaaattaatcctaaaacagcagaatatctacaaaagatagatttgccattaactttagtaactgcacgtgctcctaaagaaatgcagtttgcgattgatgatttaaatttaaaaggtgaacaaattgcttttaatggtggattgatattcttcccacataaagatggaaatgaagtaatttcttctaatccattacaagcagaagctgccaagcgagtaattgaagaaattcaagacaaatatgatggtgtatcagtaagttggtataccaaggacgagtggtatgctcaacaagaagatgatggtacaaggtatgaaacaagtattactaatattaagccaactttgaagaagtacagtgaaatcgactataccgaacctatttataaaattatgattgttggaacaaatatggaaaacttcgataaagttgtagatataattagaggaatgaaattagatggcgttagcgcaaatcattctaactataattactttgaaattactaatgaagttgcggttaagagctttggaattgagtacattagacaaagagataacttaaagaaagaagaattgttagcatttggcgatggagaaaatgacattaagatgttcgaaacagttggtacttcggtagcgatgggaaatgctaacgataaagttaaatcaattgcgacatataccactctatcaaatgaagaagatggaattgttcatggtttagaaaatgtcgttaagcatttactataa

SEQ ID NO: 236 - DNA, 1779 bp, Lactobacillus salivarius
  isolated from gut, Lactobacillus salivarius
atggcgacacaacatattgaaaataaattaaaactattaccagatttacctggctgttacatgatgaaagatatcaatagtagaattatttatgtaggtaaagccaaaaatttaaaaaatcgcgtacgttcatattttaaaagtagtcatgagggaaaaacagctaaattagtgtctgaaataagggattttgaaacaattattacttcaaccgataaggaagcatttttgttagaaattactttaattcaaaaacataagccttactacaatattaagttaaaaaggggaactgggtatccgtatattaagataactcatgaaaaagacccacaattaaaaattgtcagtcaagttaaaaaagatggtggctattattttggcccttatcccaatgtctatgctgcaacagaaacactacagttattacaaaaggtgtatcctttaagacgttgtaatggatatcaaaaacgaccatgtttgtactatcatatgggacaatgcttgggtgcttgttttaaagaagttccacaatccgagtatgaaaagcaaatcaaaaagataaagtcgtttttaaatggaaatgtaagtaaaataaaaaaagaacttgaacaaaaaatggaaactgcatccgagaatctagagtttgaaagagcagctgaaataagagatcaaattcactatgttgaaatgacagttgaaaaacaaaaaattattagtaatgataatacaccacgtgatttatttgctttttacatgaataaaggttggttatctttacaaattttctctatcagacaagcacgtttgatgaaacgtgaaaaacgactatttccatgtatagatacgcctgaagctgagttagaatcttttattttacagttttataatcaaaaaaaccgtattttacctaaagaaattttagttccttcagggatggataaagaaacattaagtgaaattttaggtattccagtcaaaacaccacaacgaggacaaaaacgcgatttactagaaatggcacagaaaaatgctaggttagtattggaagaaaaattccgtttacttgaattggatgaaagaaagacaactggggctatgaatgaaataacagatgcgttaggattgcctaatggtcatagaattgaagcatttgatcattctcatttacaaggagaagatttagtatccgcgatggtttgtttcattgatggaaaaccagaaaaaacagaatatcgaaaatataagttaaaaaatgttgaccatgctgatgaagctgctagtacaagagaagttatttatcgtagatatagtagacttttgaaagaaaaagccaatttacctgatttaatattaatggatggtgcaagtattcaaattaatgccgctgttgatgtgttacataatcaattaggtattgatattcctgtagcaggaatggtaaaaaatgatcgccataaaactgctgatttaatgatggaaaatgatgaaaagattggtttagatcctaaaagtgaaggcttttatctactacaaagaattcaggatgaagttcatagatttgcgattactttccatcgccaagttcgatcaaaaaattcattagcttcacgcttagaaagaattcaaggagtaggtcctaaaacgagaattaaattattaagaaattatggttctctgaagaatatttctgcagcttcagtagaggatttggaaagcttaggtatttctaaaaaagtggctcagacaattaagttaagcttgaaaaaccaaagttag

SEQ ID NO: 237 - DNA, 1194 bp, Lactobacillus salivarius
  isolated from gut, Lactobacillus salivarius
atgaataatctatggaagaagcgattaaacctgtatctaaagcgaatgatcaagtactatcgctatgtattcaatgatcattttgtaattgcgttactctttttactgggtggaataagctacacatactctaatttcataaagtccttaaatgtagatctatcgtacccatgggccaagccggtagtaatcattgccttgcttgtgatgttgcaatttggaaaggtagggacattaattgatgagcctgataaagtgttccttttgccacaagaaaagggtatgagagagtatttgatgaaagcacaaaagcgagcttgggtgtcaaacagcgttattcaaatcgttgtctggatcgttttactgcctttcatttactacggtgtccatttaaacttagtagaaagcataatcctattattaagtcaggtagctttaaaggttgcccaggtaaacttattctttatccgagcctttgaagcgaagtatcaagcaggcaaatatagtcttatccttaattatgtggtacctttaatcgtttatacgcttggcttgtatgcatccatatatttcgcattggggattaccgttgggctaattctgtatttgaaatcattgcctaaaaataaaatcattcaatggaattatttgatagacgtagaaaaactaagactgatgagaaaatacagtttcttcaacctatttacagatgttccccaagtaaagaagaaagctaagcgtagaaagtacctagactggctcatacctaagtttaaaaacgtatatggctacctattcattagggcaatcatccgaaatggtgaatatagtggcctgtatgtacgcctaaccgttatcgagttcattgtcctactctttatccctaaattctggcttagcctggtaataggaatgttgttcatctacttaatcggtttccaaatgttaccactatacaagtactttgacgataatgtattcgtacacctatacccactcgaaaccaacagcaaaggcaaagaattcaaaagcattctattagctttattgataatcaatgcctttatatcagccatagccgtatatatcgctatccaaaacctactactctcaggagccttccttgcccttgtattagtcgaaagcatcctgtttgtttatggatatgcaaatttaagattagaaaaatcttga

SEQ ID NO: 238 - DNA, 555 bp, Lactobacillus salivarius
  isolated from gut, Lactobacillus salivarius
atgttaaaaatcaatgttcgtggtgaaaatattgaagttacaggagcaatccgtgaatacgttgaaaagagattagcaaaattagagaagttctttgataatactgctgattcaacggctcacgtaaacttaaaggtgtactcagacaagactgcaaaggtagaagtaacaattccattgccatatcttgttttgagagcagaagaaacctcacctgatatgtatgcaagtattgatcttgttacagataaacttgaacgccaaattagaaaatacaagactaaagtaaatcgtaagtctcgtgaaaaaggctttaagaattttgaatttgcacctgttgcagatgaaaaagaagaagtagaagataagaagtttgaaattgttcgtactaagcgtctatctttgaaaccaatggacagcgaagaagctgtattacaaatggacatgttaggtcatgacttcttcatttatgaagatgcagaaaatggtggtataaatattgtatatcgtcgtcgcgatggccgttatggtttaattgaagctagtgaagactaa

SEQ ID NO: 239 - DNA, 2136 bp, Lactobacillus salivarius
  isolated from gut, Lactobacillus salivarius
atgttcaagaacaaatttttcataaaaaagctaaatggtataaaacacagaggtatgaatagaatgaagaaaaaattattcattgcgattttatcaatgttagttttgatgatctcgttgtgtacacaagttaaggcagatgacatgaagagttatacgcaaccatttcaaaattcaacgcaaactctttcagggaaatctgtgtcagataatacatattttacaaaaatcgattactgggatgttaagaaagcaactttgaacttgagttaccaagtttcacaaattgctgatgatcaaacatctgacattacagtatcaattaatggggttaaattttactcatttagacctgaaataaaagatggtgttcaaactaagcaaattgatattcctctaaatttaattaagggggcaaataatcttaaaatttacggacaaattttgaataagtctgataaatcaacggttagtgtacaaacacctgctaactggttaacaatttatgaagagtcaaatgttaacttccaatataatttgaagcaaccagattattatttaaagtctttctataaccatttttcaggggcagatacaatttcatttggacaatctgttattgcagttcctcaacagcctagcgatgctgagttgtcagctgcaacttatgctttaactggggtaactagaacaatcgcaacagatacagacaaagttagaattttaccatacaatgatggtagagttaaggatgcagattatcgcgttattatcgccaaatatgacaatttacctaagaattataagagtaagttctctgtagataaattgaagaatcgtggttgtttaagattagtgtatagtaagaataaatacacattgataataacagccttagatgatgaaatgttgcaaaaagcaactcgttttatggctaatacagaattaatgacagaaactaaaaagccagttaagtatgtaagctctaagacagcaacttatatgtcaagtttacattacgatggaagttaccaattgactaatcaaggagcaactttaactggaagtggacatcacgaagaaacattttttgttgctttaccagctagtcaaagcaactcctatggtagtaaggtaaaattgagtttgaagtattcaaagaacttgaattttaataactctttagcaactgtatatatcaataaccgcaacattggtagctataagttaactaaagataatgctgataatgatgaactaaccttcaatattcctaataatatgaagataggcagtggtttctctgtcagggtagcttttgatttagaaccaagtcaaattactaagtcagacaatagtgagacaccttgggcagcaattaatactaactccaagatttttgtcaagtctattgaaaagaacgatatcctattttcaaattatccaagtttattcattagaaacaacacttatagtaatctagcagttgttaagcctagaaagatgacaacaaatgattttgaagcattgtctaatattttcaatttgattggtatctatgccaagagtaatactggaaaaattgaattctatagtcaacaacctgatgatgaaacattaaagaacagcaatgtaatcgtattgggaacacctagtcaaaattctatgattaagaatttaaatgacaaactttatttccaatacaataagaaatatacaagctttatttctaatgaaaaattgagtatcgaatatgattacggtaagacaatgggtacagctcaattattgcgttcgccttacaatgataagagaggtatgttagttgtaactggtatcacatctaaagacgtttatctagcttcaactcaaattaattaccaaaagacaattgttgaacatggtggcgatgcaattgtagttgataatgataataatatttataattatcgtttcaagaagaaagctgatttagacaagaaggtatctttgaaacaaacaattcacaagaataccaagttgatcatttatttagtaattgctttaatctttgttgctttgctagctgcagcaatctttatggttctatggaaaaataatctgttaagaaaggataaaaatgatgagaagaaatga

SEQ ID NO: 240 - DNA, 2094 bp, Lactobacillus salivarius
  isolated from gut, Lactobacillus salivarius
atggcaaacaaacgtgaattcccattggaaaaaacacgtaatatcggtattgttgctcatatcgacgctggtaagacaacaacaactgaacgtatcttgtactacacaggtaagattcacaaaattggtgaaacacacgatggtgcttcccaaatggactggatggaacaagaacaagaacgtggtattacaatcacatctgctgctacaacagctcaatggaaagaaaaccgtattaacattatcgataccccaggacacgttgactttacagttgaagtagaacgttcattacgtgttcttgatggtgcggtagttgttttagatgctcaatctggtgtagaaccacaaacagaaaacgtttggcgtcaagctacaacatacggtgttcctcgtattgtttttgttaacaagatggataagattggtgctaactttgattactctgtaagcacaattaaagatcgtttacaagcaaatccattgcctgtacaaatgcctatcggtgcagaagatagctttgaaggtgttatcgacttaatcgaaatgaaggctgacttgtatgatgaagacgaattaggttcaaaatgggatacagttgatgttccagatgaatacaaagaagatgcacaagctcgtcgtgatgaaatgatcgaagctttagctgacgttaatgaagatatcatggacaagtatcttgaaggcgaagaaatcagcaacgatgaaattcgtgctgcaattcgtcaagctacattgaacttagacgtattccctgtatttgcaggttctgctttcaagaacaaaggtgttcaaatgatgttagatggtgttaatgattacttaccatctccattagatgttaagccatacaaggcaacagatcctgaaacaggtgaagaaattgaattgaaagctgacgactctgctccattcgcaggtttagcatttaagattgctacagacccattcgtaggtcgtttaacattcttccgtgtttaccgtggtactcttgaagctggttcatacgtattgaacgctacaaagggtaaacgtgaacgtgtaggtcgtttactacaaatgcactctaaccaccgtaacgaaattccagaagtattctctggtgatatcgctgctgctattggtttgaagaacacaacaacaggtgactccttaacagatcctaagacaccattgattcttgaatctatggaattcccagatccagttatccaagtttctgttgaacctaaatcaaaagcagaccaagataagatggacgttgctttacaaaaacttgctgaagaagatcctacattcaaggctgaaacaaaccctgaaacaggtgaaacattgatcgccggaatgggtgaattacacttggatatcatcgttgatcgtatgaagcgtgaatttaacgttgaagctactgttggtgaacctcaagttgcttaccgtgaaacatttacaaaacaagtatctgcacaaggtaagtttgttcgtcaatctggtggtaaaggtcaatacggtgacgtttggattgaatttacaccaaatgaagaaggtaaaggtttcgaatttgaagatgctatcgttggtggtgtagttcctcgtgaatacattccttcagtagaacaaggtttgaaggaagctatgcaaaacggtgtattggctggttacccattaatcgacgttaaggctaagttatatgatggtagttaccacgatgttgactccagtgaagctgcatttaaggttgctgcatccttagcattgcgtaacgctgctcctaagggtggtgctgtaattcttgaaccaattatgaaggttgaaatcattgcaccagaagataacttaggtgatgttatgggtcatgttacagctcgtcgtggacgtgttgaaggtatggaagcacgtggtaacgcacaagttgttaacgcatttgttccattggctgaaatgttcggttacgcaactgtattacgttccgcaacacaaggtcgtggtacatttacaatgacaatggatcactacgaaccagttccaaagagcatccaagatgaaattattaagaaaaatggcggtaacgctgaataa

SEQ ID NO: 241 - DNA, 861 bp, Lactobacillus salivarius
  isolated from gut, Lactobacillus salivarius
atgagaagaaatgagaattatagtttaaatactgatatttatattatcttgttgttagtttgttcaatcatgacagctattttcgttggaatttcatctaatttgatgattttgaattgtgttttcttagcaattacttgtttcttagtattgattacttattttctcggtttattagctggattaatctttaatttactgtttgtctttattcaaggaagttacgttttatatgcagatgtggtcttaggaaaagaattagatttatggttaattgtctggatttttttaccactgatttggtcactattagtaagctttatgacacgaaatcttcaaaaactacaagaagaaaatctaagtcttagagaaagtaatgcacgtaatctgggatataatagtgagacagacttgcgtactatgagatcttatcgtcaagatgcagaagtgtttattgaaacgcataaacgttttgatattcctgtttcaacgggaataatttcaattcgttacttccaccaaattatgaatattttaacagaagaacaacaacatcatttgatcaaaagattatcagatattttatctgagagttttagaaataatgatattgtctacagtattgatggcgtaggtggtgtgcctcaatggggagtgctattatttgcagattatgatggagcgatggtagcgatggatagaattaagcaaagagtaactactttactacatgaagatgaggaattaggaaagtatgatattcaaatttctatcggagttgttgaatacaatgaagataagataaagagtgtcagccaatttattgactctgctcaacatgtacttcaatatgacgtttag

SEQ ID NO: 242 - DNA, 1338 bp, Lactobacillus salivarius
  isolated from gut, Lactobacillus salivarius
atgcaaaatactgtttattcagtaagacgtgaagtttccggttatatcgtgaaaaatatcttcgcatctttaggaatatcattatacgttttggttgatactttatttatagctcttgcagctggttcaatcggtcttgcaactttaaatattgtattgccgattttcaatctttttaactctttagggttgcttttaggtgttggtggtgccgctattttttctttaaataaggttcgtcaccctgaaagaattgaaggactttacagtgaactcatcattttttgtgtgggattaggaattctctttgcaataattggaaatctttttcctcatcaaattttgactttaatgggtgctaatcaacaaaccatcaatatggcaaccacttattttcgtattgtttcctgtggtgctccattgtttatggcaaattatgttactattaactttgttagaaatgatggcaacccctcgctaacaatgcgggctgctttaacacaaacagcttttgtaatattcatggattggcttttaatttttgggttaaatttaaaaatggaaggtgctgctttagcaactattttttctcctttaactagtctaacggttttaagtagacatcgccattttgcacaacgacaattaaaactttttaaaaccaaagtccatctcaaaacggtcctaaaagctgctcgattaggtattccatctttcttgaatgaaatgagtactggagttagcatttttgttttcaacttagtacttctaaagttaggtggaaattatgcgattgctgcttatggagttattgctaatattgggattgttttcttagcaatcttcaacggtgttgccttaggggtacaacctattgctagtcgcgagtatggtaaacacttataccaaaacgtaaaaattgctttaaaaattggattgcttgttactttttcaatagctataatcagttatttcttacttcttatttttaaagctcctattgtcgatattttcaacgctgaacacgaagctcaacttgttgcttatgcagttaaaggtattcctatttactttattagtatcttttttagttgtctaaaccttgttttaatgctatttttagcagctattaacgatgctagaggtgcctttttcttgtcgattttacgtggatacatcatcctattgccatcaattattatttttgcttactttggtggcatagctggtgtctgggcaagtgttccatttaccgaatttatcgtagcaagcttaggtatatatctaactaatagaaaaatttctactatgcaaataagaaaggaatctttattgtga

SEQ ID NO: 243 - DNA, 960 bp, Lactobacillus salivarius
  isolated from gut, Lactobacillus salivarius
atggaggaatttatcatggaaacaaaaaaattgtcagtatcattgcctggattagaattaaaaaatcctatcatgcctgctagtgggacttttggcttcggcgatgttccaagcgctaataaatattctttggatacattaggagcattggttataaaaactactactccagaagctagaaccgggaaccctgatcctaaaatttcagtaattgaagatggagtcttaaatgcagttggtcttactaatcctggtgtagatgtagtagtgtctgaaaagttaccagctttaagagaaaaatatcctgaactaccaataattggaagtgttggtggagcaacagaggatgattatgttgaagtagctactaagttgtcacaatcaggaatggttaatgcattagaattgaatatatcttgtcctaatgttcatgagggtggtatggcatttggaactgttccagaagttgctgaaagattaacaaagaaagttaaggaagtttcaacagttcctgtttatgtaaaactctcacctaatgtaacagatatagtggctattgctaaagctgtggagcgtggtggagcagatggaataagcatgattaatacagttttaggaatgcacatagatgtagcgtcaggtaaaccagtacttggtaacattatgggtggtttatctgggaaagctgtaaaagcaattgcgattagaatgatctatcaagtcgctcaaaatactgatttgccaattattgggatgggcggagtagaaacagtagatgatgtcttagagatgtatatggctggtgcttcagctgttgctgttggaactgcacatttccatgattctatgatttgtccacatttgattgaagaacttccaaagagaatggaagaattgggaattgaaagccttgaggaattacgtttaaatgtgaaaaaacgtggagcgttcaagctttaa

SEQ ID NO: 244 - DNA, 957 bp, Lactobacillus salivarius
  isolated from gut, Lactobacillus salivarius
atgtctatagtagaagaaccgtatttacagttaattcgtgatattttagaaaaaggtcatgaaaagagcgatagaactggaactgggacaaagagtctctttggttaccaaatgagatttaatttagcagaaggtttcccattattaacgactaaaaaagttccattcggcttaataaagagtgaattgttatggtttttaagaggagatactaacattagattcttattggaacataataatcatatttgggatgaatgggcatttaagaattgggttcaaagtgatgaatatcatggaccagatatgactaattttggtttaagagcccaagaggatgatatctttaataaggtttatcaagatgaaaagaaaaagttctgtcagaaaattgttgaagatcaagaatttgctaataaatttggcaatttgggagatgtatacggtgctcaatggcgtcattggcaaacaagaaatggtgaaactatagatcaaataaaagatgttattgagactattaaaaataatccagactcacgtcgcatgattgtaacagcatggaatccagaagatgttccattaagtgctttaccaccttgtcatacattgttccaattttatgtaaatgatggaaaactaagttgtcaattatatcaacgttctgcagatgtatttttaggtgtaccttttaatatagcaagttatgcattgttgacacatatgattgctagagaaactggacttgaagtaggagaatttgttcatactcttggcgatgcgcatatttacttaaaccatctagatcaggttaatgaacaattgcaaagaaagcccaatgatgctccaacattatggttaaatccagaaaagaaaaacattatggattttgaaatggaagatattgaggtaaaaaattatcattcacattcagcaattaaagcgccagttgctgtttag

SEQ ID NO: 245 - DNA, 1176 bp, Lactobacillus salivarius
  isolated from gut, Lactobacillus salivarius
atggtagatttaacaaaatatatgaagaaagaattagaattagttaagccatctgaaattttagcatttgctcaatatagtagcaaaattccggatattacaaaattcacagtaggagaaccagattttaatactccagagcacattaaagaagctgctattgcgggggttaaagccaaccattctcactatgctccttcaaatggaacgcttggtttaagaaaagctgcagctaatttcttaaaagaaagatatggattgaaatataatcctgaaaatgaagtgattgtaacaaatggtgcaactgaagctatttatacagctttgacttcagtattgaatcctggggacaaagttgtagtaccaactccaattttcccattatatattgctgatgctttattagtaggtgcagaaccaattcttgttgatacatctaagaatggatttaaattatcagctgacatgttaaaagaggtgttagatgaacatggtgatgatgtcagagtagtagtcttaaattatccttctaatccaactggtgttacatatagtcaagaagaattggatgaactagctgatgttatacgtgataaaccaatttttgctttgtgcgatgaaatatatagcgaattatgttatgaccaagaacatgcatcattagctaaaagtctatgtgaacaagcaattgtattgaatggtgtatcaaaatcacatgcaatgacagggtatcgaattggtattatgactgcacctgcagagataacaaaagaattatctaagattcatcaatttacaattactacaacaacagcgattgctcaagatgcagcccaagaagcctttgaaaatggcttgaatgatagtcaagaaatgaagaaagaatatcaagcaagacgtgattatctatattcaaacttaactaaattaggatttgaatgtgctaagcctcaaggagcgttctatattttcgcaaaaattccagctggtttagaacaagatgataagaagtttatttatgacttagccgaaaaagcaaaagtagcagtaactgctggctctttcttcggtaaaggtggagaacactatatccgtttaagctatgcaacaagtatggaagaaataaaaaaaggcgtggctcgaattgccaagtatgttgaagaagaaagtaaataa

SEQ ID NO: 246 - DNA, 1512 bp, Lactobacillus salivarius
  isolated from gut, Lactobacillus salivarius
atgaaaatatattatttaaggaggaaacaaaaattggctgaaacacaagctactgatatttacggaaaaccatataaccgatctttattagttctcgttttaatgattggttctttttgtactattttaaatgctactttactcgcaactgcatttccagcaattatgaagtcatttgacatcagcaccgcaacagttgaatggctaacaactggttttatgttagttaacggggttatgattcctatctctgcatggatgattaataagtttaatactcgtacaatgtacattggtgctatgtcaacattctttgttggtactttattatcatttatcgctcctaactttgctacattgttggctggacgtttgatccaaggtttgggtgttggggtatctatgcctcttcttcaaacaatcatgttatccatcttcccacctgaaaaacgtggtgccgcaatgggtactgtagggattgcgatcggtgtagctcctgcgattggacctactctttctggatggatcgttgataacttctcatggcgtgatttattcggtatgatgcttccaattgttttaggtgttatcattctttcaatcttcttaatgaaaaatgttatccctaaccgtgatcaagatatcgatgttatttctgctattacatccattatcggttttggttctatgctttatggattctccaaagctggtaacgacggttggactgatccacttgtactagcatttatttttgttggtatcatcttcgttattttatttggttggcgtcagcttaagatggaagtaccattccttgatatttctgttttcaaatatggggaatttagccttgctgccatcttatcaagtgtatccaaccttgctatgatgggaattgaaatgattttaccattatacattcaaaacattcgtggagaatcagctttccactctggtttaattttacttccaggtgcgatggcaatggccattatgtctcctattactggtcgtttatttgaccgctacggtgctagatacatggcaattactggtttgacaatgttgtctctaggaacattaccattccttttcctaactagtcacacttctattttatacatcactgttttctatgctgtgcgtatgttcggaattgcaatggttatgatgcctgttacaacttctggtatgaatgtcctaccattcaagcaaatttctgatggtactgctgtaaacaatactttccgtcaagttgttagttcaatcggtactgctattttagtatctgtattaagtacaactactaaagacaacatgcctgctaagtccttacttcacgcaacacctttagcttatcgtgataaggctattgacgctgttttaagtggttatacagccgcattcttggtagctgcaatcttcgcaatcgttgctttagctctagcattcttccttaagaaaggaaatcgtgctcgtgaagctgctatgttaggaggtaaaaaataa

SEQ ID NO: 247 - DNA, 1029 bp, Lactobacillus salivarius
  isolated from gut, Lactobacillus salivarius
atggaagaaaaattaaaattaagtccagatagtttcgaacctttagcaaaaggcgaagctcaagataatgaaaaaatcgctgctccctcacttacctttactcaagacgtatggttaagattgaagaagaacaaaggtgcagttgtctctttgattgttatcttattgatggtgattgtagcatttggttcaacaccattcattaataaaagtacattagttaagtctcagccacaatatgcaaacttaccagctaaggttccaggtctagatgcaattaatggtcttaacggtaagattaagcaaggcggtgtctgggtagatgcttatgctaaaaatgatgttccaaaagataagtatttctatttaggaactgattatttaggacgttcattagctcaacgtattatttacggtacaaaagtttcattgattgtagctttagtcgcaacattctttgatttaacagttggggtcgcctatggcatcatctcaggatggaaagggggtagagtagataatgttatgcaacgtattatcgaaattatttcctctatccctaaccttgttatcgttgttttgatgctggtagtattgaagccaggtatgacttctattatcttagctatcgcaatttcttcatggacaaccatggctcgtatgattcgtgccgaaacgctgtccttgaaaacacaagaatatgtattagccgcaagaacattaggtgagtcacctacaaaaattgcatggaaacacttggtaccaaacttatcaagtatcatcattattcaaacaatgtacacaattccatcagctatcttcttcgaagcattcttgagttttatcggtatcggtattacagctccagaaacttctttaggggtattgttgaatgaaggtcaaaagaacttccaattcttaccatatcaaatgtggtatccagcaattgtattgtgtgtattgatgattgcatttaaccttttaggtgacggtttacgtgatgcattcgatccaaagacaagaaggtag

SEQ ID NO: 248 - DNA, 924 bp, Lactobacillus salivarius
  isolated from gut, Lactobacillus salivarius
gtggattttacagagtttttaactaaccatacagttgttttagatggagcgatgtcaactcctcttgaaagattgagtgcagatacaaataatgatttgtggacagctaaagctttgattgataatgaagaattggtatatgaagttcataaaatgtatttcgaagctggagcggatctaataattacggatacttatcaagctaatgttcaagcctttgaaaaagttggatacagtgaaaaagaagctagaaatttaattaaaaaagcagtaaaaatcgcacaaaaggcacgcgatgattatgaaaatagaacaggaaagcataattatattgctggaacaattggtccatatggtgcttacctagctaacggaagcgagtatagaggagattatgagttatctactaaagaatatcaacaatttcatttaccaaggatcgaagaattggtaactacaggggttgatatcctagctattgaaactcaacctaagttagatgaagtactggcgattctagagttgctaaagaaaaaatatcctcaacaaaaagtgtacgtttcttatactttgagcgatgacgatacaatcagcgatggaacaccattgcctagagctatccatgcacttgaagattattcgcaagtaatagcagtaggaatcaattgtataaagttagagttagtagaaccggctttaaaaaatatgaaagaaatcacagataagcacttaatagtatatcctaattcaagtgcggtctatgatcctaagagtaagacttggtcccaacctaaaactagtgtaacctttgaagaattgattcctaattggtatgaagcaggagctagaattattggtggttgttgtacaactggaccaaaggagatcaaagcagtggcggattttattaagcgtaataaataa

SEQ ID NO: 249 - DNA, 1146 bp, Lactobacillus salivarius
  isolated from gut, Lactobacillus salivarius
ttgaaaaagtttggtataattatcagtttatgtctatcagctgctttaatggcttcttgtggaaaacttggtggtaattctaatactacaacagcaactacagagtcatctaaaagtggttatcagacaactggtgaaaacaatagtagtgattatcaaggaattattgaagatggagaatataagacaagtaagtctagaggggtagggatttctcaaaattcagataatctattgaatttgaagagttttgaagcaggtctaacaacaatttctaaggatcatttctctactaagagttacattttccaagaaggacaatatttaaataaggctactattcaagattggttagggagaaaatctagttctaatccagaaggtttgaatcctagcgacaatggtaagaaagaagcaaataagcgaaacccaatttatgttcaacaaatagaagaacaagattacatgaagcaaaataatggtaaattggaattagccggtatgacaattgggattggtatgaatcaaaaggattactaccaaaaagaacaatatggtgctacttattcaacaacaatttctaaagaaaagagaattgaagaaggtaagatagctgctaagaaagttcttgcacgagttcgtcaaaaagtcggaaacaatgtaccaattgtgattgcgatgtttgctcaagctcctaatgatagtttagtaggtggttatttctactcctatactgtaagtaagagtgggacagatatcggaagttggacagaaacaaacattaagagttatgttcttccagcgactgaagataacaaacttcctaatgacaatgattcaacatcatttgataatttccaaaaagaagttaagaatttcttccctaatatttctaatgtaacgggacaaggtcaatataaagataagactttgcaaggtttacacataacaattacaactcaattttatagtgaaaccgagataactagctttactcaatatgtagcacaagctgccaagtcatacttaccaagtggtattccagtagatattaagatcaatggtagtgatggtgaaacacaaagttttgtttcaacaacaggtggcaatggcggatattatacccatgtatttggaagttactaa

SEQ ID NO: 250 - DNA, 1395 bp, Lactobacillus salivarius
  isolated from gut, Lactobacillus salivarius
atggctacgatggtaccaacagaattcgatacaattgctgcaatttcaactccacctggagaaggagcgatctcgattgttcgtttaagtggagaagatgctgttaagattgcaaataaggtgtttaaaggaaaaaatttagaaaaagttccaacacataccattaattacggacatattgttaatcctaaaactaatgaagaacttgatgaagtaatggtgtcagtaatgttagcacctagaacatttactcgtgaagatgttattgaaataaattgtcacggagggattgttccaactaatcaaattctacaattattattatcaaatggagcaagattggcagaacctggtgaattcaccaagcgtgctttcttacatggaagaattgacttaactcaagcagaatctgtaatggatttaattagagctaagacagatcgttcaatgaaagtggctttaaatcaattagatggtaatttgtcacacttaattagaaacttacgtcaagatattttagatgttttggctcaagttgaagttaatattgactatccagaatatgacgatgttgaaacattaactactaagatgttacgtgaaaaagcaattgaagttaagaagagtattcaacaattgttaacgactgctaagcaaggaaaagttctacgtgaaggcttggcaactgcaattgtagggcgaccaaatgttggaaaatctagtctattgaatcacttacttcatgaagacaaagcaatcgtaacagatattgctggaacaacacgcgatgtaattgaggaatatgttaatgtaagaggcgttcctttgaaattgattgatacagccggaatccgagaaactgaagataaggttgaaaggataggggttgaacgttctagaaaagcaatcgaacaagctgacttggttatgttagttttaaatgctagtgaagaattaactgatgaagataaggaattaattcaagctacaagtggtaagaagagaattgttatcctaaataaaactgatttaccacgaaaacttaatatggatgaagtgcgtgaattagtaccagaagatgaacttattacaacatctgtcttaaagaaaacaggggtagataagttagaagaaaagattgcagaattattcttcggtggaatagaaaattcacaatctacaattatggtaaccaatgctcgtcatattgctttattgaaccaagcagaagattctttagatgcagttttgcaaggattagattcaggaatgccagttgacttatgccaaattgatatgacaaatgcctgggatgaactaggcgaaattacgggcgattcttaccaagatgaattattaacacagttgtttagtcaattctgtctaggaaaataa

SEQ ID NO: 251 - DNA, 1383 bp, Lactobacillus salivarius
  isolated from gut, Lactobacillus salivarius
atgaattggagatatattgatatgaacaaagaaaataaaggatatgcaagaaatttaaaaagtagacatatccaattaatagcattaggagggacgataggaactggactatttttaggatcaggaaagtctatccacttagcaggcccatctattgttttagcatattgtataacagggttaatatgtttctttctgatgagagcaatgggggaacttcttttatcagatttaaatacacattcttttatagattttattactaaatatttaggagaaaaaataggttttatagctgggtggacatattggatttgttggataacgattgctatggcagatgttacggcaacaggtctatatatagaatattggttccctaatataccacagtgggttccaggattagttgcagtagttgtattgttatctttgaatttagttacagtggggctatttggagaaacagaattttggttttctttaatcaaaattattgctatcattgcactaattgtttcaggaattgcgatggttatagttagttataagacaccggtaggacatgctactttagggaatttgtatagttatgggggattatttccaaaaggcttaaaaggatttttgctatctttccaaatggtgacttttggctttattggaattgaaatggttggaattactgcttcagaagcagaaaatcccaaaaaagttattccaaaggctattaatgaaattccgttaagaataattattttttacgtagggtctttactagcaataatgtccatatatccatggaattccatctcaataaatgaaagcccctttgtacaagtatttcagaatataggtataacttttgctgctggaattataaactttgttgtattgacagctgcattatcggctactaatagtgcattattcagtaccggaagaatgttattctcgcttaactggggtaaaaagggaaaattcgcaaaaaaaatgagcacattgtccagacaacaagttccagcgaatggtttaattttttctgctattataatagcaatagcagtattagctaactttgtagtatctaatacatctttatttacatttgtgtctagtgttgcgacaacttgtttcttatttatttggggcgcaattgttgtatgtcatttggaatttaaaaagcaacaaaagaaacaaaacattcctgagggagaatttaaattacattttcatccatggactgattatttagtgttggctttcttaatattcgtaggagtaataatgtgcttggaaaaaacaacattatttgctttgatagctgcgattgcttggtttgtaatgttatatatgattagtagtattaaaaaaagaaattag

SEQ ID NO: 252 - DNA, 1638 bp, Lactobacillus salivarius
  isolated from gut, Lactobacillus salivarius
atgacaatttcagtgatttattccttatttaatcgcttttttacatgctataataatgcttgtagttatgttatacgattgacagttttttcaatattaaatataataacagataagaatacgtttacaataataggaggaattattatggaatggacacgtgaatcacgttataaaaaatattctgaatgggatgcggaaactttattgaagttacaggcacaagcaacagcttcaaaataccaaatgtcttatcatattcgccctcaatcaggcttattaaatgatcctaacggtttttcttactttaatgatgagtaccatgttttctatcaatcttatccatttggtgcagttcatggtttaaaatcttgggttcatttaacttctcctgatttagttcactggaagaaccttggattagcaatcaatgctgatactaaatacgatagtcatggtgcttactctggttcagcacgtgttatcgatgataaattattcttaatgtatactggtaatcatcgtagtaaagaatgggttcgttacccttatcaaattggtgcgatcatggacaaggacaacaatattactaaacttgataaacctatgattgagcctgtagatcatataacagaacattttcgtgatccacaattactaaaacatcgtgatgaatacttcgttattttaggtgctcaagatgctgaaacaaagactggtaaaatttcactcttccgttcaaaagatttaaagaactggcaagacctaggttatcttgattttactgaagaagaaatgggatacatggtagaatgccctaatttagtctttgttgatgatcaacctgtacttattttctgcccacaaggtttagataagaaagttgctgattatgaaaatatctatcctaatatgtatattgttggttcagatattcgtttagacaaagctaaattcaatactgatcaaaaagcacctctaaatcttgacgatggttttgatgtttatgctacacaagcattcaatgcacctaatggtaaagcttatgctatttcttggattggacttcctgacatctcttatccaactgatagtgaaaactgggctaactgcttaagtcaggttaaagaattatctgtagttgatggtgaattataccaacgccctgttccagctatggcatcacttagagaagaaggaactcttgttagaagtgaagaagtatttgatggccaacaaattgtccactctgcagcttcaaaacattatgaattaaaacttgatcttacagctggtcaaaatggtaaattattcctagcagctaataaagatttatcccaaggaattgaaattaatttctctactgctgacgatgctttccttacagtagatcgtagtaaggctggtattcctttcgcagaagattacggtacaactagaactattgctttgccagctaacaaacaacttagcttagatatattcgttgacggttctgtttgcgaaatctttgttaataatggtagacataccttaacttcaagattttttgctcctgatggtaataataagattgcatttattagtgataaaaagctacaatatactggtacctattggaatatgaaaaatatttag

SEQ ID NO: 253 - DNA, 921 bp, Lactobacillus salivarius
  isolated from gut, Lactobacillus salivarius
atgaaagaattagtttttggacacaagaatccagatacagatgctattgtagcagctaaagcatactcatatttacaaaataaattaggtgctgatactgaagcagttgctttaggcacacctaatgaagaaacaaaatttgtgttggattacttcaaggaagaatatccacgtgtaattacaacagcaaaaaatgaagtagaagctgtaatgttagttgatcataacgaagcacaacaaagtgttgatgatattaaagaattaactgtaacacacgttatagatcatcaccgtattgcaaactttgaaacagctgcaccattgtactaccatgcagaaccattgggatgctcaagtactgtaatttacaaagaattcaaagcaaataatgtagaagttcctgctaaattagctggtttaatgttatcagctatcatttctgatacattattattaaaatcaccaacaacaactgatgaagatgttgctgctgtgaaagaattagctgaaattgcaggtgtaaactatgaagaatatggtttggaaatgttaaaagctggaacaaacctttcaagtaaaacagaagaagaattaatttctgcagatgctaagtcatttgaaatgggtggtaagacagtacgtgtagaccaagttaacacagttgacttagatgaagtatttgctagagaagctgctttgcgtgcagcaattgaaaagcaaagtgcagaagaaggctacgacttattcttattaatggtaacaaatattttagattcaaatacacgtttattagtagtaggtgaacctaaagatgtagttgaaaaagcattcgataaaaagttggaagacgacaagatggacttaccaggcgtagtttcacgtaagaaacaagttgttcctccattggaagctgcattttaa

SEQ ID NO: 254 - DNA, 987 bp, Lactobacillus salivarius
  isolated from gut, Lactobacillus salivarius
atggtgaaggatataggtatcgacttgggtactgctaatgttttaataaatgttaaaggtagaggtattgtccttaatgagccatcagttgttgctatagatactaagagtggcagggttctttctgttggatctgaagcatatcaaatggttggtagaacacctagtaatattcgtgcaattcgtcctttaaaagatggggtaattgctgattttgatatgactgagcaaatgttatcctactttataaaaaaattaaacgttaaaggtttcatgtctcgtcctaatattttaatttgttgtcctactaacactacagatattgaaaggaaagcaattagacaagcagcagaaaaatccggtggtggtagtaaggtatacttggaagaagaacctaaagttgcagcaattggtgcaggtttagatgttttccaaccacatggaaatatggtaattgatattggtggtgggactagtgatatagcagtactatcactaggagatattgttgtaagtcgttcattacgtgcagctggagataaattaaatagtgatattgcaaattacgtaaggaataaacataacttaattataggtgaaagaactgctgaaaaagtaaaaatggaaataggttctgtactaaaaggacacagagatgaaacatttagtgtacgtggtagaaatgtagttgatggattacctaagactattacgatgacttctgatgaaacggaagaagcaatgcatgatacgatgcaagctatgatttctgctgctaaagatctattaagtacgactcctccagaattagcttcagatatcattgatagaggaattgttattactggtggtggtgcgttgttagatggaatagacatgttgttctcagagcatttgaaggtaccagttatgatttcagaaactccattggatgatgttgctttaggaacaggaaaattacttgaccatattgaaaaatcaaattaa

SEQ ID NO: 255 - DNA, 1935 bp, Lactobacillus salivarius
  isolated from gut, Lactobacillus salivarius
atggaaataagaaattcacaaagtaaaagtgagaagattacttctcgtattgcatatacctttggtgcctttggtaacgatgtgttttatgcagcgatgtctacatatttaattaatttcattacatctcatttgtttgatacaggagataaaacgttaaataaccatttagttagtgctgttacattgattatcatggttttacgtattgttgaattattaattgatccatttattggtaacgctatcgaccgtaccaagactcgctggggacactttcgtccttgggtagtaattggtggtactgtttcatcaattgctttattggcattattctcaaatatgggtggtttaactaaaacacatccatggttatatttagtaatttttgcatttctttatattgcaatggatatattctattcatttaaagacgttggtttttggtctatgttgccagcgctatcatttgattcaagagaacgtgaaaagacagctacctttgctcgtatcggttcttcaatcggtggttcattagttggtgttgttgttatgcctcttgtattattcttctcccttcaaagtaatggaggaacaggtgatgacagaggttggttctggtttggctttattgtagctgcagttgcttttgtaacagcgttagcagttggtattggaacacgtgaagttgacaataaattacgtgaaaacaaagaagatacagctggtgtaagtgcagttttcaaaatgttagttaagaatgaccaattaatgtgggtagctttggcttacttactatatggtgtaggaattaacttagtaaatgctctagaactttactacttccaatatattatgggggatccaaaaggtttcagtttactacaatttataaacatgtttgtaggtatttttgctgtaagtgcctttcctaaattagcagataaattaaatcgtaagccattatttatttggtgtttagtaactatgttaattggaattggtttattcactgtcgctggcaagagcttattacttgtattgattgccgctgaattattctacattcctcaaccaattgttttcttagttgttttaatgattattactgactctgttgaatatggtcaatggaaattaggacatcgtgatgaatcacttgctttatcagttcgtcctttagttgataagttcggtggagctgtttctaacggtgttgtaggacaaattgctgttttagcaggaatgactactggtgcaactgccgcttctatcactatgcatcaacaaatggtcttcaaatttatgatgtttggtgttccagcaatcttcattttaattgggatgtttgttttctggaagaagattactttaactgaagaacgacatgcagaaatcgttgcagaacttgaaaagacttggggcgatcaatttgatcaatctaatgcagaaagcgataagttaattaagtctgacgaattaactgcaatggttccagtagcaggtaaagttattgctatgaaagatgtacctgatgaagtattttcaacaggtaagatgggacaaggtattgcaattaaacctacagatggtaaagtatatgccccatttgatgctgaagttaaaacagtctttgcaactcgtcacgctattggtttggtttctgataacggaattccagttctaattcatgtgggtattggtactgtttctatgaagggtacaggttttgtaacatatgtcagagaaggacaacatgtcaagaaagggcaacaaattcttgaattctgggatccagcaattaagaaagctggcttagatgatacagtattaatgacctttacacattcagatttatttaaagaatttgacgtgaaagtaccagttggttcagaagttgttaatacaaatacagctattgaaataaagaaatag

SEQ ID NO: 256 - DNA, 2367 bp, Lactobacillus salivarius
  isolated from gut, Lactobacillus salivarius
gtggtatttttaacaagaaatgaggaaaaactcttgattgatgctaaaaaagaatggcaagaaattgaattatcagaaaatgaacatcttgatgaattaattgaagaaacaggttttcctaagatagttttacaaatattaatggaaagaggatacgattctcttgaagctattaacaattttttagatccagatgctcgtggattgtacgatcctaattttatgcatgatatggaactaggtgtagatagaattcaacaagcaatcatgaatggtgaaaaaatagttatttatggagattatgatgttgatggaatcacaagtactgcccttatgtacgaaactcttgaagaattaggagcagaagttgaatattatatacctgatagatttaaagatggctatggtccaaatatggaagtctataagcgtttgattgatgaagatgttagtttaattgtaaccgtggataatggggtagctggacatgaagccattgattatgcaaatcaacatggagtagatgtagtcataacagatcatcatgagttacctgaaactttgccagatgcatatgcgattattcatcctcgtcatcctgagggcgattatccttttggtgaattatctggagtaggtgtggcttttaaggtggcggctgctttactagaagaactgccacaagatgtattagatttagttgctttaggaacagtagctgatttggtttctctaactggtgaaaatagaatcttagttaagtatggtctgcaattgttacaacaaacaatgcgtcctggattgcaaagtttatacaaagtagctgggatagaagtccctacaattacggaagagacaattggtttttcacttgctccacgtttaaatgcattaggaagaatggaaaatgggagtttaggggtagaattactaactactttagatggggaaagagctgaagagttagcaaaaactaccaaccaattaaatataaaaaggcaagaagaagttaataaaatcgttgaagaagcagtggcgcaattagctaataaatccgaaaatcatttagtcaatgtagtggctggaaataactggcatgaaggtgtagtgggcatcgtggcaagtaggttagtcgatatgactggcaaaccttctttagttcttagcattgatgaaaaaacaggtattgctaaaggctcaggaagatccattgaagcatttcaaatgtttgatgccttagatagtcatcgagatattctcatgaaatttggaggacatcatatggcttgtggcttgtctctagataaggagaagttgtcagatttacaacaagttgttgatgaagaaggaaagaaacaaggaattgaacatgctacaaaaccggtagtaaaagtcattcctgttaatttagatgatgttaatttggatttagaagcacaattagaagctttagcaccatttggtacagataatcctcgtcctgtttttgaattcaaagattacaaagtgaatacagttcaggcgattgggcaacaaaaaaatcatcttaaacttcaattgcaatccaataactctcaagtggatgccttggatttcggaattggtagtaaaaagatttctgaaattgagcaaaataaaaattcagttcgtttgataggaactctgggaaaaaatgtttggcaaagtaggattaatcttcaaattatgatagaagatattttgttggatgatagtaatactgaaacagttgttgagattcaacgaaaaaataaattaactaagtcaatgtttcaacaaaaagcaacatatgctttctttgataaaaaactatataatcaagtaatgccatatctagcagatagtagtgaaacttatttatataattttagcgatgataagaagttaaattgtgatacgttggttgtggtagattgcccagataatatagaaaaattaaagtctctacttgctaaagcaactgttaagcattttatttttgttggttatactagagaaaatacttacttaaatggcttgccaactagagaacagtttggtagactatataagttctcgcaaacacacactaatgtaaatataagaagagatttacagaaattagcggactatttaaaattaaaacgtgaacttttagtttttatgattaatgtgttttttgaagcgaaatttgttaaaatagaaaatgggttgatgagtggaaacacaaatgtaactccgcataatttagaagatacaaattcatatcaagcatatttacaaaaaatgaaagcacaaaaatcgctaatatacagcaaatcaacagatttacagaagtggatattaaagtatcttgatgaaaataattag

SEQ ID NO: 257 - DNA, 1032 bp, Lactobacillus salivarius
  isolated from gut, Lactobacillus salivarius
atgtttaagaatatcattgtaactggtggagctggattcatcggttcaaactttgtacattatgtagtcaataatcatcctgaagttcatgtgacagtattggataaactgacatatgctggaaataaagaaaatcttgctggcttgccagaagatcgcgtagaattagttgtcggagatatttgtgataaggaattagtggataagttagttcaaaatgctgatgcggtggtacattatgctgctgaaagtcataatgataactcacttagaaatcctgatccttttatccaaactaatattgttgggacatcagttctaattgaagcatgtactaagtacgatgtacgtttccatcatgtttctactgatgaagtttatggtgatttaccattacgtgaagatttaccaggacatggtgaaggactaggtgaaaaattcacacctgaatctccgtataagccaagtagtccttactcatcttcaaaggcaagttcagatttgctagttagagcatgggtgcgttcatttggattaaaagcaactatttccaattgttcaaataactacggtccttaccaacatatcgaaaaatttattccacgtcagataacaaatattttaagtggtattcgtccaaaattatatggaacaggtaagaatgtacgtgactggatccatactaatgatcattcaagtgctgtttggaagattttgaatgaaggcaagattggcgaaacatacctaatcggtgctgacggtgaaaaaaacaacaaagaagttttagaattaatcttgaaattaatgggacaaccagcagacgcttacgatcaagttaaagatcgtccaggacatgatttacgctatgctattgatgcaagtaaattacgcaatgaattaggttgggaacctcaatacactaattttgaagaaggcctaaaagcaacaattgattggtatactaaccatcgtgaatggtggcaagatcaaaaggctgcagttgaagctaaatacgctaaaaatgggcaataa

SEQ ID NO: 258 - DNA, 702 bp, Lactobacillus salivarius
  isolated from gut, Lactobacillus salivarius
atggcaaaagtattggttgtagatgatgaacaagcaataacaacattgttgaaatataatttagaaaaggcaggctatgaagttaaaaccgttaataatggaaatgatgcattagatgaaggattaactggcaaatacgactttataatcttagatctaatgttgccaggaattgatggaattgaagttactaagagaataagacaagaaaagataacaacatatattcttattcttactgctaaggatgatgagtatgataaaatcattggattggaattaggtgctgatgactatttgactaaacccttttcaccacgtgaaattgttgctaggttaaaagcagtcaaaagaagagtggaacattattctgataattcagagaaggattccaaaaataagtattactttggaaactatatggtaaatcttgatagttatgaattgagagataaaaataataatttaattaagttaacgcctaaagaattcgaattgcttgtatattttttaagaaaaaaaggtagggttttaggacgcgaagaattgttgaacaatgtttggggatttgactatatcggtcaaacaagaatggtagatatgcatgtcagtcatttacgggaaaaaatagaggagaatcctaagaaacctatttttttaaaaaccgttagaggcttcggctatcgctttgaggacgaataa

SEQ ID NO: 259 - DNA, 312 bp, Lactobacillus antri
  isolated from gut, Lactobacillus antri
ggagtccttattatgccaattgctactactcaaagtgatttccgtaatcatattaaagactacttagataaagtcaatgatgaaaaccaaacagtactaattgcacgttctaatcaacgagcagcagctgttatctcacaagaacaactcaatacccttcttgaggctgttaatgctaaagaagattcactagattatgctattgctagagataagttaatcgaaatgcacatcttacctgatgatcctatcgttgaaccaactgacgattattggaacagttttaagccaaaggataacagtaaccaatga

SEQ ID NO: 260 - DNA, 693 bp, Lactobacillus salivarius
  isolated from gut, Lactobacillus salivarius
atgattgcgcaagacatcgcttcaaaaattaaatatcatcaatataaagaaggagattatctcccaagtgaacatcaactttgtgaactttatggaacttctcgcgaaactattcgtaaagctctcaatcatttaaccgaattaggacttattcaaaaaatccgtggtaagggttctgtcgttttagatattcaaaaatttaccttccctatttctgggattacaagttttaaggaattaaatagatctctaaatatgcatgctaagacaacggttctaaagcaagttaacacattggctcctaaaagatttatggacattaatatcgataatcaacaagcaattttcgttgaacgtcttcgtactatcgacgacctacctgtagtgttagatcaagattatctacttacacctccagtttcttctttgccagctggtgtagctgaagactctatttatgaatatttggaaaaagaattacatttagaagtatcctatgctactaaagctattacggttgaaaaagccgcagatgatatcgctgaaaagttgcagctggatgatgataaactcgttgttatagtcagaagtctttcttatttagacgacactacactattccaactaacatcttcctatcatcgccctgacaaatttaaatttattgactttgctcgtagaaaaaaaatctaa

SEQ ID NO: 261 - DNA, 1251 bp, Lactobacillus salivarius
  isolated from gut, Lactobacillus salivarius
atgagtgcaccagcatttacaccaattttattaggtagtgactttaatgtttacggaatggcacgttctttttatgaactataccatcaaccagttaaggcatttgcggaaatagaattggcaccaacaagatttacaaaaattgttgacttagaattaatagatggtttttctgaagatccagtttggattaatgaaatgcgtaagataaaggaacgttacgctgatcatgaagaaccagtaatcttaattggttgtggtgatggctatgcagaattgattgctaagcataaggatgaattgtcagatgtatttatttgtccttacgttgactatgacttattgaagcatttgaataacaaggaacgtttctatgaaatgtgtgacaagtatgacttgccatatccaaaaacaaaaatcatcactaaagctgatcatgacagtggagacaagattgaacaaccattccaatatccggtagcattgaaaccagctaatagtgttgaatggcttgacgttcattttgaaggtcgtaaaaaagcctttagaattaaggatcgagaagaatttgattatgtcttgaaacaagcatatgcaaatggctataagtctgattttattttacaagactttattcctggcgatgatagtcatatgcgtgtattgaatgcctatgtagataaagatcataaagttaagatgatgtgtatgggacatcctttactagaagatccagcaccatcagcaattggaaactatgttgcaatattgccagattttaatcaagatatctatgatcgtatcaagaatttcttagaagctattaactatactggttatgctaactttgatatgaagtacgacacaagagataacacatataagttatttgaaattaatcttcgtcaaggaagaagtagtttctttgtaactttagatggttacaatttagctgattgggttgttaaagactacgttaaagatagcttaaaagatcaagaaactgtctacggaaataaagatgaagaacaacatgctctatggttaggtgtgcctgcgaaagtatttaagaaatatgccaaggataatgaagataagcaaaaagctttggaattaattaaagctggtcgttacggaacaactttcgaatattctaaagatatgaatattagacgttggctattaattaagtggatgaatcataactatgtgaagaactttaatcgttatttcaaagaaaataaagggtga

SEQ ID NO: 262 - DNA, 894 bp, Lactobacillus salivarius
  isolated from gut, Lactobacillus salivarius
atgaataatttgccgagaggagtttcaactatggcaaacattaaaattttaacagactcttctgttcaacttacaccagaagaaattgaaaaatataatattacaattgtacccctttctgttgaagtggatggtaaaaattatgttgatggtgaagatatttctcgtgaagaattagtccaagctttaaaagatggcaatattcctaaaacaagtcaaccacctatcggcagatttatagatgcttataatgaactaggtaaagatggcagcgaagtattagctattgtactttcagatgttctttctggaacttacgaaactgcaagtagtgctgctgatatggtagatactaaggtaactgttattaacagtaaatcaactgatagaggattggctttccaagttcttgctgctgctaaagatttagaggcaggtaaaagtattgatgaaattaaagatcaccttaaagacatctatcatcgcacaactattgatgttttgattgataaccttgactgtttagttgctggtggtcgtgtaagtcgtttagctggtgctttaactaaacttatcaatcttaaacttattattcgcttgaacgaggaaagtttggatgttattgtcaagggtcgtagcaagaagacctttatcaagcattgtaagactttagctgaagaatatttacaaaatcacaaccctattcaagcactatccttatcaaatgttggtacagatgatagtctacttcaaaaaatcaaggatactttattagagaataactctatccaagaaatcccttatatcgctcgtttaactagtcctattattatgactcacactggtttaaacgctgttggagttattacacttaacgaaaaacctacacattga

SEQ ID NO: 263 - DNA, 345 bp, Lactobacillus salivarius
  isolated from gut, Lactobacillus salivarius
attatgagaaagtcatatcgcgtcaaaaaagaagcggaatttcaaacagtctttactcaaggacagtcttgtgctaaccgccaatttgtggtttacatgctagaaaagcctgatcaaaagcattttcgagtaggaatttcagttggtaaaaaaattggcaatgcggtagctcgcaattgggtaaagcgtcgtattcgccaaagtttaactgaattgaagcctcagttgaagcaggattgcgattttcttgtgattgcacgaccaactgttgcttatatgtcaatggctgaagtaaaggaacatctaaagcatgttttgaaattagccaaagtattaggagaatga

SEQ ID NO: 264 - DNA, 1566 bp, Lactobacillus salivarius
  isolated from gut, Lactobacillus salivarius
gtgattatagcaattacaatcctcgccatcgccattgcgactttagttatcggttttgcgttgggggtagcttatcgtaagcgtagttatgaacaagctttagatgtagcaacccaaacagcaactggtatcattgaaacagcaaaaaaagaagctgctgcaagtaagaaggaagcgattattgaagctaaagaagaaaatcatcgttatcgttctgaaatagaaagtgaactaaaggaacgcagatctgaaattcaacgtcaggaaaatcgcttgttacaaagagaagaaattctcgatagaaaagatactgctttagataaacgtgaggacgttttagagaaaaaagaagcacaattagattctgatcaaaaagttgtaactaagcaaaaagaacaagcatctttgttagtaaaagagcaacaagataaacttgaagaaattgcagcattgacaagacccgaagctaaggaattaatcttgaatgaaactaaggaagaattaattcatgagcgtgcggtaatgattaaggaaagtgaagaagaaactaaagctacagttgaccgaaaagctaagagtttaatcgctcaagctattcaacgtagtgctgcagatatggtatctgaaacaactgtatctgtagtaaatcttccaaatgatgaaatgaagggtagaataattggacgtgaaggtcgaaatattcgtactttagaaacattgactggaattgacttaataatcgatgatacgccagaagcagtcgttttaagtggtttcgatccagttagaagagaaattgctaaaatggccttagaaagattaattcaggatggtcgaattcatccagcaagaattgaagaaatggttgataaggctactaaggatatggatgcaaaaattcgtgaaataggtgaagaagttatttttgacctaggaattcattcaatgcacccagacttgattaagactattggtagattaaattatcgtacaagttatggtcaaaatgttttgaatcattcaattgaagttgcaaaaatttcaggaatactagctgctgagttaggcgaagatgtcatattggcgaaacgtgcaggattattacacgatattggtaaagctgttgatcatgagattgagggttcacatgtcgaacttggtgtagaactcactaagaaatataatgaaagtgagacagttgtcaatacaattgcttcgcatcatggagacacagagcctaaatccgtaatagctgttttagttgctgcggctgatgcaatttcagctgctagaccaggtgctcgtagtgaatcattagaaaattatatccatcgtcttgaaaaattggaaaatatttcaaacgaatttaagggtgttcaaaagagttacgctattcaagctggtcgagaagttagagttattgttcaaccaaatgaggttagcgatttagaagcaactgttttggctagagatattcgaatgaagattgaagatgagttagaatatccaggtcatattaaagtgacagttattagagaaacaagagctgttgaatatgctaagtaa

SEQ ID NO: 265 - DNA, 918 bp, Lactobacillus salivarius
  isolated from gut, Lactobacillus salivarius
atgataacgcgtcaagaaataaatgggaagtcaccattaaattatagttggtacgatattaaaaatattgatgataacgatattgtaaaattgaaaaaaaggtttcattttacgccgactattatctcatatgttgccgatagaaatgaacgtcctcactatgatcacgatagtttaactcatagtgaattaatagtatacgatgttcctgtttggccagaagaaaaatctgatcattttacgactcgtcctctaatttttctattacaaggaactacagtatatactttccacactaatgctactgaggatatatttgaagagtttaaagaagaacgcgctcatgaagcgcaagatgctacggaatttatcatgctattcttacttcatgtaactcaatatttccaacgagcattaacacagttgaatcatcaattaaatgagttagatagaagattgaatactaaaattaaaaacaaagatttattggaattagcacaaatggaaagaagtttagtctttgtttcaagtagtgctagaactaatttgatgatgctagaagatttgaagaacacaccgatgtcttggcaaattactaagtcagctcaagaaagattagatgatgttttgattgaagctgagcaggcctcaaggacggttgaaatttctaatgaagtgacagaaaaaatttctaagacatcaaataatatcttgaataataacttgaacgatacaatgaagttcttaactgtgtggtccttgattttaactattccaaccattattacaggtttctttggaatgaacgttaaattaccaattttaaacaacggatttgactggattttagtagttttcgttaactttttattgatgggtggattatatctctacttgaaaaagaacgattttatttaa

SEQ ID NO: 266 - DNA, 1887 bp, Lactobacillus salivarius
  isolated from gut, Lactobacillus salivarius
atgcctaataaaatcagtggcgctgatgccatgttaaaagttttgcatgaatggggagttactcatatttatggtcatcctggtggctcacttgactctactatgaatgctttacataatcaacaagataaaattaaatttattcaagttcggcatgaagaagccggtgcacttgctgcctctgccagtactaagctctcaggtaaagttggagtagtattaggctctgctggtccaggtgccattcatcttcttaacggactacacgatgccaaagccgatcatgttccagtattcgcaatcatcgcgcaagtacctactactaagatgaatattgatttcttccaagcttacaatgaaggtccttggtttgataatgttgcttgttggaatagaacagctatgactgctgaaagtattcctaaacttgttgatgaaggtatccgtcaagcttataagcatcgtggagtcgccaccctaattttacctaaagacctaggatggaaaatgattcctgatacttttgtttccaatgctgctaaccacgttgaaccaatttaccctgaacccaatcctcaatccattaccgacgctttagaactgataaaagcagctaaagcacctatggtttacttcggtattggggctaaacatgctgctaaggaattgaaagaaatttctgctaaatttaaacttcctctagtatcttctgttcttgctaagggaattattgaagatacctatcctacttatatgggatcaactggccgtgttgctccaaaaaccggagtagaattaggatttaatgctgatttaattctctggattggtaacgatgtgcctttcagtatcttcctttttaatcctaaggctaaagtcattcaaattgatattgatagtgaaaaattaggtaaacgacatcaagttactgttccaattcttgctgattctaaaaaaacattgcaagccttacttaaacaaggtaaagaattacctgaaacaccattctacaaagctgctttagctaacaaagaaaattggctagcatggttaaatagatttaaacacagtgaagatatcccacttagacctgaaccagttttcgaagttttgaatcaagaagctagtgatcaagcaatcttcactcttgatgttggtaatgtaaatattaactttgctagacttatgaacttacatgatcaacaaaaatggactacctcaggccaattcgcaactatggggtatggtgttcctgcggccatcgcagctaaaatactttatccagatcgtgacgtatatagtcttaatggcgatggtggttttgctatgctaatggaggaaatcattacacaggtaaagtacaatttgaatattatcaacattatttttaacaataagacccttggctatatcgaggctgagcaaattgatgacactcaacaacctgtttttggagtcgatcttcctgatactgattgggcaacaatcgccaaaggaatgggtgcaattgggtatacagtctacactttagacgactttaaagaagcaattgctgctggtaaagaaagttccaagccaattgtaattgacgttaaatttactcgagagatgccatttactactgagcatatgtatttggatcctagttaccaagatccacagaaagtagctagttttatcgaaaaatatcaagcaactactttacgtccatttagttatttcctaaagcgtgaactaggagaatctcgcgatgattttaactccgcgatgcaaaatgtttttgatgtaattacaacaccatcaaccttaccggaaaattatgaccaaaagaaaaaagaacaagatcaaatcatcccagatgcagtttctggagcttccgagtactaa

SEQ ID NO: 267 - DNA, 792 bp, Lactobacillus salivarius
  isolated from gut, Lactobacillus salivarius
atgattactttaaaatcaccacgtgaaattaaagaaatgcaaaaatcaggtcaaattttagctggaatgcatattggcttgagagatattatcaaacccggaatttctagttgggaaattgaaaaatttgctagaaaatattttaaagaacacgatgctattgcagaacaaattggttttgaaggttataagtacgctacatgtgtaagtgttaatgatgaaatttgccatggttttccacgaaagaacttaatattaaaggatggagatttggttaaggtagatacagttgttaactatcacggagctatgagtgactcttgctggagttatgtggtaggtaagtctactcctgaaattgacagactaatggaagttacaaagaatgctttgtatttagggattgaacaagcacaagttggaaatagaattggtgacatcggtgctgctatccaacattatgtagaagatgaaaatggatatggcgatgtacgtgaatttataggacatggtattggacccacaatgcatgaaagtcctaatgtccctcattatggcgaagctggacaaggtgttcgcttaaaagaaggtatgacaattacaatcgaaccaatggtaaatattggtggttgggaagcagaaatggatgatcctaacggttggacagcacgtacagcagatggtagtttatcttgccaatatgaacatactattgcaatcactaaggatggtcctaagattttgacttctcaagatcctgaaagagataaaaaatacctattagacgattag

SEQ ID NO: 268 - DNA, 1902 bp, Lactobacillus salivarius
  isolated from gut, Lactobacillus salivarius
atgttatacttgtatagaaaaaatttaagattagaaggtattactatgtcagtttcatttttaattgttacactggcagcttttatcacacctatggttttagcaagattcaaagtatcttttcttcctacttcggttgctgaaattattataggtattattattggtaaaagttgtttcaatttaattcatgctgatacgctcttgagttggtgttcaacttttggggttatactattaatgtttttaagtggtatggaaattgattttagcttatttaagaagaattcacacaccttatccccgttagaagcaaagatggcagctaatgagcctaagacttcacctgttagagctgcaacttatgcatatgctttttctttagtcgcatcgctaattttagctttgttatttaaagttacaggcttattctcagatgttggtttagctactattttatttagtactgtttctttgggaattatgacttcattattgaaagaaaatgagttactaagccgtccattcggtcaaactattcttttgttctctgtattaggtgaagttattcctatgattgctttaactgcttattcctctatctatgcaggaaaaggtgctagtttatggttgattacattgctatttatagctgcagcattcttattcaatcgtttcagacacttcttctcattctttgataaaatcaataaagcaactacacaaattgatatgcgtcttgctttctttgttatcattgccttagttttagtagctgagacagttggagctgaaaatattcttggtgctttcgttgccggaattgttttgaaattattagaacctgctgaagaaacagaacatcgccttgatgcaattggatatggtttctttactcctttcttctttattttaacaggggtaaatttagatattccatcattgatgcgttcgcctaaaacattattattaattcctttattctttgtagcctttatcctcgcaaaacttccaggatattttggtttcaaaagacgttttagtaaaaagaactcctttgttggtgctgttgcaacaagtactactatcacattagtagtaacaaccttaaagattgctgaacacttacatgctataactccacaacaatctagtgcttttttacttgctggaattcttacttgtatcgtaggacctgttttctttaataaacaatataaacctgaaccagaagatcaaaagcaaacatcattgcatattattggtgtaaatttagttacagtatctgctgctcaacaactttctaaaggaatgtatgatgttcaaatgtatacagataattctaagaattttacaacctacaattctcaagctaatgtacatttcttagattctttagatcctgatgagttaattgctaatcatatttttgatactgatattctcgttttagggtatgctgattataatgttaattataaattatctcttgcagctaaaaagtatggtgtaaatcgtgtcattgttcgttttgaaaatcgtaatccacttaatgatatggaagatgaacttaaaaaagctggtattgaatacttcagttatttcgatatcaatgtaggtatgatgcgttcaatgattgatagtccatctatgctacaaattcttacaagttctgaatctcgtttatatgaagtggtagttaatgattcaatttttgttggagttgaagttaaagacttaccacatattgataagattacaatcagtagaatttatcgtaatggacatgctattgcacctcatggttatacgcaattacaattaggtgatcatattatcttctctgctagtgctgaagaaagtgcttatttcagacgtaaacttcaaagaaagaatgaatag

SEQ ID NO: 269 - DNA, 801 bp, Lactobacillus salivarius
  isolated from gut, Lactobacillus salivarius
atgaaaaagataaatcctttattaacaatcccttattatctatggataggtttatttgtaattgctccagtgttgttaattgtctattattctttcatagacatccatgggaacttcactttaagtaactatggaaattatttcggttcaggcaagtatttaatgatgactgttaactcattcctatatgcttttattattaccttttttacggttttagtaagttatcccatggcatattttttgacgaagttaaagcataaagaactttggctattgttagtcatcttaccaacctgggttaatttgttgttaaaagcttatgcctttattggtatttttggaattgacggaagtgtaaatcatttccttagtttttttggaataggacctaaacagatattatttactgattttagttttattgttgttgcgacctatattcaaatacctttcatgataatgccaatatttaatgcccttgaagaaattaatccgtcagttttacgtgctagtcgagatttaggtgctaatgaatggcaaaccttctttaaagttgtaatgccattatctatgaatggggtaaaaagtggaattcaagcagtatttattccatcgctctcactatttatgttgacacgtttgataggaggaaatagggtaatcactctaggtactgctatcgaagaacatttcttggtaacacaaaattggggaatgggttcaacaattggtgttgttttgattgttataatgttcattgttatggtaattaccggcgagaaaagggggcataaatag

SEQ ID NO: 270 - DNA, 1041 bp, Lactobacillus salivarius
  isolated from gut, Lactobacillus salivarius
atggtagaattacgattattggatttcttttcaatcgatcaacccaggagacaggcagtattacgccagattcttaaaaataaagtaacaagttcttcaatatactggggattgagatataattatttatcctatctaaatgtttttcctgaattagatgaaaaaaactatgatcgagcaattgcacagttaatagaagaaaattatctaagtaaaaaagataacaaattacttttaaccattaaaggacaacatgctttagatgaatttaagcaacaacactattttattgataagccgcaattgtttaataaatatgatttgaaactatggaaagaaattctacgacttatgatacaagttttatcagaattaagttttgaaaatcgccgatattatgtagtatctcagaatttaaaggctcaattttacattaaaaagtggctctaccaagaaaaaaagaaagtattaataccacaatttaaagaatacttattagattttttggaatctcaacctaaagataaaagtgatattttcatgaattcctttgttggacatggattaccaggatatactattgaacaattaagtgaatttacagggctagcaactgctgatattcaaattgtcatcgctgatctatccttaaaattcgctgactaccttaatcaaaaaggtggtaatttttcaaaaattgtcaatctggtagcaaggtctcagggattgccgactagtgtagaggagacttacactctattacaaaagggctttactgtagaaaaaataaagcaaataagacgacttaaggaaagtactatacaagaacatttaatcattgcctcaatcttgtcgcataattttgattatcatcaagtacttacctctgaagactatcgtattttacaaagcatatattctgatgatgatcttgatgattggaaatatcaggatttagaattgtcagggcaccaaatgcctttttataaatttcgtatatatcaagtgcaacggagcaaattaaataatgatagaacatga

SEQ ID NO: 271 - DNA, 717 bp, Lactobacillus salivarius
  isolated from gut, Lactobacillus salivarius
atgaaagacacaaagaagttatttcaacatggtacattagccttacttgttccaggattatttgacggtacattacctttaagttccttactagaacatggtgatacaggaataggaacagctacaggattagatggcgaaatgattatacttgatggagtgccatatcttgtacgtagcgatggtagtgtaaatgtattagatgctaatgaagtaaaggttccatttgcaaattcccattttgataatccagaaatagaatttgatgttactgatgcaactcctgatcaattaaaggatatgattttctctaagtataatttgaagaatgttttctttgctgtaaaagtaaagggaaaatttgattatataaagacaagagctgttgaagggcaaaagaagccttatccaacattgacagaggtggcagataagcaagctatttttgaagaaaatgatggacaaggaacaattgtaggatacttttctccagaattattccatggaatggcttcagcaggtttccacctacattatttaaataatgcacataatttgggtggacatctgttggattacaagataaaagaagcaaaggtttatttgcaagtgtttgaaagtgtagaaacacattttccagttgaaaacgaagattttatgaaagaagaatttgatattgatagtttacgtgcatcaatatcatctgctgaaaagtag

SEQ ID NO: 272 - DNA, 765 bp, Lactobacillus salivarius
  isolated from gut, Lactobacillus salivarius
atgtcacaactaagcgttaataatttatctttagcattggcttttgcattagtattagtagccgtttatattagtaatcgtgaaaaattaggcctaacaaaggatattttctatagtatttcccgggcaatagtccagcttgtaatcgtaggatacattcttaaatatatcttcaatgtaaataatgttatcttaacagcagcaatgagtttctttattgtgttaaatgctgcttacaatgctcacaagcgaaatcctaatgaccacaagagttactttaattcattattagctatttttgtcagtacatatgtgactatgggagtattagtagcttccggttcaattagatttattccatctcaaattgtccctatcagtgggatgattgcaagtaactctatggttgcgattggtctttgctacagaaatttaaatacactttttaaaaaccaaagacaacaggttttagaaaaattggccttaggagcatctatgaagcaagcttcattacctttattacatgcaagtattaagacagcgatgcaaccaacgatagattctgcaaaaacagttggtttggtaagtttaccaggaatgatgtcaggtttgatttttgctggagtagatccagtaagagcaattaagtatcagattatggttacgttcatgcttttatcggctacgagtttaggatcaattattgcaggatatcgaacatataaagattactataacgaaaaattacaattgagaattaaatag

SEQ ID NO: 273 - DNA, 1293 bp, Lactobacillus salivarius
  isolated from gut, Lactobacillus salivarius
atgaaaagagaaattccagtaaatagtgaaggacattacacaattgggggacttgactctttagaactagctaaagaatttggcacacctacaattgtttatgatgttgctaaaatcaaagaacaaattgcaaagtttaaagcaggttttgaagaagaaaatgttaaatatcacatttcttacgctagtaaggctttttcaagtttagcaatgtatggcttggtggctaagagtggtattggaagtgatgttgtttctggcggagaactttatgcagctttaaaaggtggaatggatccacaagagttggaatttcatggcaataataaatcccgtgctgaattagaaatggcagttgatagtaacgttggttatataattgttgataatttttatgaaattgatttattaaatgaagtacttacagaaaagaataagacagctgatatcctattgcgtttagcaccaggtatccatgctgaaactcatgaatatatctcaacaggtcaagctaaatctaaatttggttttgacttacaaagtggacaagcaagtgaagcattagaaaaaacattggctaaccctcgttttaaagtactaggtgttcacagtcatattggttcacaaattttcgcaactgccggttttgtagaagcagctaagaaattgatggacttcttaagtgcttggaaggaaaaatatgattttacagctgaagtacttaaccttggtggtggttttggaattagatatactgatcaagacgaaccattagatgtaaaagactttgttaagatcattgttgaagcagtcaaagaaaagagtaaggaattaaactatccaatgcctgctatctggattgaaccaggtcgttcagttgttggtgaggctggtgtaagtttatacacagttggctcacgcaaagatgttgaaggtgttggaagctttgttgcagttgatggtggtatgggtgataatattcgtccagccttatatggtgctgaatatgatgctgttttagctaaagatccaaatgcaccgatagcacaaaatgcttcaattgtaggtaagttctgtgaatctggagatattttgattaaagattatgattttcctaagacagaacctggcgatgtgattgcgatgttatcaactggtgcttacggctatgttatggcaagtaactataaccgcaatccacgtccagcaattgtttttgttgaagacggtaaagctcgtttggttgtaaaacgtgaaagttacgaagatatgattcgcaatgaaattctttaa

SEQ ID NO: 274 - DNA, 846 bp, Lactobacillus salivarius
  isolated from gut, Lactobacillus salivarius
atgattacatctacattattaatgctggcagtcggtttattcgccggtgttatgggcgccattctgggaattggtggcggtatgattattacacctatcatcactttagctttgggtttagatatcaaatatgctatcggtgccagcattattgccgttattgcaactagctctggttctacaattgcattcttaaaagatgatgtcttaaacttacgtgtagcaatgttcttagaaattgctactactatcggagctattgttggagctgtcctaactggtattttccatccagcaatcttatatttcttatttggttccttacttattttctcaagttggaatatgtacagaaaactccgcagtggtaaagaaattttaaaaagagccaagcctgacaagtgggcacaaaaatttaatcttaatagttcatattttgacaagaacttaaacaaacaaattgattatcaagttgaaaatattcctggtggtttatccattatgtttggagcaggtattgcctctggaatgttaggaattggttccggtgcttttaaagttatggctatggataatgctatgaaaatgcccctaaaaccatctagtgctaccagcaatttaatgatgggagtaactgctgcagccagtgcttctgtatactttttcaatggatctattaagcctggtattgctgttccacttgctttaggaattttagttggagctgcaatcggaagcagaattatgcagcatcttccttcaagagttattagaatgattttcattcctattctattatatctaggattacaaatgatttttaaggcgtttggggtgacaatataa

SEQ ID NO: 275 - DNA, 1539 bp, Lactobacillus salivarius
  isolated from gut, Lactobacillus salivarius
atgaaatttgatacgagtagatttatatttatagttaaaggattattagttggagcggcagtaggaattgtagttagtttatttcgactattaattgaaaaatttttagtatttatcaagtttttgtttatgcaagcccataataattcaatctattttataattttagcaattataatgttggtatctttaatagctaattctaaattcattaaggatgaaccaaatattaagggatcaggtattccccaagtcgaaggacaacttgctggagaattggaaatgaactggtggtctgttctttggcgtaaatgggttggtggaattttaagtatcggaataggcctatttttagggcgtgaaggtccatcaattcaattaggagcagcagtaggacaggggatagctgaaagaacaaatcatcgcggttctggtagaagaattttaattgctggaggagcttcagcaggattatctgcagcttttaatgcaccaattgcatcaacattatttattcttgaagaggtttatcataatttttctccattagtttggacaacttctttagcagcggcaattgcagctaattttatttctttaaatttttttggtttaataccagtattacatatgtcttataaattagcttttcccattcattattatatccatctagtattattgggaatttttttaggactcttagggtatatttatcaatatttaactttaaatgtcgatagattttataaactatttaaatttatccctagtaattggttagcaataattcccataatattattatttcctttagggtactttttaccagacactttaggtggaggtaatagtttaattcttgaaataggtggtaatattccgacggtatggctgcttttaggtattttcttattaagattactattttctactttatcttacggtagtggattgcctggtggaattttcttgcctattttgacaattggagctactttaggagctttatatggagttgttgcagctcattttggtttattgccagataaatatattgttgactgtattatttatgccatggcaggttattttgcttgtatagggaaagcaccatttacggcgattctcttaattaccgaaatggtaggttctttgcatcatttaatgccattagcagtcgtatcactaacagcatatacagttgttgatttattacgtggacgcccaatttacgaagcattgttagaaaaatctcttaaacgttatacaccacatccagatgagtttacagatcaattagaaattcctgtatttgcaggttcatatttacaagacaaacaagttagagatataacatggcctaaagaatgcttattagtggcaattcaacgtggagaaaaacaaacaatcccacatggtgatacgttaattagaagtggtgatactcttgtaattgagactggagatgctcatcgtgcagaagtggcaagaaaaattggacatattgctaatgacatttccaactggaaaaactag

SEQ ID NO: 276 - DNA, 1437 bp, Lactobacillus salivarius
  isolated from gut, Lactobacillus salivarius
ttggagaaagagaaaatttcacaacaattatctgcgcaagtagatgttaagcatccttggcttgcgatgactagtatgttaattggggcttttgttggtatgttaagtgaaacatcattaaacatcgcccttccaactttaggtaaggtttttaatgttgaacctagttcactacaatggttagtaacaggatatatgttagttattgggattgttttaccatttttaagccttatttctaagtggtttactactcgtcaaattgttatttttgctttagctgatttcgcaattggtgccctaatttcaggttttgcaaatagttttactgttttattaattggacgtttaattcaaggtatcggaactggtttaattctacctttaatgtttactgtcgctatgttaatcttcccaccacaaaaactaggtgcggtaatgggggttaacgccttagttattatgtttgctccagcaattggacctactattactggtatcattttaggagctttatcttggagagatatcttctttatctttacagttttattagttattggtctattatttgcgattttcacacttgaaaatgttaataagattactcgaccacatgttgatgttctttctgttttaggttcaattatcggattttcatctcttgttgctggggtaagttttgccagtgaatctggttggacttcatttaaagttttaggtcttattttagttgcgatcatcgttttaattttatatgctcgtcgtcaattaaaacttgaaaatcctgtattaaatctacgcgttttcagtaaagttaactttagaactggtgctttcttagtcatgattgactttggaattatcttatcatctatgtacttattaccacagttcatccaaaatgcgatgttacttccagttgctatgacaggtatcatcatgcttccaggtggtattattaacgctttggtttccgcaatttctggtcgtttatatgatagtattggtgctaaaattcctgctactatcggattttttatagcattactcggatcaatcatgttcatttttgcatctgaaaaatcctcagttgcttacgttatcacagctcatattatcttaatgattggttgcccacttgctatgtcaccatcacaaactcatggacttaatgctttgcaaggtcctgaatcagctgatggttcaactatcatgaatacacttcaacaaattgttggtgcgatcgctactgcaattgctactagccttttaggtattggcgaagcagtttcacatagctctaataaagctatctcctttacttctggagttcattttggattctacttcactgctttcctaacaattgttggtttactcttagctttaacaattaaaggtaaaaacaagagtcaagatatcgaattacattaa

SEQ ID NO: 277 - DNA, 1728 bp, Lactobacillus salivarius
  isolated from gut, Lactobacillus salivarius
atgcaggagttttttatttttatatgggaggacaacatggattataaagttaaagttgctcaagttattgaacaagctgttgatggaaaattatcacaagaagatattttagctaagatagaaaaacctaagacacttaatttaggggattatgcatttcctgcttttgtattatcaaaagtattacgtaaagcaccacaaatgatagctagtgaattggttgaaaagattgaccaaacaggatttgaaaaggtagaagcagtaggcccatacgtgaatttctttttagacaaaaaagaattcagtaaagatatattatctgaagttttatctgaaggttctgcttacggtaaccaagatttaggtcatggtggaaatgttcctattgatatgtcttcacctaatattgctaagccaatgtcaatgggacatctacgttctacagttatcggcaattctttagcattattacttgaaaaagtaaattataagccaataaaaatagatcatttaggtgactggggaacacaatttggtaaattaattgttgcatataaactatggggaagtgaagaagaagttaaagctgacccaatcaataatttattgaagtattacgttcgtttccatgaagaagatgttaataatcctgaattggatgaagaagcacgtgaatggtttaaaaagttagaagatggtgatgaagaagcacttaaactttggaaatggttccgtgaagaatctctaaagaaatttactgaagtatatgatcgtttaaatattacctttgattcatataatggtgaagcattctataatgataaaatggatgaaattacagacttgcttcaagaaaagggattattaaaagaaagtcaaggggcagaaattgtagatttagaaaaatacgatttaaaccctgctttaattagaaaaacagacggagcaacactatatattactcgtgatttagctgctgcattatatcgttaccgtacatatgattttgtacaatcattatacgtagtaggtcaagaacaaactaaccattttaagcaattgaaagccattttaaaagaaatgggatacgactggtcagatgatattcatcatattccatttggattgattacatccggtggtaagaagttgtctactcgttctggacgtgtaattttattagaagaagttttagatgatgctgttaaattagctaataagcaaatcgaagaaaagaatccaaaccttgctgacaaggaagaagtagcagaagctgtaggtgtaggtgctgttgtcttccatgatttgaagaatgaaagaattaacagtttcgactttaacttagatgaagttgtccgttttgaaggagaaacaggaccatacgtacaatactcacatgcacgtgctatgagtatattacgtaaagcaggtgatttagaattagattctgataacttagaaattagtgatccagaagcatggcaaacactacgtttattggctgctttccctgaaacagtaaagaaagctgttagtgaatatgaaccttctgttgttgcaaaatatgcaattcatttagcgaaagcatttaataaatactatgcacattctagaattttgaatgatgatgctgaaaagaatgcaagattagcattagtacaaagtgttgctactacattaaaagaatctttacgtttattaggtgtaaaagctcctaatgaaatgtaa

SEQ ID NO: 278 - DNA, 1284 bp, Lactobacillus salivarius
  isolated from gut, Lactobacillus salivarius
atggcgacatctgaaaataaagatatcaaagaattaacaattgctgaattggaaaacatgacgctaaaggaaatttataattacgcaagaatttataaaattccttactatagcaaaatgaataaaaaagaattatctttagcggtaattcgagcacaagcaaataaaaatggtttctatatgaaaggaattttagaaatagttcctaatcaagatggttatggattcttgagacctattaattatggaccatcacaagaggatatctatatttcagcatcacagattagacgatttggtttaagaaatggtgatgaagttgcagggacagctcgcccacctcgacaaggcgaaaaattttatggaattttacacgttgattctgtaaataataaggatcctgaagaagccaagaaacgcgatcattttccagctttaacgccaatttatccagataaacagatagaattggaaacaattaagggacaattatctacacgtgtgatagatttatttgcaccaattggatttggtcaacgtggtttaattgttgcgccacctaaagctggaaagactagtttgttaaaagcaattgccaaaggaatttctgcaaattacccagatgcgaaattgttattattactaattgatgaacgtccagaagaagttacagatttagaaagaacagttaacggtgaagttgtttactcaacttttgaccaacgtcctgaaaatcacgtacgagtagctgaattgttactagaaagagcgatgagattagttgaagataaacaagatgtaattattttgttagattctttaactcgtttagctagagcttataatttagttgttccaccaagtggacgaacattatctggtggtattgatccggcagccttatataaaccaaagaaattctttggtgcagcacggaatattgaagagggcggaagcttgacgatcttggcgactgcattagtagatactggttctcgtatggatgatgttatctatgaagaatttaagggaactggtaaccaagaacttcacttatcacgtgaattggcagaaagaagagtctttcctgctgtcgatataaagcgttcaggaacaagaaaagaagaattattattatcacaagagaaattggatgcattatggaaattgcgtaaaaacttgagtaatgatttagtttctgacactgaacaggtgctacaacttttacgtaattcgcaagataatgctgaattttgtggtaaaattgaaaaaatgatgaaataa

SEQ ID NO: 279 - DNA, 852 bp, Lactobacillus salivarius
  isolated from gut, Lactobacillus salivarius
atgcagctatttgatgaattaaaaacaattagtaaaaagcatattaaggctaacaaaaaagccggagaaaaagttccttcgggattatggatttcttgccctaaatgtcaacaatctatatatcataaagatttaggtaagtataaaacatgtccaaattgttactatgggtttagaattcatgctcgtgagagattagaatggttagtagatacttttcaagaatttgatacagatttagaaactaaagatccattaaattttcctggatataaagaaaaattaattaaagcacaacaagacagtaaacttaacgattcagttttaactggaatagcaatgattgatgatgttgaatttgctttaggcataatggatccatacttcattatgggctcaatgggaactgtgactggcgagaagataactcgtttgtttgagagagctactcagaagaatttaccagtaatattatttacagcttctggtggtgctagaatgcaagaaggaattagttccttaatgcagatgagcaagatctctcaagcagtcaaggaacattcaaatgcaggtttattgtacataactgtcattacagaccctactacaggtggagtgacagcaagttttgcaatgcagggagatataattctttctgaaccaagagcattattgggatttgcaggtaaacgtgtaatagaacaaactattcaccaaaaggtaccagatgatttacaagatgcagaaactgttttaaagaatggatttattgataatattattaaacgtgaagatcaaaaagaaaaattagcatggttggtaaaaattcattcaatgaaaggagctttttag

SEQ ID NO: 280 - DNA, 1281 bp, Lactobacillus salivarius
  isolated from gut, Lactobacillus salivarius
atgagtaaatatcaatttaaattgccagatatcggtgaaggtattgcagaaggtacaattggcgaatggcatgtaaaacctggtgacaaggtggaagtcgatggagatttagttcaaattgaaaatgataaatcagttgaagaaattccttctccagtttcaggtacagtaacaaaaatattggttgaagaaggcgaaactgctgaagttggtcaaccattgatcgaattagaagttgcagaaggagaaggtaatgtagctgacgatgctcctgctgcagaaactgaaaaagaagaaaaagtggaagccgcaccagcaccaaatacacaaccaactccacaagttgcagatcatagcttgccagttcttgcaatgccagcagttcgtcgctatgcacgtgaacaaggaattgacttgaagttagtaccaggttctggtcgtcatggtcaagtattgagaagtgatattgatgcctttaaagctaatggtggtgcagttgctgctgctcctgaagcaacaccagctgtggaagaagcagcaccacaaccagctcctaatttacctgctggagatgctcaatggcctgaaacacgtgaaaagatgtcaggcattcgcaaagcaacagcaaatgcaatggtacgttcagtatctcaaattccacatgtgcatgtatttgatgaagtaattgttgataaattatgggcacatcgcaagaagtacaaggaacttgctgcagaacgcgatgtccgtctaacattcatggcatatatggtaaaagcattagccgtagttatgaaggaattcccaatcttcaactcatctgtagatatggataagcatgaaattgtttataaagattacatcaatgtaggaattgctacagatacagatagaggattatttgttccaaatgtaaaacatgctgatagcacaagcctatttggtattgctaaacaaattactgaaaacacagctaaagctaaagatggtaaattaacagccggtgatatgagtcacacaggtatgtcaattacaaatatcggttcagtaggtggcggtcactttacaccagtaattaactggccagaagttgctatcttaggtatgggtcgtattactgatgaaccagttgttgttgaaggtgaagtaaagattgctaaagtcttgaagttatctttggcatttgatcatcgcgtaattgatggtgcaacagctcaacgtgcaatgaatcgcttgaaagaattattaagtgacccagaattgttattaatggaaggatga

SEQ ID NO: 281 - DNA, 1128 bp, Lactobacillus salivarius
  isolated from gut, Lactobacillus salivarius
gtgaaagacaagagtcaaattcgtgtcgttgtgggaatgagtggtggagttgattcttcagtttctgcttacttattgaaacaacaaggatatgacgttgttggtgtatttatgaagaactgggatgataagaatgatagtggtgtctgtacagtaacagaagactatcaagacgtagctaaagttgctagtcaaattggtattccttattactcagttaactttgaaaaggaatattgggatagagtattcacatatttccttgatgaatataaaaatggacgtactccaaatcctgatattatgtgtaacaaagaagttaagtttaaagctttcttagattacgcaatgtctattgatgcagattatattgcaatgggacactatgcacaattgcgtcgtgatgaagatggcaaggtgcacttactacgtggagcagatgataacaaggatcaaacttatttcttgagtcagctttcacaagaacaattacaaaaagtaatgttcccaattggacacttacaaaaatcagaagtaagaagaattgctgaaaaagcaggtttagcaactgctaaaaagaaagattcaactggaatttgctttatcggtgaacgtaactttagtaaattcttaggcgagttcttacctgctcaaccaggtgaaatggtaactcttgacggtgaagtaaagggaaatcattttggcttgatgaactatactattggtcaacgtaaaggcttaggtatcggtggcgatggtaagagtaatgagccatggtttgttatcggtaaagatttgaagacaaatactttattagtaggacaaggctaccacaatgaacatttatacgctaatagtttagatgcttcaaaattaagttttgttgacgatatttctgatcgtggcgatgaattccattgtacagctaagttccgttatcgccaaaaggatacaggagttacagttaaatttaatgaagatcgtacaaaggttgaagttatttttgacgaacctgtacgtgctattactcctggacaagaagttgtattttatgatggcgaagaatgtctaggtagtggaactattgaccacgcatataaggaaagtaaattattacaatacgtataa

SEQ ID NO: 282 - DNA, 435 bp, Lactobacillus salivarius
  isolated from gut, Lactobacillus salivarius
atgaaattacatgaattgaaacctgctgaaggttcacgccaagtacgtaatcgtgttggtcgtggtacttcatctggtaatggtaagactgctggtcgtggtcaaaaaggtcaaaaggctcgcggtaaggtacgtttaggttttgaaggtggacaaatgccattgttccgtcgtatgccaaaacgtggtttcaagaacatcaatcgtaaagaatatgctattgtaaacttggaaactttaaataaatttgaagatggtgcagaagtaacacctgcattattagtagaatctggtatcattaaagatgaaaaagatggtatcaaagtacttggcaatggtacattgaacaagcaattgactgtaaaggcaagcaagttctctgcatctgctaaggaagcaatcgaatctaaaggcggtaaagctgaggtgatttaa

SEQ ID NO: 283 - DNA, 699 bp, Lactobacillus salivarius
  isolated from gut, Lactobacillus salivarius
atggacggaaataaattatcgtatcgtttacaaaaagtggcagaatatgttcctgctgatagtcgattagcggacatcggttctgatcatgcttatttaccagcatatttagcattaaaaggtaagattaactttggaattgctggtgaagttgttaaaggaccttttcaaaatgctcaaaatgaaattaaaaaagaaaacttacaagagataatagatgttcgtttggctgacggattagctgcagttgaactttcagatgagattaatgtagttacaatctgtggtatgggtggtccattaatttgtcagattctagaagaaggaaaggctaagttagctaatcatcctcgcttagttttacaacctaatgtaggtgagaaaaatgtcagagaatggctagtagcgaacaactatcaaataattgccgaagatattttagaagaagacggacatatctacgaaattatcgtagcggaatttgttgatgcaaaggctgagctaacagctaaagaattagaatttggtccttacttaatgaaagaaaagaacgaagtctttaagcataaatggcaaaaggaattagataagattgaaacagttagagttcagctggaaaaagccaaggaaaagccagttgctaagttagaatatctagacgaacaagtaaaactaatagaaggtgtattaaatgactaa

SEQ ID NO: 284 - DNA, 972 bp, Lactobacillus salivarius
  isolated from gut, Lactobacillus salivarius
ttgattttgatctttagaggaggatatatggctgaatttaagcatattacagtattattaaatgaagctgtagatggtctgaatattaagccagatggaacttacgttgattgtaccttgggtggtggcggtcatagtggtttgatactaagtaagttatcagaaaatgggaaattatattcatttgaccaagatataacagctattaattttaataaggataagtttgaagaagaaaatgaactgggaaagattaactttatcaaaagtaattttagaaatatttctgaagagttaaataaaagaaatattttgggagtagatggaattctctatgacttgggtgtctcatcgccgcagttcgacaatgcagatcgtggttttagttataactatgatgctcctctagatatgagaatggatcaaagtcaatcattaacagctagagatgtggtaaatgactggagttatgaacaattagtgagaattttcttccgttacggtgaagaaaaatttgctaagtcaattgctcgtagaattgagaaagttagacagcaaacaccaattgagacaactggtcaactggttgatcttattaaagaagctattccggctaaggcccgtagaaaaggtggacatccagctaaaaaaacattccaggcaattaggattgcagtcaatgatgaattaggtgcattggaagaatctttggagcaagctttagatttattaaatcctggtggtcgtattagtgtaattaccttccaatcattggaggatcgattagttaaggtaatgtttaagcagaagacaagtctaccagaattacctcccggattaccagtaattccggatagccaaaaagttgagtacaaattgattacaagaaagccgatagtaccaagtgaagacgagattacacacaataatcgtgctcactcggctaaattaagaataattgaaaaattgtag

SEQ ID NO: 285 - DNA, 1215 bp, Lactobacillus salivarius
  isolated from gut, Lactobacillus salivarius
atgattgtagaaaatataccagatgagtttaaaaaagcattacctattttagagaaaattagagaagctggatttgaagcatactttgttggtggtagtgttcgtgatactttacttggtctaccaattcatgatgttgatattgcttcaagtgcctatcctgaggagattaaacaaatatttagtaagactgttgatacaggtgtagaacatggtacggtgatggttttagaccacggtactggatatgaaattactacttttcgaacagaatcaacttatcaagactatcgaagacctgataaggttgagtttgtgcgctctttagaagaagatttaaaacgaagagatttaacaatcaatgctcttgcgatggatgataagggtaaaatcatagatttattcgatggattaaaagatttgaaaaatggcattataagagccgttggaaatccagaagaacgattccatgaagatgcattacgtatgatgcgtgctgtcagatttggtagtcaattagatttcaaagtagaactagataccttcaatgctattaagaaaaattcccatttacttgaaaaaattgcaattgaaagaattcatgtagaatgggttaaacttctcttaggtaagaatcctaaacaaggattaaaagaatttttagatacagaattatataaatactgcccattatttacagataaatatgctgaattaaagtctatattggaatttccagactttaaattaaatacagaagaagaatgttggacattattatctgatgtttttaagttaaaagatactgatataagcaatttattacgttcttggaagagttctaataacattattaaatatgttattgcagctagtttatgtgtccaaaaaatcaaagatagtaagttagatattgagacatattatcaaaatggattagaaatcattttaacagctaaccaaattgcaaaaatacgaggatttggtatggatgataatgagcttaaaatcaattatgataaattaccgattaaatctagaaaagaaatgaagattaatggtaaggatcttgtgcaagaggcagggatcaaacctggaaaaataatgggtgaaattttaaataaacttgaaaaagaaatagtttttggaaatattattaatgacaaagaaacattaatagaaaatgcaaagaaactattagaagagaaagtgtga

SEQ ID NO: 286 - DNA, 1323 bp, Lactobacillus salivarius
  isolated from gut, Lactobacillus salivarius
ttggaagaactttttgaaaaagctccagtcaaaaaagtctactatcaactagcattgccagtagtgtttagtatgatcattagtatggtatataatatcgctgatacatattttgtcgctaagactggaaacactgatttagtggcaggaattactgtaagttcgccactatttatgtttatgctagcaattggtgacatttttggcttaggtggaagtgccttaatttcaagactatttggacaaaaacgatatgaagaaagtaagcatgtaagtagctttagtttttatggagatataatttttacgattattttgacagtattgttattagtttttgaagcacctatcatgcatcttctaggggccaatgctcagacttaccaatatgcagctgaattttatcgtgtattagtaatcggctcggtttttatcacattatcattagttccaggtaacatgattagaacagaaggacttgcggttaagtcaatgatagcgacaatttctggaacagtactagcaatcattttagatccgatttttctatttggatttaagtggggtgctgctggggtagcatttgctaatgttttagggtatgcactaaatacaggattactaatctactttacttggaaggatagtaagtttttgtcatttaatcctaaatacattaaagtcagctggcatcattttaaagagattatcgcaatcgggattccaagctctgttactaatttcatgcaaacatttgggatggctttactaaataactatcttgttatttatgggaatgacaaggttgcggcgatgggaatcacgcaaaaggtgtatgggattgtaacacttgtcttggtaggttttgcttttggagctcagccattaattggatataactatggggctaagaatgcaaagagattccgagaagttttgcgttatgatttcaaggtggaagtagtttatgcgattattgcttccttgatcttgattgtactttctccattcgtaattaagttgtttatgaataatccgcaaatcattgctgatggttcctatatgttgagagtctgtctactaacaacgccatttattggagctatcttggtttatactactgtttttcaatcagctgggaaaggctggagtgccttggtaatgtcaatttctcgtcaaggtgtggtgtattttattagtatggtagtaatggttaagattctcggctaccatggagtagtaatggcacaaccagttgcggacattttaacttgtgcaattggttatttaatttatcagagagattttcggaaatttaagtaa

SEQ ID NO: 287 - DNA, 1371 bp, Lactobacillus salivarius
  isolated from gut, Lactobacillus salivarius
atgaagttgaatgtaaaaaaatttgaaaatcaattattacagcgacttagggatttaaaaatttccaataaaaaagtattacttgcggtttctacaggtgtagattctatggtcttattatcaggaatgttgaaattgagtaaagttttagatgtagaaattaatgtcgcttatattgatcatcaattacgagagcaaagcaaagaagaaacaaaatttattaaagagttttgttttgcacgaaatattcctttatatgtatacaggtgggaaaaagaagaacatcctgtacaaagcattgaagctgcagccagagaagttagatataacttttttgaaaaagtcctaaaagaaaataatattgagtacttggtaacggcgcatcatggagatgaccaagcagaaacttttttaatgaaattaattcgaggtgggaatattcaacaattacaagcaattcaatctgtacgtatatttagagaggattatcaaatagttcgtcccatgttaatttttaataaaaaagaaatttatgattatgctaaacaattagggattaaatattatgaggatgaaactaacaaaagcgatgactaccaaagaaatagattacgacatcatataattccagtattaaaagcagaaaatccagaatttttaaagcatgtattaggatatactcagcaattaacaaataatttacaagcaattcaagaagtagctgatgtgaaactgaataagatttctaaagaagagactttggactatgataaatttgttaaagaaagtcccttatggcaacgtattttacttgaacgatatttagaagtaaaaggattggaaatcaaagaaacgcaggtacagcaaattttagcgatgcttaatgatgagaagaaacctcaagcaaagattgatttgaacgaaaaatttgaattctatcatgaatatcttgaaatgggaataagaattaaaaacagtattagttttaatctagaagaaaattttgaattaaaattaaatcaatggcacagtttggaagagggaaaaaagataggtttatttaagattaatgaaatagaactaatgcctggagatgaaattctggctgtagaagataatgtaaattgggtaattagacatagacaaccaggtgattcactaaaaatgagctttggaaatcaaaaaattaaaaaagtttttattgataaaaaaattccaagtgaacagagaaataagagttggctaattacaaaaaataaaaatgaagtgtattggattttagaaacaaaaaaaactgatttgtcactggccccacaaaatgctaaaattcattacatactagtatttagaaaaaagcaagaaagaggttaa

SEQ ID NO: 288 - DNA, 2061 bp, Unknownn
  isolated from gut, unidentified
atggcaatttttcatatgagttttagtaatattagtgctggaaaaggacgaagtgcgattgccagtgccgcttatcgaagcggtgaaaaattatttgatgataaggaaggacgccactacttttatgcccgcgcggttatgccagaaagctttattttaaccccaaaaaacgcaccagaatgggccagtaatcgagaacaattatggaatgaagttgaaaagaaagatcgtaaatcaaactcacggtatgcaaaagaatttaacgtggctttaccggtagaattaagtgaatccgaacagaaagaattactgacaaaatatgtgcaggaaaattttgtcgatcaaggtatggtagctgacgtagcaattcatcatgatcaccaagataatccgcacgcacatgtgatgttaacgaatcgaccatttaaccccgatggtagttggggattaaaagcaaagacgcagtacattaaagatgaaaatggcaagcaacttttaaccaaaagcgggtttccaaaacaaagaaaaatttggttggttgattgggataaaaaggaaaaaattaatgagtggcgaaaaaattgggcgttgagtgttaatcagttcttagcacaaaaaaatattccggatcggattagtgaaaaatcgtttgtggaacagggaatagctgatacaccaatgcaacacgagggaatcaatagtaaacggcatgaaagaaaggcatttaatcaacaagttaagacctatcgtaagtccaaagctggctataaaaatatgcaggaaaaagtaattaatcgaggtcatttagatagcctaagtaaacacttctcatttaatgaaaaaaggttggtaaatgagttaagtcatgaactgaaaacttatatcagtctggagagtttagatgataaacggcgtctgctatttaattggaaaaacagtaccttaattaagcacgctattggtgaagatgtcactaagcaattattgacgattaaccaacaagaaagttcactaaaaaaagcagatgaactcttaaataaagtagttgatcgtacgactaaaaaactttatccagagcttgattttgaacagataaccgcggctgaacgacgggaattgattaaagaaaccgatagcgaacaaacagttttcaagggtagtgaattaaacgaacgtttaatgaacattcgtgatgatttgttgacccaacaattattgacctttaccaaacggccatacgttggctggaagttattaatgcaacaagaaaaggaagtcagaatcaagcttaaatatacgctgatgattcatgatgatagcttagaaagtctagaacacgttgatcaaggtctactagaaaagtattcaccaaccgagcagcaaaagattactcgagcagtcaaagatttacgaacaatcatggctgtgaagcaagttattcaaacccaataccaggaagttttaagaagagcctttcctaacggcgattttaatgaattaccaatgattaaacaggaacaggcctatacagcagtgatgtactatgatccagctttaaaaccgtgcaagattgaaacaatcgcacaatggcgggaaaatccaccgagggtattcaatactcaggaacatcaacaaggactagcttatctatcgggacagctgagcttagatcagttagataatcaccatttacaacgggttttaaagcatgacggtactaaacaactctttttgggtgaatgcaaagccgatccaatgattaagaatagtcagatcgagaaaatccaaaagcagttaaaagagcaacaagccaaggacgaccagtatagaaaagtaaatatgggacattatcaaccgctaaattacaagccagttagtccaagctactacttaaagacagcctttagtaacgcaatcatgactgccctatatgcccgtgatgaagattacgaacgacaaaaacaggcacacggcttaaaagagactgagtgggcaatgacgaaaaagcagcggcaacaccaaacccgtaatcggcatgaagatgggggtatgcacttgtaa

SEQ ID NO: 289 - DNA, 849 bp, Lactobacillus salivarius
  isolated from gut, Lactobacillus salivarius
atgactaaagaagttgtaattgtaacaggtgcttcaaaaggaatcggttttgaaacagttttagctgctttaaataatgatatgatagtagttggcacttctcgtacacctgaaaagctggttgctaaggttcaagaaaagctactagctaaagtagataactttactgcaatgaagatggacttcaatgaagaaagcattaagcaagttgtatcagaagtgattgctaaatttggcagaattgatgttttagttaataatgctggttacgcaatcttgggtgcttttgaagatatggatatggcagaagttagaactaactttgatgtcaacgtctttggattaatgagtatgactcaaacagttttgccacaaatgcgtaaacaaaagagtggtcgcattattaatctatcttcaatttctggatctgttactggtccaagtcaatcaatctactcagctagcaaggcagcagtaactttaatgagtgaagacttagctcaagaagtagcaccatataatattaaagtaactgcactttgcccatggggagtacgtactgatttcttagatgaatcatctttgaagaaaccagctactcaaggtggggattacaaggtagttgatcaaactttagctggtttggcacgtctaaatcataatcaaaatggcgatcctgctttggtagctcaagcaatcatgaaagtagtagatatgcctaatccaccagctcgtctttatttaggtgcaggtgctttaatggcagttcaaagtaagattgaagaaatagtccaagtggcaaatgaaaatctagaattaagtcaaagtatcgatagcccagcaaattaa

SEQ ID NO: 290 - DNA, 1296 bp, Lactobacillus salivarius
  isolated from gut, Lactobacillus salivarius
atggtactattatttcaacgtaaatatggaaaggaaaaaatagtgcttaagaaattaaaaaaattaggaataagtttcctaacttctttgatggtagtaacagggatagggcaaggattgattaaggctgatcagactttgccacaattagatttagaggctaaatcagcaattgcggtagacgctaagacagggcaaatcatttacgctaaagatgataaacaaacatatccagttgcgtctatgtctaaactgctgacagcttatatattgttacaagcgattcataaaggtgaagttacctgggaaactaaagtaactcctactgcaactgaagtagatattagtaataatactgaattgacaaatgtacctttacaagaggggcatagttatactataaggcagttgtatcaagcaatgttggtaggttcagcgaatgcagcaactatgttgataggcaatgctatttcgggaacacagaccaagtttatagataagatgagagaaactgccaaaagtttgggaattacagatgctaaaatctatagtgcgaatgggctaacagctaagtatttgggcgatgaaatttatcccaatacagatgaaaatgcagaaaacgaattttcagtacgagatatggctattatttcgcaaaagttgattgaagagtatccagagattttagaaacgactaaattaaccaagatcgactttaacgataatggagaaattacaactgttaataatacgaatgaattattacaggatgattcaaatttagaagttgatggtcttaaaacaggaacatcagatgcagcaggttattgttttgcatcaacaactaacaaagatgggcatcgcatcataacagtaattgctggagcaaaagacaatgatgctagatttgatcaaaccaagaatttgttaaattatatctacaataattatgactacttggctataagtaccaatcaagcgttaagacaagatgttaaagtcaaatatggaaaacaaagcagtgtatcaacaataatcggaaatgatttaagtttatgggtgcctaagaacactagggaaaaggcgctacaaattaaattaacaccaaaatcttctacaatagaagcaccaatcaagcaaggtgaaacagtgggagattatcaaataacgattgctggtaacttagggttcatagatggatcaacggatttgaaaactaaagcattagctgctaatagtgtagaaggaattaatatctttataaaatggtggcaaatgctgactgatgcaatatag

SEQ ID NO: 291 - DNA, 879 bp, Lactobacillus salivarius
  isolated from gut, Lactobacillus salivarius
atgacaggaattaagattgatggattatcaaagaaatttcgtaagaaaaacgtattggataatatatcagtagaatttaaacctaataagatttatggacttttaggtagaaacggtgctggaaagagtacattattaaatattatcgctaatcgattatatgcagatcaaggaaatttaacactggacgatgaaaatttagtagaaaatgacagtgcattaggtagattatatttgatgaatgatgtcgatatgtacaacaaaagtatgagattggacaaaattttcgaatatactgaacaattttatggaagtttcgactatgaatatgctgaaaagttagctgaaagatttaaaattgatactcatcaaaaatttggaaaattttcaacaggttatcacacaatcgctaagttaatcattgcattatgtgtaccggcagattacatcttcttggatgaaccagtattaggtttagatgctaatcatcgaacaattttctatgaggaattaatgactacttacagtgaacgtccacgtacattcgttgtagcaactcatttgattgaggaaattactaatattttagaacatgtcatgattgtgtctgaaagtaaaattacaattgatgaagatgttgaagatattttggctaaatcacatttgattgtgggaccacaagttgaaactaaagattatgtcgaaggtctaaatatcgttggaaaagaaagtctgggtaatttacaaggttactatgtatatggtgatttgaatgacgataagatattaccagatactgtacaaattgaacgcgttgacttgcaaaagatgtttatatatttaacaaatcaaggtggtgaaaatggtgttaacaagtaa

SEQ ID NO: 292 - DNA, 1260 bp, Lactobacillus salivarius
  isolated from gut, Lactobacillus salivarius
gtgatacctgttattattgccggtttagaaaatgactatgaaaatttcgaatataaaatggatgaactttcatctttagcctacgctaataatatggaagttatcgtttctgtaaagcaaaaattagaacatccaattgctgctacttactttggtaaaggaaaggctgaggaaattcgtcatgtgggagaagttaatgatattgacactttaattgtaaatgcagagctaacccctactcagttacgtaacctcgaagatattaccgggcttcaagttattgatagaacggccttgattctagaaatatttgcttctcgagctcaaacaaaagaagctaaacttcaagttcaaatcgcaaaattgcaatatcaattacctagattaagaacttctagtatcaaccgtatggaccaacaaacttctggtaatactggcggtggttataccaaccgtggttctggggaaacaaaattagaacttaataagcgtgttattgaaaaaaggattagcaatctttccaaagaactcaaagaaatagagagcgtgcatgaaaatcaacgtcgtgcaagagaacgttctagcattaaaactgttgctctagttggttatacaaatgccggaaagtcaactactatgaatggtttattaaaactactggaacaacctactaataaggaagtttttgaaaaagacatgcttttcgctactcttgacacttctattagaaaaattaaattacccgataacaaggaatttttcttaagtgatactgttggtttcgtttctgacttgcctcatcaattggttaaagcattccgtactaccctttccgaagctaatcaagctgacttattgattcaagttattgatggtagtgatgaacacgcaaaagatatgattgaaacaactaaacaaaccttggatgaaatcggagttaaggatattcctatgatatatgcttataacaaatccgatttaacaagtacaccttacccaagttccgttggtaatcaattttactatagcgctaaggataaaaagtctattgaaatgttaattaacttaatcaaagaaaatctatttcaggactatgttactcatacttacttaattccattttctgagggacgctacttagaaataattaataagcaagcaaatattttaaaaactgactatcttgctgagggtactaaaataacagctgaatcaacgcctatcatggcacaacaactcaagcaattcattatagactaa

SEQ ID NO: 293 - DNA, 1137 bp, Lactobacillus salivarius
  isolated from gut, Lactobacillus salivarius
atgagtacagttttaaaacatggacttatttatactggttccgaaaaaattgtagatggatatttacgatttgataaacaaattatcaatgttggaccaatgtctgaatataaagcccaagtatctgatgataaaattattgatttggaaggacaagttgtagttcctggctttatcgacgttcatagccatggtggttatagcttcgattccatggatggcgatgctaaccaaattgatgaaatggttaatgatatggtccatgaaggtattactacatatttcgctacaactatgactcaatctcatgaaaatattgcgcatgcgatggttggcattaaagaagctgctgcaaaaaatccagttattcaaggtattcatcttgaaggaccttttgtttcacctgttttcaaaggagctcaaccagaagaatatatcgaatctcctgatatcgatgctttcgctcattggaatgaactatctggtggcatgattaaattagttacttatgctcctgaaaatgaaaatactactgaatttgaaaaatattgtattgaacacaacatcgtattatctgtaggtcatagtaatgctacacgtgctcaaatgaaaggctcacttgctagtcacgttactcatttatacaatgctcaacgtgaattgaagcatcgcgaaccaggtgttactggtcatgcccttctcgaaggaaatatgtattgcgaaatcattgctgatggattccacgttttcccagatatgattaaactagcttatgaccttaaaggaccagacaagattgaattagttactgactccatgcgtgcaaaaggtatgcctgaaggagtttcagaattaggtggtcaaaaagttatcgttaaagataagcaagctcgtctagaatctggtaatttagctggttctgtattgcaataccaagatgcctttaagaatattatgaaatttactggttgcggtattgaagaagctgtgaaaatgtcttctgttaaccaagctcgtgaatttggcttaactcaaaaaggtgctattgaagttggcaaagatgctgacttaaatgtgcttgattctgatttaaatgttgttaaaacatttagttttggtcgtttatttgaaaaatag

SEQ ID NO: 294 - DNA, 2067 bp, Lactobacillus salivarius
  isolated from gut, Lactobacillus salivarius
gtgaaatttttacgcagttcacggagaaatagacggaatagtaatcaaaattcattaattccgtttagattaaattttctctttgttattgtatttttattatttgcagcattgattgctcagttagcatatttacaaattgttaatggacagaaattttcaagtgaagcagcaaataatgatacttatactgaaaccactaatgttcaacgtgggatgatgtatgattcaacaggtaagttaattgttggtaataattcttcaagagcaattacctataccaaaccccttggcgttacgaatcaaaaaatgagagcaattgctgatgaattggtaaaatttgtatctatcaaaacagattcattaacgagtgggatgaaggctgaatattatctagctaatgtaaagaactatgacgctgtaaaagagcatattaaaaatgctgatagtttagatagtagtgagttaaatcgtctaatgatcacttatgttagaaaatacggtttagtttctgatatgactaataaggaaaaagaggcagcaattgtttataacaagatgagtggtgcttatgctctatcaagtgtttatattaagactagtggtgttagcgatactgaaatggctgaagttggtgaaaatctttcttcaatgcctggaataaagattggaacagattggacacgtagttatccagatggaacatcgataaagaatttagctgggactgtaacaactgaaaagcaaggtttaccagatgattctattaatactttcttagctcaaggatattcaagaaatgatagtgttggttcaagttatttagaaaagcaatatcaggatgtcctaaagggtactaagaaaactacaaaagtatttactcaaaatggtaaaattactaaagaagttgaacaatatggtggacaagccggtgatgatgttcagctaacaattaatgctaaattccaacaagatatgcaaaaaataatggatagcgcagttgctggattaggtggttattcaaatggtggttatgcagtagcgattaacccacatactggtggcatttatggtatggccggtgtttatcgtgaccctaacactggtaagacaactgttgatcctgctggggcaattaatcaatctattactatggggtctgttgttaagccagctatgattattggagctttgaagtcaggcgttattacacctgataataatgtattgactgatatgccaatcaaagttaaagatacgccagtcaagggatcatggtttaataagagtggtggagctaatgtggctttaactgcttctgatgctttgatggtttcttctaactcgtacatgatgcaacttgctatgaaggaagcaggatttaagtatagttatggtgcaaccttaactatgccaacctcaatttttaagaaattaagaaataactttaatgagtttggcttgggtgtaagaacagggattgatttacctggtgaagtttctggattggaaggtaagagtacagctaaatatattggtagtgcccttgacctttcttatgggaactatgattcttacacaacaattcaattagcccaatacgcttccattttggctaataaaggttataaaattcaaccacatttactacaatcaatcagagcaaatggcaaagatggtaagatgggtgctgtaaaatatgaagttaagcctaatatcacgggcgtgatagatgttccagattcttattgggatattattcacagtggtatgtataaagtagtacacggaactagtcaatatgcaactggtacagcaatgaaggatattaatccagccattgcagctaaaacaggtactgctgaaactgtttataagaatactgatacaatcacattaagtgctattagttatgctccttatgatgatccacaagtagtagtggttgtagctttcccaaatcttgctagtgataaaagtagtgttaacatgaatactttgaagagtatttatgaagcatactggaaagatgtccaatctagcgatggatataaaacatctaaataa

SEQ ID NO: 295 - DNA, 594 bp, Lactobacillus salivarius
  isolated from gut, Lactobacillus salivarius
atgcaccaaaatgatttaagggtgagaaagactcgcgcaaagataaaaagggcattgatcgaaactattaacgaaaaaggttttggaaatctaacagtatctgatattactgaaagagctggaattaaccgaggaactttctatattcattacaagggtaaacaagatttgttggaacaattagaggaagctatatattctgacattatacagttattccatgataatggaacaatttcctcagcgactagttatgaagatttgaacagacaattttttcaaaagttttcggcctacatttatggagagcgagactttatcttagcgatggtgttaggaaatggtgacccaatgttttaccataaaattaagcaaatcttgactcgagaattgcttaaaaggatggagtatttaggtatcaagatgagtgacgagataccacacgaatatatcgaagaatatgcaatcggtagcatgttaaatttatcaatttattggttggaaaaggacaatcctgaactaccaaatgaatttgcaaaaataatgatgcgtacacgaacaaaagcaccattagcatttgcggttaaggaataa

SEQ ID NO: 296 - DNA, 1299 bp, Lactobacillus salivarius
  isolated from gut, Lactobacillus salivarius
atgaatagattaaccaaagcgacctatgtgtattggttgttagtaatgataaattttgtttcagtaatgtttaacgtatccttatatttactaattactagttatatttcaaaaaagaatcttagcttatacctcttacaacaattacaagtcatgcctggtaattttagattacttttttgggcagtatttgtactttttggatgcttagttactgtcatctatttacgccgaacctcaaccaataaaaagacgaataaattactctggctagaattattactaatagtattaattttttggctaactaaggcaacttatggtggtttagtcttcttagcctttgctgatatctttttttcaactgatgacttccacaccattagtaataaattttattggctgattttcattatcgttgcttcggtatgcttactagtatcaaatagtaattttttggcaactttaatttccttaccatcattagaaatttatattagctttttaccgagtcatgtggcaactctgttatctctaatgcgactatttctttttattattagtatcgttatttttactttagccttatttacacatgtcgtttatataacaaatgagaaacgcaatatcgaagaagagcttagaatggctgatcacgctaatgtcgaacttcagcactatattagtgttgccgaagagaatgccgaattgcgtgaacgaaaacgtatttcccgggaaatacacgacactctaggccatgctttaactggaatttcagctggtattgatgctgtcctagtgctaattgatatggataaagatagcgccaaggagcaattaaggaatttatctgaggtagtacgtcaaggtattgtagatgtacgtaagtcattaaataaaatgcgtcccggagctttagaaaaattatccttatacgattcgattgttgatatgattagtcgctatgataatattccaactttaacgattgatttagattttcaatggcaaggcgttgatttagagaaaactactgaaaatgtcgtctttagaattatcgaagaatccattactaattctattagacatggtcatgctgaaaagatttggataagaatgactaaagatgataaatactactatattgaaattcacgataacggtaaaggtagtccaactatcaagcctggatttggtctaactcagatgcaagaaagacttgctattatcggtggtactgtaacctaccaaggagatcacggatttactacaaaaataaaattcattattaaaaactag

SEQ ID NO: 297 - DNA, 1404 bp, Lactobacillus salivarius
  isolated from gut, Lactobacillus salivarius
atgattagtgaagatataaaagacattggtggccaatataaatatggctttaaagatgatattgaaccaatatatacaactggtgaaggtcttagtgaagaagttgtaagaaatatttctaaagctaaaaatgaacctgaatggatgttggatattagattggctgcttatgaaaagtacaagactttgaagatggctaattttggaccagatttgtcagaattggatttagatcatattaattattttagacgtgatactgatacagtagctagaaaatgggaagatgttccacaagaaattaaagatacctttgatcgcttaggcgtaccagaagctgaacgtaaatatttagctggttcttctgctcaatatgaatcggaagttgtttaccataatatgaaagaagactttgccaaaaaaggtatcatatttatggatacagattctgcagttcaagaatatccagaattagtaaagaaatattttggaaagttaatcccagcagatgataataaaatggcagctcttaatacagctgtttggtctgggggaacatttatttacgtacctaagggagtaaaggttgaaacacctattcaaagttacttccgaattaatgccggaaattcaggacaatttgaaagaacactaatcattgtcgatgaaggtgctagcgttaactatgtagaaggttgtacagctcctaattattcacaagattccttacatgcggcagttgttgaagtaaatgttttgaaggatgcttattgccgttatacaacaatccaaaactggtccaacaacgtatatagtttggaaacaaaacgtgctagagctttggaaaatgctactatggaatgggtagacggtaatcttggatctaaggtaactatgaaatatccaagtatctatttagatggtgaaggggcacacggaaatatgttatccattgcatttgcaggtaagggtattgactctgacactggcgcaagaatgattcataatgctaagaatacatattcgtcaactgtatcaaaatctctctgtaaagatggaggaattgctgactatcgtgggtatgtaaggtttaatagagatagtgatggttcgtttgcacacgttgaatgtgacactatcattatggatgatgagtcttcaagtgatacaattccatttaatgaagtattaaatagtaatgtttcaatggaacatgaagctaaagtttctaaaatttctgaagatcagctttactatttgatgagtagaggtatttctgaagaaaaggctactgaaatgattattatgggatttgttgaaccatttactaaagaactaccaatggaatatgcagtcgaattgaatagattgattgagtatcaaatggatggtagtgtaggttaa

SEQ ID NO: 298 - DNA, 1206 bp, Lactobacillus salivarius
  isolated from gut, Lactobacillus salivarius
atgaaatcaaaaaatattattaaaattgtaacaggaactattatagccaccactattattagtcccgttgttcctgttatacagaatatttctgtatttgcagatacaactaattcaaattctagtaactcaaatacacacactctaaattctgcatacgtagtctacgggtctggagtctcatcagatatctactcaagtttaaatgatgttttacaaacagattcttcatttaaaactatgacggcaacagcagatgattaccgtaaatatattaataacaatagtaatacaactaacgctgctatgattagctctgttgctattgctcccggtgatccaggttctggggttaaagttaatataaagaattataatggtgaaaataatattactgaggttactgctcagcaatatgctatggttgctcaaatggctggtgtaactgatgtaagtattgtcgttactgctaaccgagctgtatctggtgaatctgctttaacaggtgtttataaagctttagctactgacggtgtaaatatcaattctgaaaacacttctgctgcaaataacgttttagatgctactcaatctgctattgatgctaataaagatgataaaagttatcctggaaaattaatggcagctgtaggtgatgtttcaaaacaaattgctcagcaaaaacaagatgattctagtaatttagcaactaaacaagatattcaagatatgttaaataaggcacttgaaaaacgtggcatcgccgatacaactaatcaaactcaaattacacaaatcgttaatgctttgatagtatttcaaaatgctcctatttcatcaagtaaaacttacgtaaacactgttgatgatacgattaataatgtaaaaaactcaactggtaacttgatgaataaagcaaaaaattgggctaacagtgaaaaatttggtcaaacagctgaagaagctaagggctggttcgctaaattcactgattggataaaaggtatttttggacaaaaatctgataattccacagacacagatactaacactaacgaatcaagtaatacaacttcatcctctgacacttctagtgttgtagatgatagctccagtaacgaaaatactgatacaaataattctgagaattggtggacacaatttaccaattggataaagggattatttggacaaaacaataactaa

SEQ ID NO: 299 - DNA, 2172 bp, Lactobacillus salivarius
  isolated from gut, Lactobacillus salivarius
atggataaaaaagttttaaaattaactaatgctgaattaaagtataatcctaaaaaaatagaaaaagtaattgaattgctagaagaaggaaatactattccttttatagctagatatagaaaagaactaactggaagtttagatgaagtccaattaagagaaatccaagtaacttatcaaagaaatgaaaagatagaaacacgtaagagtgaagttcttaagaaaatttcagaacagaataaacttacagaagatataagaaataaaataaataatgcaagtactcttcaagaggtcgaagatatttatttaccttataagaagaaaagaaaaactaaagcacaaaaggcagttgcaaatggattagaaccattagctaagtggttattgagagtaaatagcgatgcgccaatggtagaagctaagaagtatcttaataaagaagtacctgatgaagaagttgccttaaatggtgctgttgatattttagcagaagcatttggtgaagaagcacaattaagagattgggtgcgaaagcaaatgtctagaaaaggagtattaattgctaaggaaaaagatagtgagaaagatgaaaatggcacctatgaagattactatgattttgaacaagtagtgtctaaattaacatcatatcgaattctagcaattaatcgcggtgaaaaagaaggaattttacgagtaaaaataaatacagatgacgattatgcgctaagatatttacattctagaataattggtagtaagaaaagtacaagtaatgactatgtagaaagggcatatactgaagcgtataaaaaatttatcaaacctgccattgaaagagagcttcgagcaactttaactgaaaaagccgaaaatgaggctattaaagtttttggtgaaaatttgtataatttattaatgcaagcccctttgaaaaataaaattattttaggaatggatccagcatttagaactggttgtaagttggcgattattgacgagactggaaaatttttagttaaagatgtgatttatccacatgaaaagcataaaggcgagaaaccaaattctgaattaagaaaagaagctgctgaaaaattagagacattgataaatagatataatgttgacatgatagcaattgggaatggtacagcaagtcgagaatcagaaaaatttgtagcagaagttttaaagaagatagataaagaagtatattacgtaattgtaaatgaatcaggagcttctgtatattcagcaagtgaagtagcaagagatgaattcccggattttaacgtagaagaacgttcggccgtaagtatagctcgaagattgcaagatcctttagcagaattaataaagattaatcctgaatcaattggtgtgggacaataccagcatgatttaccacaaaaacaattagatagtgaagttgaagcgactgttgaaactgcagttaataaagttggtgtgaatttgaatacagctagtatccaattactaacctatatttctggattgaataaaacaacagctcaaaatattattctttatcgtgaagaaaacggaaaatttcaaaatcgaaaagagttaaaaaaggttcctagattaggtcctaaagcttatgagcaggcggcaggctttttaaggattattgatgggaatgagtttctagataatacagatatacatccagaaagttacccgctagcagaaaaattgataaaggatctaggcattactaaagaagatatgggtactaacactataaacgataagttagcaaaatttaatgttgaaagatatgcactagataatgaattagaagtaataactgttaaagatattgtaaaaagtttgatgaaaccagggtgcgatggtcgagaaagtatgccaatgcctttgttgaaatcagatattttaaaaatagaagatttaaaagcaggaatgcaactagagggcacggtaagaaatgttgttgattttggggcattcgttgatattggtgtaaaacaagatggattagtgcatttatcaaaattaagtaagaaatatgtttctaatccacgagatatagttgcggtaggacagatagttactgtttgggttgaagatgttaatttaaacagaaagagaattcaattaacaatggtaaatccaaatgaataa

SEQ ID NO: 300 - DNA, 585 bp, Lactobacillus oris
  isolated from gut, Lactobacillus oris
atgaacggcaagcagcgtacggttgagcagtctaagcaatggttatgtgacgcccttataaatttaatgatgaaagagaactttcaggatatttcgattactgaaattgcccaaaccgccgaattatcgcgaaaaacattctatcattcttttaaaaataaagaagcggtcattaattacctgtgtgatcagttgtttgatcagtactttgaacaattactccagcagaaaccgcaggtaggggaactgatgttaaaaactacttttgatatttttttaaatttttggtggcgaaaacgggatttaattcaattattgatccgccaaggcttatttgatcacatgaatgaaatttggcagcaaaaagcaatccctcgttatcaacagtttgcagctccttggcatgttcatggcactcctacccaagtgaattatgtgatggctttgcaactaggtggtttaactaatattctacgtgtctggttaggacaagatcagcctgagccaccagaacaaattaaggatctaatgttgttggctgctcagcaattagctgatagtttaaatacaaatcagattagctag

SEQ ID NO: 301 - DNA, 897 bp, Lactobacillus salivarius
  isolated from gut, Lactobacillus salivarius
atggaactcacttggattgaagaattcaagaaatatttgttaattgaaaaacaatattcagatgaaactttgaaagcttatagtgaagatttacaacattttgttgattttattgacgaaactggaggcgctaaatctttcaaggaaattggtagtaatgatgttcatgcatatatgagctatctatatgataggtatgaaatgacatcgatttcgagaatgatttccagcttacgtgcattctacaattttttaattaagaatgaattaacagatgaaaatcccttcgcttatgtacaattaaaacgacatccacgatcactaccacgttttttctatgaaaaggaaatgaccgcattatttgaagcaactgaaggcgacacacagatgttgatcagagatagagcgttgttggagtctttgtatggaactggaatgcgtgtcagtgaatgtacaggtttaaaaatggaaaatgtagatttgactaataaaaagatgcttctacatgggaaaggtgataaagacagattagtaccatttggaagctactgtcaggaagcattacaacgttattttgaacaaactcgtacacctttaatggaaaaatatcatcgggatcatgatttagtctttgtaaatcattatggaaatcctttaactccggctggggtagcatatatcttaaaacagatagttaagcgcagcagtctacacaccagcattcatcctcatgagttgcgacacacatttgcgacacatttgatgagtaatggtgcggatttacgtgcagtacaagagttactagggcatagtagtttatctactactcaaatctatactcatgtaacaccggagcatttacaaagagattatcgaaaatttttcccaagagcatag

SEQ ID NO: 302 - DNA, 1185 bp, Lactobacillus salivarius
  isolated from gut, Lactobacillus salivarius
atgtacaattttgataaggtggcaaaatttcaaaattcacttaagtggcatgttaatgatagcgaattaccaatgacacttggtgatatggattttgaagtagcacctgaaataattactgaattacacaaaagaatagaaaataagaattttggatacgaatatattccgcacgaatattatgcaagtgtagctaaatggtataaagaaatgcataattgtacccttgatatttcctggatgtctttttctcaaggagtagtagctactttatcagctattattactaatttaatgaatgaagatagtgtaataacagttttaactccaggatttgataaatttaagaaagttggagaaggaaaacaaaaagtattagtaagtgaacttatttacgataaagaaaaacgcgattatgacattaattggctagatttagaagataaattaaaaaagactaatctctttgttctttgtaatccacatagtccagttggaaaaatatggtctcaaaaagatttagaaaagatactaaaactaagtttaaagtatgattttaaaatttttagtgatgaaattcatggagaaataacatttgataagaaatatactccattatttagtttagacgaaaagttattaaagaatacgattatagcagtttcaccaagtaaagcatttaatattgctggaattcaaacagcaacaataataacgccaaataaagagttgaaagagcaagtagataacgcaataaaaagtttccatcttaatgaagctaatagtttagcagttccggcaacaattgcagcatatacagaaggaagagtttggcttgaagaattgaaagattatctaagagaaaatcgaaatttcattgaacgttttttagagcataatgttccagatgtgaaaccaagtttaaatgaagcatcatattttctttggttagatatatcatcattaaatgttgatgcacaagaattaacaaaatttattcgtaaaaagacagggttaattttaactgctggagataaatttgatggaaatggaaaacaattcttacgtatgaatatagcaacttcaacagatttaattgaagatgcattgaggagattgcagcgagctgttgtactatttaagcgaaaagatgacgatttaatgagcttgatactaaataaataa

SEQ ID NO: 303 - DNA, 1383 bp, Lactobacillus salivarius
  isolated from gut, Lactobacillus salivarius
atggagaaattagtagaaagaaaattaactaaaaaagattattttgtcgttagttcgttgctatttgcattatttttcggagctgggaacttaattttcccactacatttaggacaattagcaggtcataattggcttcctgctacactaggatttttagtaacaggtgttttgttaccattgctatcagttctagctatcgcaatcacacgttctaaaggtgtttatgatgtaggtttaccactaggcccaacttttgctttagtatttatggtattaattcatgctacaatcggaccattatttggtactccaagaacagctactgtttcatttacggttggtttggcaccattagttccacaacaatatcaacaagtagcattatttggtttctctgcattattctttttagcagcatttttattatcatataaagaaaataacatcgcatctaatttaggtaaggttttaaatccagtatttttggtattattattcttagtattcttggtatcattcttaaaaccaatgggtagtgtttctcaagcagcacctactgcgcaatatctacatggtgcatttactaatggatttttagaaggttataacacaatggatgctttagcaggtttagcttttggtgttactgttgttacagccgttcgtgcaatgggtaaaaaacgtgaaaagagtgttgctgccgttactgctaaagctggtttcttctcaatgagtgcagttgcagtaatctacttacttctaattgttgtaggcgcaatgtcattaggtagatttaaattatccgctgatggtggtgtagcattttctcaaatcgttaatgcttatgcaggttcatttggtcaagctgtattggctacattaatcacagttacatgtttaacaacagcggtaggtttggttgcagcttttgctcaagatttccatgcacattttccaaaggttagttatcacacatggttggcattatcatgcttagcatcattcttaacagctaactttggattagaacaaatcatcgcttggtcaactccaatgttaatgttcttatatccattatcaatggtattgatcttattatctgtattttcacctttattcaagcgtgatggtgcagtatatttcatggtagttctatttactgtagttccagcattctttgatatggtagttgcattcccagcagttgttagtcaaagcgcatttggtaaagcagtcgcagcatttagattgcattacctaccattagctagcatcggattatcatgggtagttccagcattagttggattagtattaggattagggatttacttctataagaaagctagagtatctgtaggagtaactgaaaaagaatag

SEQ ID NO: 304 - DNA, 675 bp, Lactobacillus salivarius
  isolated from gut, Lactobacillus salivarius
gtgaaatataccaaagaggaggcaagggtaaaaaagcaagctctaacgagcttacaagtgagggctatccctccagtggttaaaaccactggtatctcgcccactatgtcaatgaaagttgtagcaatttccggagctgtaattgggaaaaagactctaactgccatgaaatatgtagcagaaaagatgaataaagattttccagaggttgaatttgacttgatagatttgagtgaaaaggatattcaatttagcgatggacgtaattataccgaatatcaaggagatattttagaagttactactaagattatggaagcagatgccctaataattggaacaccgattttccaagcttcaattcctggatcagtgaaaaatatttttgacttactaccagaaaaagccttacgtgacaaagtggtttcaattgtggttactgctggttctgctaagcattatctagtagctgagatgcaacttaagccaatcttgtcatatatgaaggcacaagttttaccagaaattgtctttattgaaggacaagatttgttcagacaagaaatcatcaatgctgatattaatttcaggttggataaattagttgaagatactttgattatggttgaaacttttaaagaactgcgaaagaaacaagaagatgcattattctag

SEQ ID NO: 305 - DNA, 1155 bp, Lactobacillus salivarius
  isolated from gut, Lactobacillus salivarius
ttgaaaattggagagaaaaaaatgaatccatatgatgttttaggagtttctaaagatgcttctgatcaagaaataaaacgtgcatatcgtaagctatcaaaaaaatatcatccagatttaaatcatgaacctggtgctgaagaaaaattcaaagaagtaaatgaagcgtatgaaattttaagtgatcctcaaaaaaaggcacaatatgatcaatttggtacaacaggtggacagcaaggctttggtggtggccaaggtttcggtggctttgattttggtggatctggagcaggtggctttgaagatatattcagttcattctttggtggtggtcaaagcagaaataataatggccctcgtcaagggagagatcttcaatatgaaatgcatctaacttttgaagaagcaatctttggaaagaaaacagaaattaaatatactagagaagaaaattgtaaaacttgtagcgggacaggtgctaagccaggaacatcacctgtaacatgttctaaatgtcatggtagaggatttattcaggttcaacgacagacacctttgggtagaatgatgtctcaacaagaatgtgatgtgtgccacggtactggtaaagaaataaaagaaaaatgctccacttgtcacggaagtggacatgtaaatgaacaacatgctattgaagttacagtacctgctggtgttgaagatggtaatcaaatgcgcttgagtggtcaaggtgaggccggagtaaatggtggaccatatggcgatttatatatttacttctctgttgcacctagcgataagtttaaacgtgatggggcagatatatacttgagtttgcctattagttttgtccaagctgcacttggtgatgaagttgaagtggatacagttcatggtaaggttaaaatgaaaattccagctggaactcaaacaggaacaacatttagacttcgtgggaaaggtgcacctcatttaagagctggtggaaatggtgatcaacgtgttacagtcaaaatagaaacacctaagaatttaaataagaagcaaagagaggcattaaaggcttttgctgactctatgggtgaagatcctagtggtgatgatagtttctttgaacgttggtctaagagtaaaaaaactaaacgaaaaaaataa

SEQ ID NO: 306 - DNA, 471 bp, Lactobacillus salivarius
  isolated from gut, Lactobacillus salivarius
ttgcgcaagcaaattagaaaagcggatgttgatgcagtttatcttaactccatgtcctcaccagctgatactgctagtgtagttcaagctttagaaaaagctggcgttaagcgactattaggcgcaacgattgctagggtagaagatgaagttccttatgaactagcaacttggacaaagaatagtttgccagcaagttacattaagggtgaatatgattctactaagttggttaaagattctaatttggattacacattgttaagactaacttggttatttaatgacgaaagtgatcgtgaatatgaactagttccaagtggagttgaatttgcagatgcagaggtttcacgacaagctgttgctcaagcaattttagacatcttaaatggtgaagaatctgaatatgtaaggaagagctttggtttgggtaagccaaatacacattatggtaagccatcgttttattaa

SEQ ID NO: 307 - DNA, 1599 bp, Lactobacillus salivarius
  isolated from gut, Lactobacillus salivarius
atgaccaagtatatttttgttactggtggtgttgtttcctcattaggtaaaggaatcgtagctgcatcactcggacgtttgttgaagaatcgtggcttgaaagttacaattcaaaagtttgacccttatatcaacgtagatccagggacaatgagtccatatcaacatggagaagttttcgtgacagatgacggtacagaaacggatttagaccttggtcactatgaacgttttattgatattaacttaaacaagtattctaacgtaacaacaggtaagatttattctgaagtgttgaagaaagaacgtcgtggcgattacttaggagcaactgttcaagttattccacatatcactaacatgattaaagaaaaaatcatgcgtgcaggtacaatcacagatgctgatgtagtaattacagaagttggtggtactgttggtgatattgaatcattaccattcttggaagctttacgtcaaatgaagtctgaagtaggtagtgaaaatgtagtttacatccacacaacacttgtaccttacttacatgctgctggagaaatgaagactaagccaacacaacatagtgttaaggaattacgtggtttaggaattcaaccaaatattttagttgtacgtactgaaaagccaatttctcaaagcatgcgtaataagattgctaacttctgtgacgttgaaccagaagcagtaattgaatctatggacgtagatacactctactcaattccattgaatctacaagctcaaaacatggatgaaattgtatgtaagaaattacacttagatacaccagctgcagatatgactgaatgggctgctttacgtgataaagttaagaatctttcaggtgaagttaagattgctttggttggtaagtatgttcaattaccagatgcttacatttctgttaacgaagcgttgaaacatgctggatacacaattggtgctaacgttaagattgattacttcgattctgaaaagttaactgctgaaaatgttgctgatgaattgaaaggttatgatggtgtcattgttcctggtggctttggcgatagaggtcttgaaggtatgattcaagcaattcgctatgctcgtgaaaatgatgtaccttacttaggtatttgcttaggtatgcaaatggcatgtattgaatttgctcgtgatgttgctggtattgaagatgcaacaactggtgaagtaaatccaaaggctgctaataagattatcgacttgatggctgatcaagaagatgttgaaaatatgggtggaacacaacgtttaggtctatacccatgcaagttgaaggctggttctgttgcttctgctgcatacggtaaccaagatgtaattcaagaacgtcaccgtcaccgttatgaatttaacaacaagtatcgcgatgaattggcagctaaaggtttagtattctctggtacttctccagacaaccgtttagttgaagttgttgaaattccagaaaacaaattctttgttgctgcacaataccatccagaattcttatcacgtccacaacgtccagaaggtctattccaagcatttattaatgctagtgctggtaagtaa

SEQ ID NO: 308 - DNA, 2847 bp, Lactobacillus salivarius
  isolated from gut, Lactobacillus salivarius
atgggatttttttgtttccaatttttaactgagagagaaaggatggatcttatgaaagtcaaagatactttaaatttgggtaagacaaaattcccaatgcgtggtaatttacctgttcgcgaagttgaaagacaaaatgaatgggaagaaaataaagtttatgaacaaaggcaaaaattaaacgagggaaaaccaagttttgtgttacatgatggacctccatatgctaacggtaatattcatatgggtcacgcaatgaacaagatttctaaggatttcatcgttcgttctaaatcaatgatgggattccgcgcaccttatgtaccaggttgggatacacacggtttaccaattgaacaacaattgaaaaaagctggtgttgatcgtaaagcattatctgtagctgaattcagagaaatgtgtcgtcaatatgctttagaacaagttgataagcaaagaaaagactttaagcgtttaggtgttgctggtgaatgggataacccatatttaacattgaaaccagaatatgaagcacaacaaattcgtgtctttggtaagatggcagaaaagggcttaatttataaaggtaaaaagccagtattttggtcatggtcatctgaatcagctcttgctgaagctgaagttgaatatcatgatgtaacatcaccatctgcattctacggtgaacaagttgttgatggtaaaggtgtattagataaaaatacatatatggttgtttggactacaacaccatggactattcctgcttctgaaggtattacaattgatgctacattcgactacgcagttgtacaacatgacgatgatgaacgtaagtatgttttagctgctgatttagtaaatgctgatgctgaattatttggttggaatgatgttaagattgtgaagactgttaagggtgcagaattagaaaatgttttatgtcaacacccattctatccagaaagaaaacttgtaactatgttaggcgacttcgttacaactgatgctggtacaggtcttgttcatacagctcctggctttggtgaagatgactttaacattggtgttaagtatggtttagatgtatatgttcctgttgatgataagggatatatgacagaagatactggcgaagattttgcaggtttattctatgaagacgcaaatgaagtttctttgaagaaattggaagaagctggcgtacttttgaagcaaatggattacgaacatagctacccatttgactggcgtacaaagaaacctattatcttccgcgctacaccacaatggtttgcatctgttgataagattcgtgaccaaattttaggtgcaattaatgaagttcaattcttcccagattggggtcaaaaacgtctttacaacatgattcgtgatcgtggtgactgggtaatttcccgtcaaagagtttggggtgttccattgccaatcttctacggtgaagacggtgaagctatcatgaccaaggaaacaattgaacatgttgcaaaattagttgaagaacacggctcaaatatttggttccaacgtgaagctaaggacttattacctgaaggctttacaagtgaacattctccaaatggtaaatttactaaagaaacagatatcatggatgtttggttcgattctggttcctcacaccaaggcgtatgtgctgaacgtgattacttaacatatccagctgacctatacttggaaggttctgaccaataccgtggttggttcaactctagtttgattacatctgttgcttactctggtcatgcaccatacaagcaaattctttctcaaggatttacacttgatggtaagggacgtaagatgagtaaatcattgggtaacacaattgttcctagtgaagttatcgataagatgggtgctgaaattattcgtctatgggtattgagtgttgatacatctgctgacgttcgtgtatctatgggaagtttccaacaaatcgctgaaagttatcgtaaatttagaaacacagttcgtttcttacttgcaaacataacagatttcgatcctgctaaagatgctgttgctttcgatgaaatggaatccattgataaatacatgacagttcttgtaaacaaatttactaaggaaattctagatgcatatgcaaactatgaatttatggaaatttacaagaagttaattaacttcattacaacagatctttctgcattctatatggacgttgctaaggatgttgtttatattgaagctcctgatagcaagaaacgtcgttcaatgcaaacagtattgtatgatgtagtggtacgtctaactaagttaatgactccaattttacctcatacaacagaagaaatttggaagtatttgaaggaagacgaaaaatacgcacaattatccgaaatgcctgaagttaaacatttcaataatgaagaaaaacttgttgatttatggaacagattcatgaatttacgttcaggtgtatttaaagctcttgaagaagcaagaaatgaaaaattaattggtaagtccttcgaagcacatgtagacttatatgtatctaatggtgtacaagctgatttagatgcattaaatgctaatgttcgtcaagcattgattgtttctgcattagatgttcatccattatctgaagcaccagaaaatgctttgaagtttaatgatgaatatgctgttgtagttgaacatgctgaaggtgaagtttgtcctcgttgccgcatgatcaagacagatatcggtagtgatgctgacttatcaacactatgtgcaagttgtgctgaaattgttcgtgaaaactatcctgaagctttagcagaaggtttagaataa

SEQ ID NO: 309 - DNA, 606 bp, Lactobacillus salivarius
  isolated from gut, Lactobacillus salivarius
atgaaaattttaggattaactggcggaatagcttcaggaaagactactgttagcacatatttaaaagagatgggatatccaattattgacgctgataaagtttctcgtaaagttgtggagccacatacagaaggtttaaaagaaattagtcatttttttggaaatgatattttacaatctgatggaagtttaaatagaaaaaaattgggtgaaatagtttttgaaaacaaggacaaaagagagttacttaataaaatattgagtaaaaaaatacgcacagaaataattgatcaaattgaatattataaaaagcaaggtgcagatgtattaatcctagatattcctttgttatttgaaggtggatatgataagatgtgtgattttacaatggtcatatacattcccaaagaattacaaatagaaagattgatacaaagagatggactaactagggataaagcgttaaaaagaatatctgctcaattagatagtgcagaaagaaattccaaagctgatattgtcattgataattcaagaagtattgaagatactcataatcaagtgatagaatggctagagagaaataatttaatgttagagaaatga

SEQ ID NO: 310 - DNA, 435 bp, Lactobacillus salivarius
  isolated from gut, Lactobacillus salivarius
atgtttgaagtaaaaaattctaataagttagattcacaagtttatcgagatagtttaattattagagaagatgtttttgttaaggaacaaggtgttcctatcgaaatagaaattgaaggtgaagaaggtccaaagtattactgtggatatgtagatggtaattttgtaacttgtgcgagagtgaaaatagaagatggtggagtttggcatattcaaagagtagcgaccttaaaagatagtcgtggaaaaggatatagttcaagtttacttcgtagtattgaggaagatgcgagaaaagcaaaggtgccatatttaacattaggtgctcaggatacagcgcaagctttttataaaaaacttggatatgaggttgtaggtgaaggatttctagatgcagaaatgccacatcatcgaatggataagaagttagtttaa

SEQ ID NO: 311 - DNA, 633 bp, Lactobacillus salivarius
  isolated from gut, Lactobacillus salivarius
atggttgaaacaataacaattcctgaaataaaagtcatggctgaattaataacgaatatgaaacataagagggtaggaatattaggtggtacttttaatccaccacatctaggacatttaattattgcagaacaagtaaaaagccaattaaatttagatgaagtaatgtttatccccgattaccaaccacctcatattgataaaaaaacagctatttctgctgaaaagcgactaaaaatggtgaaacttagtacgatggatgagcctggatttaaagttagtgatatagagttacgacgtaaaggtgtaagttatacaatagacacaattaaggaattgaaattgaagaatccagaagtagactattattttataattggtggagatatggttgagtatctaccaaaatggcatagaatagaagaactaattaaattagtaaaatttgttggtgttggtagacctggatatagaaaggaaagtaaatatccaattatgtgggtagatgttccaatgacagatatcagttcaactttagttagacgaaatgtaaagcaaggatgttctataaaatatttagtgacaccagaagtggaaaactatatacatgaagaaggtttgtatcgtgaataa

SEQ ID NO: 312 - DNA, 2361 bp, Lactobacillus salivarius
  isolated from gut, Lactobacillus salivarius
atgacagattattcatcccaagaatacttagataaattagatgcttattggcgtgctgctaactatgtttcagttggtcaattatacttaaaagataatcctttacttcgtcgtcctttaaaagcagaagacgttaaggttaaaccaattggtcactggggaactatcgctggccaaaacttcatttatgcccatttgaaccgtgtcatcaacaaatatgacttgaatatgttctacgttgaaggcccaggtcatggtggtcaagttatggtttctaactcatatcttgatggttcttactctgaaatttatcctgaaatttctcaagatgaacaaggtatgaagcgtctatttaaacgtttctccttcccaggtggtgtagcttctcatgctgctcctgaaacaccaggttctattcatgaaggtggcgaattaggttactctatttctcactctgttggtgcagttttagataatcctgatttgattgttgctgcagttgtcggtgatggtgaagctgaaactggtccattagctgcttcatggcaatctaataaatttatcaaccctattcatgatggtgctgtcctaccaattttagatcttaacggattcaagatttctaaccctactatcctttctcgtgaaagcgatgaaactttgactaagtactttgaaggtatgggttggcatccaatctttgttgaaggcgatgatcctaagttgatgcatcctgcaatggctaaagcaatggatgaagcaattgaagaaatcaaggctattcaaaagaatgctcgtgaaaataacgatcctagtcttccagcatggcctgttattatcttccgtgctcctaaaggttggactggtcctaaagaatgggatggcgaaccaattgaaaaatcattccgtgcccatcaaattccaattcctgttgaccaaaatgatatgcaacacgctgatgctttggttgactggcttgaaagttataaacctgaagaattattcgatgaaaatggtaagttgaaagctgaaattgctgaaatcacacctaagggcgacaagcgtatggctgctaaccctcacactaaccctggtaaattaatcagagaagttatcaaacctgatttccgtgattttgctgttgatacatctgttccaggtaaagaagttgctcaagatatgactgttttaggtaaataccttgaaaaagtactttctgataaccgtcataactatcgtgtctttggtcctgacgaaacaatgtctaaccgtttggcacctatctttgacgtaactaagcgtcaatggttagctgaaattaaggaacctaacgatcaatacttagctccatcaggtcaagttattgattctcaattatcagaacatcaagctgaaggtttcttagaaggatatgttttgactggtcgtcatggtttctttgcaagttatgaatcattcttgcgtgtagttgactctatgttgacacaacacttcaagtggttacgtaaagcaactgaacaaccttggcgtacatcaattccatcattgaatgttattgctacatctactgtattccaacaagatcacaatggttacacacaccaagatcctggtattttaggtcacttagctgataagaaacctgaatatattcgtgaatacttacctgcagatgctaactcattattggctgtattcgacaagactattaatgatcgcgataagattaacttgattgttgcttctaagcacccacgtcaacaattctactcagctgcagaagctaaggaattagttgataaaggtttgaagattattgattgggcttcaactgataagaatgctgaaccagacgtagttatcgctgctgctggtacagaaccaaacttagaagctttagctgcaatttctatcttgcatgaaaaattacctgacttgaagattcgcttcatcaatgttgttgatatcttgaagttacgtagtcctaaagtagatcctcgtggcttgagcgatgatgaatttgatgcttactttacaaaagacaagccagttatctttgctttccatggttatgaaggcctattacgtgacatcttctactaccgtcacaatcataacgttgctttccacggctatcgtgaaaatggtgatatcacaactccattcgatatgcgtgtgctaagccaaatggatcgcttcgatcttgtaaaatctgttgcactttctcttccagatgctgacaagtatggtcaacttgttgctgaaatggatgctaaagttgctaagcatcatcaatacattcgtgatgaaggtactgatttaccagaagttgaaaactgggaatggaaacctcttgattaa

SEQ ID NO: 313 - DNA, 594 bp, Lactobacillus salivarius
  isolated from gut, Lactobacillus salivarius
atgaatttagtgcctacagttattgaacaatcttcacaaggtgaacgcgcttatgatatttattcacgtttattaaaagatagaattattatggtatctggtgaagtcaatgatgacatggctaatgctatcatcgcccaacttctatttttagatgctcaagattctgaaaaagatatttatatgtacattaattctcctggtggttctgtttctgctggtttagcaatctacgatacaatgaatttcgttaatgctgatgttcaaactatcgttatgggtatggccgcatctatggcttctgtccttgcaacagctggtaccaaaggtaaacgttttgctctacctaattctgaaattatgattcatcaaccattaggtggtgctcaaggacaatcaactgaaattcaaattgctgctgaacacattcttaagactcgcaagttaattaatcaaatcttagctgacggttctggtcaagatattgaaactatcaataaagatactgaacgtgacaatttcatgactgctcaacaagctgtagattatggtttgattgatggtattatgaagaataagaagaaaattaaataa

SEQ ID NO: 314 - DNA, 999 bp, Lactobacillus salivarius
  isolated from gut, Lactobacillus salivarius
atggtaggagttattcttgctagtcatggtggttttgcagatggtattcatcaatctgctgaaatgatctttggacctcaagaaaattttaagagttgtatcttaaaacctgatgaaggcccagaagacgttaaaaagaagatgcaagaagctgttgcaagtcttgataatcaagatgaagttttgtttttagtagatttatggggtggaacaccttttaaccaagcttcaagtttagttaaagaacatgaagataagtggacaattgttgcgggaatgaatcttccaatggtaattgaagcattaacacaacgtttctcagtagaatctgctagagaaatcgctagagcaattgttccaactggtaatgacggtattaagacattcccagaagatgcaatgccagttaaaaaagaagctgatactaaagcagttaagacaagtggtaaaaagaagacaatccctgaaggtactgttttaggcgatggacatatcaagtatgttcttgctcgtgtagatacacgtttacttcacggacaagttgctacaggttggacacatactactcaaccaaatcgaattattgttgtttcagatacagtttgtcatgacaagttgagaactagcatgattaaacaagctgcacctaatggggttcgcgtaagtgtagcacctatcaagaatatggcaaaggctaataatgatcctagattcggtgatactcgtgcgatgctcttgtttgaatcagttgaagatgctttagcagctgttaaggcaggggtagaagtaaaagagattaaccttggttcttctgcttataaagaaggtaaagttaacgtaacaaaggctttatcatttgatcaaacagacgttgattcaattaaagaattacaaagtatgggtgtaaaatttgatgttcgtggggttccagctgatagtcctgcaaatatcgatgatttaattaaattagctgaaaagaaattagctgagaaaaattaa

SEQ ID NO: 315 - DNA, 1038 bp, Lactobacillus salivarius
  isolated from gut, Lactobacillus salivarius
atgagtcgctatcaagaagctggagtagatattcatgcgggttatgaattagttaataaaataaaaaaagatgttaaatctactcaaagaatggggacaacaggaaatattggcagctttggtggaacttttgacttaagtgtactaaatgttaaagaacctgtattagtttctggtactgacggagtaggaactaagttattaattgcacaaaagatggacaagcatgacaccatagggattgattgtgttgctatgtgtgtaaatgatattttggctcaaggagcagaacctctatattttctagactatattgctactggaaaaaatgatccagataagattgcgcagattgttgctggagttgctgaaggttgtagacaagcgggaactgccttaattggaggagaaactgctgaaatgccagatatgtatgcgaaagatgaatatgatttagcaggattttcctctggtgttgtagaaaaaagtaagctattgacggatgctaatcctcaagaaaatgatattttggtaggcttagcttctagtggaatacattcaaatggtttctccttagttcgtcaaattctatttaaggataataaaattgatttatctgaaaaaggggaagaatttggtggaaaaacaattggagaagtaattttagaaccaacaaaaatttatatagatagtgttttaccacttgtaaaagaaaatttagtaaatgggatagctcatattacaggtgggggactgattgaaaatttaccaagaatgtttgctgatgatctaactgctgaaattgatgcaagctcttggaaagttttaccaatttttgaatatcttaaaaaattaggtaacttatcacaagatgattgttatgaaactttcaacatgggtattggtatggttttagcagtatctgaagataagttagaatcagtaaagaaattattaagtgataaaaacgaagatttctatattattggaaacttgaggaaaagaaaaggcaatgaagagaaaatcattgtacattaa

SEQ ID NO: 316 - DNA, 1248 bp, Lactobacillus salivarius
  isolated from gut, Lactobacillus salivarius
ttgtcattacttgatatattattatttatcagtattttttcaatttggacaattttagcggttaatgttgtcttgatttttgctggttatatgaattatttaacaatgaaagttcacgataaattaccagcagatgcaccattcgtaacaattatggttcctgcacataatgaaggtattgtaattgttagaacggtaaaatcattgctagcattggactatcctcaagataaatatgaaattattgtaattaatgataattcatctgacaattcagctgaacttttagcacaggtacaaagtaagtatcctaaccgaaatcttaatattatcaatactgataatataaccgggggaaaaggaaagtctaatgctttaaatattggcttaaaagaagctaagggttctattatcgcagtttatgatgctgataatactcctgaaaaacaagcattacgtattttggtagctgaattattagctgacgataaagctggagcagtaatcggaaaattcaggacacgtaataagaatgctagtttattaacacgatttattaatattgagactctgtcatttcaatggatggcacaagcaggtagaaaaaaactatttaatttatgtacaataccaggaactaattttgttattcgtcgtagtttactggagaaaattggtggttgggacgtaaaagccctggcagaagatacagagataagttttagaacttatttaatgggttatcacattaattttcaaccggcagctgttacctgggagcaagagccgcaaacttttgtggtttggtttagacagagaacgagatgggttaaaggtaatatttatgtgattttaaaaaatttgaaattactatttaatcctaagagtaaggctattcgatttgatttgatatactttttatcaatttattttctattaatgacatctttagttatttcagatacagtttttgttctatcagtatctggattagttcatacatcaattaatggttttagtaattggttatggttctttgcggttatcttatttgtattaggaacttttataactattacaacagaaaaaggtgagatgacactccaaaatttattaatcattgtcttgatgtatctagtctatagtcaaatgtggttaatagtggccttctatggcatgatcatgtatgttcaagaacaaatttttcataaaaaagctaaatggtataaaacacagaggtatgaatag

SEQ ID NO: 317 - DNA, 204 bp, Lactobacillus salivarius
  isolated from gut, Lactobacillus salivarius
gtgggttttctgcgtgagttcaaatcgatgtccgccctgttccagcgttgtcagccggccccggaagtcggactagggcgcgcatcggctgacgaacaggaatccaccaacgacatgtttcaactctatgtgaaaccacaaaagttacaattagttgcggttttaggtgcgtattactatgactttggccggagtatgctatga

SEQ ID NO: 318 - DNA, 966 bp, Lactobacillus salivarius
  isolated from gut, Lactobacillus salivarius
atgaacactgaaaaagctgttttaaattattttatccaaaatctaggaaattatacatctggagaagaattatcaaataaactaaatatctctcgcacagcggtctggaaagctgtcaaacaattaaaagaacaaggctatgaaatttccagcaaaacaagaaaaggatattgtctagttgataatggagtattgaatactgcgtttattaacaaatatttacatactgataatcttgatctgcatgtttatgaaactatcggttcaactaactctgaagctaaaaatatcagtagtcaacgtcattttactgagccactggtaattattagtgaccaacaaacggcaggttacggacgctatggcagaaaattcgaatcacctaagaataccggtatttatatgagcatcttgcttgaaaatcaacatcaaaatgatttaaatcctggtttgttgactactgctgtcgctattgcggttagtcgtactatcaaaaagttattccacaaagatacagaaattaaatgggttaatgatgtattacttgacggtaagaaaatttgtggcattttaactgagggtgttgctaaccttgaaactcaaagtatctcacaagttattatcggaattggtataaactataccactcccctagaagtattccctgctgaacttagggaaagagttggttcacttaaaaatttagtagaagaatatcatgtatccagaaatatgtttattgcatgttgtctggatgaatttttcgctatttatcgtaactatacttctgctgattttatagatgaatatcgtaaattatctgttgttatcggtaaagaagttcgcattaaacaaggaaataaaataataactggtgtagtttctaccattgatgatttgggaagaattgtccttactgatggacaaattttcagttccggtgaagtcaccaaaattagatattaa

SEQ ID NO: 319 - DNA, 1659 bp, Lactobacillus salivarius
  isolated from gut, Lactobacillus salivarius
ttgaaagatattgaaatagcacaaaaaagtgaaatgttaccaataactgaagttgctcaaaaggtgggattaactgctgatgaaatagaacaatacggtaagtataaagcaaaaatcagcttacctctttctgcacgtgaacaaacaaaaagaaagttggttttagttactgcaattaaccctactccagcaggtgaaggtaaatctactgtaacagttggtttgggcgatgcatttagtttattaaacaaaaaggtaatgattgctttacgtgaaccatcattaggacctgttatgggaatgaaaggtggagctactggtggtggatattctcaagttgttccaatggaagatataaaccttcattttacaggggatatgcatgcattaacaactgctaataatactttagcagctttgattgataaccatatttaccaaggaaataaattaaacatcgatcaaagacgtgttatttggaaacgtgtattagatattaatgatcgtgcattacgtcatgtagtaatcggcttaggtggagctactcaaggtattccaagagaagatggattcgatatcactgtagcttcagaattaatggctattctatgtctttctaaagatatttctgatttaaagaaacgtatcggtcaaattgttataggatacaattttgataaagaaccagtaactgtagatcaacttggagttacaggtgctattacattgttattaaaggatgcttgcaagccaaacttggttcaaacactagcacatactcctgcaattgtgcatggtggaccatttgctaatattgcacatggatgtaatagtgttcttgctactcaaacagctttgaatttagctgattacacaattacagaagcaggattcggtgctgacttaggtgctgaaaaattccttgatattaaaactccagtgttaggaaaaacacctgatacaatcgtaattgtggcaactgctcgtgctttgaagatgaatggtggagtagctaaggataatttagatgaagaaaatgttgctgtagttgaacaaggttttgcaaacttgaagaaccatatccaaagtatgaaacgttataatgttcctgttgtagtggcaattaataaattcactcaagatactgatgctgaattagctaagattgttgaactttgtgaacaaaatgatactagagcaattgttgctgacgtttgggctaaaggcggagaaggtgctacagaattagctaaagcagttattgaatcttgtgataatgatcaagaatttacaagactttacaatagcgatgattctgttgaagaaaagatcaacaagattgttactgaaatttatggtggcgatggtgttgaatttagtgctaaagctaagcgtcaattaagacaatttgaaaaattaggttggaatcatctacctgtatgtatggctaagacacaatattcattgtctgataatgctaaagttttaggtgctccaaaaggatttaagatccatgtgcgtgaatttgtaccaaaattaggtgcacaattccttgtagcattaacaggaaatatcttaactatgccaggtctacctaaagttccggctgcagatggcatggatgttgatgaaaatggaaagattagtggtttatactaa

SEQ ID NO: 320 - DNA, 984 bp, Lactobacillus salivarius
  isolated from gut, Lactobacillus salivarius
atgaatgacagacaaaaagctatcattgactgtgatccaggaattgacgatagtttggccttgatgcttgctttaacatcgcccgaactagaagttgtcggaatcacaaccgtttctggtaacgttccttccgatatgggtgctaagaataccctcaaaatcttaaatcacttagatcgtcttgatattccagtctatcaaggtacagcaacgccacttaaacgtgactatgttgatgccatggatacgcatggagaagatggtttaggtgaatcttatctacctgaagtctcaggtgttcctattcacgataacgctattgagtttattaatcagactctagccgataatcctaatttaacaattattgcgttaggaccactaaccaatattgcattagctcatcaagcacagccagatgtttggaataactgcactcgttttgtttcaatgggtggaaatttcaagagttttggtaattgttcccctgttgctgaatataattactggtgtgatcctgatgctgctaattatgtttatcaacatctttccgtaaaaatcgaaatgataggacttgatgtcacacgaaaaattgtacttacaccaaatattttggaactaattcatcaagtcaatccagaacaagctgattttattcaaaaaattacaagattctattttgattttcattggaaatatgaaaaagttatcggctgtgtcattaatgatcccttagcagtggcttatactatttttccagaattatgtactggttttgactcgcatactgagattgaaactaaaggtatcagtattggtcaaagtgtcgttgatgaaatgaatttttggcataaacctgtcaacagtcacattttgatagaggtagataacctacgttttatgcaaatcttcttacaacgtacctgttcaattgattcagaacttctagaaaaaattttgccacaattaatatcggaggaataa

SEQ ID NO: 321 - DNA, 3102 bp, Lactobacillus salivarius
  isolated from gut, Lactobacillus salivarius
atgaaaccattaaagttaagaatgaagtactttggaccatatattgatgaaaccatgaattttacagagtttgataatacacctttatttttaatcagtggaaaaacgggtagtgggaaaacaaccatttttgatgctatgagttttgctttattcgatcatacttctggcgatgaaagagacgctaagcagatgagatctgattttgctacacctaatgatgcaactgaagtgacatttgtatttgagcataatggaataaagtacacagttattcgtagccccaaaatgaatttagctaaaaagagaggaaatggaactagagatgttgaggcttctgtaaaagtaaaatatatcaataaagaacaagaaaatatcgagattactaaaaaaaatcaggcagataaatttttacgtgacttaatcggcttggatgcacagcagtttacacaaattgttttattaccacaaggaaaattcagaaatttcttgaatgctaatagtgctgatagagaaaagatattaagaaaattatttggaacgagtctatatcaaaaatggactgagaaaatccaagaacaagcaaaaatcattgaaagtgaaaatgaaaagttaacgacacaaatacagacaatccgacaacaagtagaaattgaagataatgatgaaacaaatgatgaagaatggatagttaaagttaataatcaaattgaagaaaaaaagaaaaaacaagaaaaagtaaataacgatataactattagtcaaaagcaacttgataacttagttgaaacctatcaaaatgaaaaagtattagcggatagtattaagcaaaaagaggactatatacataaactacaatctctagaaaataatcaagataagattgaattaaagaaaatttacgcttatagattggcttggtatcaaaaaaatcaacaaatatttaacaataaaactgatttagaattacagataaaagaaaaaagtgacaaattggtgttactaaatcaagaaagtaaatttttaattcaaaaacatgaaactgcaaaaatagaagcgcaagagctagaaaagcaacaggagaatattgaggatctaaaaaataagatttcaacattagaagtaaaattaccagtttatcaagatgtaaaagtaaatcaagaaaaaatgagtgaattaactaagaatcatcaagatactaaaaataaccttgataagtcagtaaaagaactagaaaaacaaaaagtaagctatgatgatttaggaaaagaactagctaagttagaaaatttagatgagaaacaagttgagttggttaatgagaataataaattaactagactgagtgaaaaaatagatttagtagatcatttagatagtgagattgaatcaaagaaattacaaaaagaaaaattagaaaagaaatatcaagaacaggaagaattagtacaagaaagtacagatactgaagaaaagttaaatactttgtggataaaaaatcaaatttactttcttgctaaacaattagcaccgggagaaccttgtccagtatgcggatccaaagaacatccattaccagctgaaatagatgaattggaacaagtaactgaggaagatgtaaaattagcgaataagaaagctgaagttgaaagatctaaagcaaaagaatttaagttaagactaacatctataatagatgaaataacagaattagaacaaaataaaaaagaaagtatagataaaatattacttgattttgaactagggaaaaaacattctttgctagaactaaaagaaatatttcagattaaaaatgatgagtatcagaaaaaagcaaaagatcttgaaaataaagtcagcttgaaagaaaagttaaaaggtaacagtcaattaataaaaaatgaaatagctaatttggagaaagaaaaagataaattaaaagaacaatatgatgatgtatattatcgcttaaaaatgaccgaaactactctacaagaacaaagaaagcagttgagtcctgaatttgaagatgtaaaacaagttgaagaatatattacagatactaaaaagagagtggaagattatcaaacaaataaggataaaatcactaaagaacttcaagatactaaagcagaattaattaaagttcaagctgatattgatagcaatcatcaagaattagaaagtaagaaaaaaggactaagtaaaattaataaggaaataactacattaatagaaaatagtgagattaatttagaagaaatagcttccttagccaagaatctagcacgattagattctattaataatgaaattaatagttatgaaaaacaaatattagtagtaaaaacaaaaatatcggaattggataaaacaattaataatagggaaatgccaaatttagttgaacgtaataatgtaattgttgataaaagaaaagaacttgcaacattccaagcagaatttagtgatattacaacagaaattaaccatatacaaaaaataaagcaagaagtagaacaattactgcgagaacaaaaagaaaattataagttaatggcagaatggaaacaattatcagatgtaatgactggtaaaagtgctactaagttgagtttggaaagatatgtgctacaaatgtaccttcaaagagtgttaaatgttgctaatggacgtttgaaagaattaactcaaggaagatatagtttccaaataaaagatgaaaaaggtagttatagtagtaatacaggattagagattaatatatacgatgataacgctgggaaagttagaccagttcaaactttatcaggtggtgaaagttttattgctgctttagctctagcactagctttaggtgaggttatccaagctaatgctggtggaatatttgtggatgctttatttgtagacgaaggatttggttccttggatagcgatgcattacagatagcattggaagccttgcagacgattgaaggaaaaaatagaatgatagggattatcagtcatgttaaagaattgcaagaacaaataccattccaagtaaaaatatctagcaattatggaaaaagtaagataagttatagaaaggatttctaa

SEQ ID NO: 322 - DNA, 657 bp, Lactobacillus salivarius
  isolated from gut, Lactobacillus salivarius
gtgggtcaaaaagtaaatccaacaggtttacgtgtcggaatcattcgtgattgggacgcaaagtggtacgcagaaaaagactttgcttctaacttacacgaagatttacgcatccgtaagtatatcgaaagtaaattagccgacgcttctgtttctaccgtagaaattgaacgtgcagcaaaacgcgttaacatttcaatccatactgctaaaccaggtatggttattggtaaaggtggatctgaagttgaaaagcttcgtaaagaattaaataacttgacaggtaagagagttcacattaacattgttgaaatcaagaagcctgatttagatgcaaaattagttggtgaaagcattgcagaacaattagaaaaccgtgttgctttccgccgtgctatgaagcaagctattcaacgtacaatgcgtgcaggtgctaagggtatcaaagttcaagttgcaggtcgtttgaacggtgctgatatgtcccgtgtagaacgtttctctgaaggaacagttcctttgcacacattgcgtgcagatatcgattattcatgggttgaagctcacactacatatggtaaattaggtgttaagacatggatttaccgtggtgaagttttaccagcaaagaaagaaaacagtaaaggagggaaataa

SEQ ID NO: 323 - DNA, 1014 bp, Lactobacillus salivarius
  isolated from gut, Lactobacillus salivarius
atgacaactaaagtaggtattaatggttttggccgtatcggtcgtttagcattccgtcgtattgctgaaacatctaaggacttggaagttgttgctatcaacgacttaacatctccagcaatgttagcacacttattgaaatatgatacagctcatggtcaatttgacggtgaagtttctgctacagacaacgcacttatcgtaaatggtaaggaaattcctgtttatgctgaagctgatgctaagaacattccttgggttaagaacgatggcgtagacttagttcttgaatcaacaggtttctacacatctaaagaaaaggcatctgctcaccttgaagctggtgcaaaacgtgtattagtttctgctcctgcaggtgacatgacaacaatcgtttacggtgtaaacgacgatgcaatcacagctgatgacaagattgtttctgctgcttcatgtacaacaaactgcttggcaccacttgcaaaggctgttaacgatgcatttggtatcaaagctggtacaatgacaacaatccatgcttacacagctacacaaaaattacaagatggtccagatcgcaagggtaacgttcgtaacgctcgtgctgctgctcaaaacacaattcctcactcaactggtgctgcaaaagctatcggtttagttgttccagaattgaacggtaagttagatggacatgcacaacgtgttcctgtaattacaggttccttaacagaattagttgcaactcttgacaaagaagttacagctgaagaagttaacgaagcagttaagaaagttacagaaaacaacccatcattcggttacaacgcagatggcattgtttcttctgacattatcggtacaacatttggttctgtatttgacccaactcaaacacaagttgttggtaagggtgacggccaagttgttaaagttgttgcatggtacgacaacgaatacggtttcacatctcaaatgatccgtacattagaaaaatttgctagcatgatctaa

SEQ ID NO: 324 - DNA, 1011 bp, Lactobacillus salivarius
  isolated from gut, Lactobacillus salivarius
ctatctcgtcaaacacggcttgttaaaggaggaacgctaatgacaacggcaattgaatttcagcacgtccaaaaagactttaatgggcaaaccgtgattcccgatttgaatctaatggtcgatcagggtgaactgttcgtcctagtgggcacctctggcagtggcaagacgacgtcgcttaaaatgattaatcgtttggaacccttaacggccggaaaaatcctggtcaacggggccgacaccaccacggtaccagtacgggatttgcggtggcagatggggtacgtcttgcaacaaatcgctctatttccaactatgacggtagcacaaaatatcgcggtgatttccgagatgaaggggacggcgaagaagactatcaatcaaacgattgacgagttattgacggaagtcggcctggacccccaagaataccgcgaccggatgccatcagaattatctggtggtgaacaacaacgaatcggtattttgcgggcaatcgcagcgcaacccgatattgtgttgatggatgaaccgttcagtgcgctggacccaatttcgcggcaacaattacaagatctagtcctagggttacacgcccgctatcataatacgatcgtctttgtgacccatgatatgaacgaggcgctcaaactaggcgaccgcattggggtcatgcaacatggacagctcgtccaagtcgacacaccaacggcactggcccaacatccggtcaatgacttcgtgcgggacttcttcggtgcgagtcgtgcgaaaaacgtgtatgacgtttacgtgggccgcgtcgggctcgtccaaggctatctcaaaactgcgccggacgtggcggatggccgtattcagtcactagatattcaggcgacgttgcggacggcctttaccgccttgaccgaccatgattacttggcggtcacggaagatgatcacgtggtgggttacctggaccgacaacgggtcgtcgcttatctgagtcagcatgaagaagtatcttag

SEQ ID NO: 325 - DNA, 1194 bp, Lactobacillus salivarius
  isolated from gut, Lactobacillus salivarius
atggaaaaaattctttcaataaattctggaagctcaagtttaaaatttaaattatttgcaatgcctgatgagaaagtcctagctaaagggctttttgaccgtattggaattgataattctcgtgttactattaaatatgatggtaaaaaatatgatgagcaaagagaattgaaagatcataatcaagctgtacatgttttgttgagcttattcaaagaattaaaattaattaatgattttaatgaaattacaggggttggacatcgtgtagttgctggtggtgaatactttgataaatctgtaattgttgatgaagatgttatgaataaaattgatgaattggctgaatatgcgcctttgcataatcctgcagaattagttggtattagagtatttaaggaattattgccaaatgcagtatctgtagctgtatttgatactgcatatcatcaaacaatgcctaaaacaaattacatgtattctatcccatatgaatggtatgaaaaatatcatgtaagaaagtatggggcacatggtacaagtcatcgctatgtagctcatgaagctgctaaattgttagacaaaccatttgaagatttaaaaattataacttgccatttgggagcaggtgcatcaatttgtgcaacaatgaatggaaagtcttttgatacttcaatgggattcacgccattagcaggaattacaatggctacacgtgcaggtgatattgatgcttcattagtttctttcatgatggaaaaactacaaattaatagttctgaaatgatagatattttaaatcataaagctggtttaattggtatttcaggagtttcatcagatatgcgtgatgttttagcggtagcagatgataatgagagagctcagctagcagttgatatttttgtaaaaaatgttgttaaatacataggttcatatatagctgaaatgggtggcgttgatacgattgtatttactgctggtatcggggaaaactcaacaccaattagaaagttagtcatggaacgtttagcatatttgggaatcacaattgatgaagaagaaaatagtaatcatggttcagcaggagtgatttcaggcgaagattccactattaaagtactaagaattccaaccaatgaagaattaatgattgcaagagatgttcaaaaattagaaaaagaagtaaaataa

SEQ ID NO: 326 - DNA, 1263 bp, Lactobacillus salivarius
  isolated from gut, Lactobacillus salivarius
atgacttatattaaaaacgtaaatagattgataaaaaaatcacaattaggtgggtggaaagtcatgaaaaaacaaaattatgctggcgtcgctgccagtgtttatatcaactttgctttagttggtatggcaacaatcatcatttcacaatacagttcttatttccaaaaagcgtggaatactgatgttaaaggtatctcaactgtactttcagttgttggtatcggccgtatcttaacaatcttatttgccggtgttatttcagataaaattggccgtaaaaaaaccatgattatcgcaatcacttccgatattattttcttattaggtgctgcatttgctcataatctctttatggcttgtgttgctgctttattctttggtgttactaactcctttggtgattcagcttgttacccagccctaacagatgctttcccagaaaaatcagctacaatgaactcattagttaaagctgctatgtcattatgtcaattcttgttcccattctgggtagcttctgtttcaaatgctaggttaactgcaattattttagctgtcgcattattcttagatattttacttgttatgtggacaccatttgctcctcatgatgaaagcaaaaagactgaaccaaaggctgaagttaagcaagaaacaacaactgtttcatcagctaaccaaccaaaaatggcaattgatggttccctaatcatcgctctaggttttacaatttgtttcactttctacgtattctcacaatatattccaaactttggaatcaacgtattaggtgttgcacctgcaactgctaaaactctattatcttggtacgcaatgtcatctatgatttctgtttttgtgactgctattgttgttacaaaagttaagcgtttaactttaatcttactttactcaacattatcagcacttggcttattattgatggtactttcaccatctctaatgactgcacgtatcggtagtatcgcagttggtttcttcggtgctggtggtatctggcaagttggtctatctgtattaacaagttacttccctactggtcatggtaagttgacaagttactatagtttcatggcttccttgacatacttcttaggacctttgttatccagtttcgtaattagtgatactgcagcaagtgtactaagtgtattctggattacagcagtcgatactatcatcactgttgttgtaacacttctacttattcaacgtagtcgtaaatttgatgttaaataa

SEQ ID NO: 327 - DNA, 2607 bp, Lactobacillus salivarius
  isolated from gut, Lactobacillus salivarius
gtgataatagagagagggattggaggatgtaacatgaaaaaagttaaggattttatcaaacaaaaatccacaattttacaattaatgtttgtagcttcagtattaatattagttttagtggaaattagtaaaattattagagatgttgactggaatcaggttagtgatggcttgcttagtcagtcaattttttcaattattatgatgctaattctaggaatgttttctgttactccaatgctaatttacgatatttcgataacttcttttttatcagaaaagtttaattggaaatatattttaaagagtggttggataacaaatactttcactaatattgcaggttttggggggatattaggagctacattaagggctagtttttatggtaaaaaatctagtaaaaaacaggttttgtatgctatatctaagattgctctatttttattagcaggattatcaatatattgctgggtatcgttatttataatctttggtttacatataggtgcagggttaactaaatattggatttggttagtcggtggaggcctgtattttccattgttatttagcattactaaattcaaaaataatgccttctttggtgatcttacgttaaaaaaagaactatttttaataatgggttcttgtttggaatgggcaggagcaggtctatttttcatatatattggattagttttaggggtaaaattcaatatacttgaaatatttgctttgtatattattgcgtccgtttttggggttatatcaatggttcctggtggattaggttcatttgatgtttttattatcctaggaatggaaagcataggcataggtaatgccgatgtaattgtatggttgctatttttccgtatattttactatattgtgccattttttgtaggtactgttttatttgtacatactctaggtaataaagtgaatgagtacttcgatggtattccaagtgcattattacaaaaaacggctcatatattaattacaatttttatgtatgcatctggcataataatgctaatagaagcagctgttccaagttttgctttttctaactttattctggtcaagttatatccgttaacatttttatttttacatcaaatgacagacgtaatatttgctttcttgctaattgcaatgggtagaggttttgaatctagagttaaaaaatcattttggccaacgataatagttttagtaataggaattgttaatactttatggagggtttatactccaggtttagcatggtttttaatctttattatggcttgtgttatcctctcaagaaaagaactttatcgagaacaattacgttattcatttgggaaaatgtttatagatggtgagatatttacagtaacatttttgttgtatttgttagttggattcttgaatttcagaccaataggacataaaagtatcccagtaccagaagttttaatttttcaaggacagcaaatatggttgtcaggttttatgggaatgattttagctggcataataatgttaataattataactagctttacatcagatactgatccatttagaaagatgaatttcgataaaaagagaattaaaaaaattatagataattattctggcaatgaagttagtcatttagcctttttaagagataaaaatatttattattacagagttaatggtgaagatataatgtatttcatgtatcgcaggaaaaatgacaagttaatttttatgggagaacctgtgggaaatatggattatttaaaagatgccattaaggagctaatgacacaagcagattactatggctatgaattagttttctatgaaataaattctaaattaactatgttgttacatgatttaggctttgactttataaagaatggtgaagaaggatatgtaactttgaaggacttttcattgtcaggtaagaaaaaacgtggtgagagggcattaatcaacaaatttgagcgtgaaggatatacttttgaaatgatagaacctccgttttctaaagagttgattcaagagctaaaacaggtttctgatagttggttagatggtcagttagagaagggcttttcattgggcttttttgatgaatattacctaaatcaagctaatataagtattattaaagatgctgataataaaattgttgcatttgcttcaatgatgcctatggatgataagactttatcaatagacttgatgagacatagtaagcaagctccttctggaataatggataaaattttcattaccttatttgagtacggtaaagaaaatggctatgaacgttttgatatgggaatggcaccattagctaatgtagggacttctcagtatagttttattgaagaaagagctgcacattttatttatgagtatggatattcattttatggtttccaaggcttaagagattacaaggataaatatgtcagctattggttacctaagtatactgcttatagaaagagaagttcaattgtctctacaatgctagaagtaacaagcgttgttaatagtaagagaagagagcagtttagaagagagatttcactttcaagattctggtcataa

SEQ ID NO: 328 - DNA, 1662 bp, Lactobacillus salivarius
  isolated from gut, Lactobacillus salivarius
atgacaaaacttggtcaaaaagtaatttatcaaatttatcctaagtcattttacgattctaataatgatggttttggagatttgaaaggaattattgctaagattgactatttgaagaaacttaatattgatatgatttggttcaatcctttttatgtttctccgcaaaatgataatggatatgatatcgctgattactataagatagatgaacgttttggtactatggaagactttgaagaaatggtagccaagttaaaagaagctaatattggtgtaatgttagatatggtgttaaatcactgttccactgaacatgaatggttccaaaaagctttggctggcgatgaaaagtaccaaaaatacttctaccttcgtcctgctaaagaagatggttcattaccaactaactggcaatctaaattcggtggccctgcatgggaaaaatttggtgatacagatttatactaccttcatttatatgataagactcaagcagatttagactggcacaatccagacgtacgtgctgaagcagctaaaatcgtcaacttctggaaagaaaaaggtgttgcaggctttagatttgacgtgcttaatgtaattggaaaagatgaagtattggtagattctgtagatccagatcatgaaaaacctctatatactgatactccagttgttcataagtatatcaaagaacttaaccgtaatacttttggaacagatcctgaaatcgtaactgttggggaaatgtcatcaacaactatccctaactcgattgaatatacaaatccagatgaacatgaattatctatggtcttcactttccatcatttgaaagttgattacgataacggtgaaaaatggagcaaggttccatttaactttatggaattaaaatccctattatctacttggcaaacagaaatggataaagacaatggctggaatgcattattctggaacaatcatgatcaaccttgggccttgaatcgttttggtgatcccgtaaactaccgtgaaaagtcagctgaaatgctagcatctgccctacatttacttcgtggtactccttatatctacatgggtgaagaattaggtatgatggatcctcattataagtctattgacgactatgttgacgttgaagctttaaacggctatcaaatgttacttgataagggtgtagacaaggatcgtgcttttgaaattgttgtttccaagtcacgtgataactctcgtgtgcctatgcattgggatgatagtaaatatgctggctttagtgaagcaaaaccttggttaatgcctactgatcaagatgaaattaatgtagaaaaagaattagctagtggcgaaatctttaatcactgtcaaaaattgattaaattaagaaaaaccgaaccacttatctacgctggtcatttcaaagaattattggcagatgataaacaagtctttgcttatgaacgttatctagatgattcatctgagaaattagttgttttcaataacttctatggcactgaagttacagttgatttaccagctgaatatcaagataaagaatgcacaacacttattgataattaccaaaatgagattcaaaagactgcaaaacaaattacactacaaccttatgaatctttagcaattaaaatttaa

SEQ ID NO: 329 - DNA, 1389 bp, Lactobacillus salivarius
  isolated from gut, Lactobacillus salivarius
atgtacggaagaagaaaaatgcgaacgaggcagggcttgtctcgaattcaaattattactttgagttttctactagcgataatgattggtagcttgattttaatgttgcctattatgagtgcgaatggagaaagtacggcttttgttgatgcattatttactgcaacaacaagtgtctgtattactggattagtaacagttacgacagcaactcattggtcgagtcttgggcatatagtaattttattgctaattcaacttggaggtttaggaacaataacgctgatgtcgttagctttttttgcgactggtaagcgaatatcgttacaaaatagattgttaatggctgatgcttttaatctagataataataaaggaattgtgaattttgtaattcgagtcattaaagagtcattgatgatagaaggattaggagcaatagcttattctatatgtttcataccacactttggttttcttacaggaagttggtattcaatttttcattcagtgtctgccttttgtaatgccggaattgacctattagcagataatagtttaattgcttatgcaggtaattggtggctgaatatcgtaacaatgttacttattgtttgtggaggtttaggttttacagtatggaatgaattaataaaaggttttgttaatcagtaccgttactacaaaaatggtaggggaaaaagattaaagaatacattatcacaacatactaagatggttttaacaacaacgtttgccttgatatttggtggagcaattctatattacctttttgaaagaagtaatcctaacacattaggtagtgttaaaaatagtcaggcgatgttagaggcactattccaatctgtaactactagaacagctggttttgtaactattcctcaagcaaacttaaccattccatcagtaatgttgacagtattcttaatgtttattggtgggtctccaactggtacagctggtgggattaagacaactacattagcagtaatattagctgaagttagagcaacaataaagggtgagccagaagcaatttgtttcaaacgccaagtgccacgccaaacaactagaaaagcaattgcgattacactaattagtgttgcggcgagtgttttagcggtgttactaatgtactttatccaacctggagatatgacagataatgtctttgaagtttatagtgctttgggaactgtaggcataagtcgtgatttaaccccacatttaacaacggcagcgaaatatttaatcatagtttgtatgtatttgggtagagtaggaccaatctctattttattagcattaatgagaagaaaacatcatgcaaatcttaagtatgccccgggaaatattcgagtaggttaa

SEQ ID NO: 330 - DNA, 1068 bp, Lactobacillus salivarius
  isolated from gut, Lactobacillus salivarius
ttgatttctgtcaaagctccaggaaaattatacattgctggtgaatatgctgttgttgaaactggacaaccagctattctagtggctttagatcaatttgtatatgtaaatttagaaaagagtaatgatttagggtcaatcatttctaaacaatataaagaaaactctttatattggaaacgagaaggtaatcaaattatttttgataatcgggacaatccatttcattatattttatctgctattaatttagtcgaagaatatgcccaaagtctaggtaaaaaaatggaattctatcatctaaaaattgatagtgaattagatagtcctgatggaaagaaatatggacttggttcttctgctgcggtcactgtagcaactattaaagctctatctgaattttatgaactaaatttatcaaaagagcatcttttcaaactagcttccattgctcatttaaatgttcaaggaaacggttctttaggggatatcgctgctagtgtctacggtggttggatagcttatcattctttcgataaagaatggcttaaagtcgctcaaagatcctatacaatttccgaacttttagatttaaattggcctaatttgaaagttactcaattgactccacctgataacttaaatcttctaataggttggactggatctcctgcatcaacttcacatctagtagatgcagttgctcttcataaggctaataatcaaaataaatacaatcattttttagaaaatagttggaaatgtatcgatacaatgattactggttttaaggaaaattctctatccaaaattcaagaatcattaatatataatcgtgaattactccgaaatttagctagtttgagttctgtagaaatcgaaactcccctactaactaaacttatcacttctgcagaaaaatttggtggagcagcaaaaacttctggtgctggtggaggagattgtggtattgttctaattgataaatctatgaatgttgagccattatttacttattggaaagaaaatggaatagtcccattatcattgcacgtttatcaagattaa

SEQ ID NO: 331 - DNA, 855 bp, Lactobacillus salivarius
  isolated from gut, Lactobacillus salivarius
atgaaaaaaataaaaattcttataggaagtttattaattgcaaccttgatgacaggatgtgcaagtaaaaaaaacaataatataactattgttggttcaacagcaatgcaaccaatgatagaaatggcagcagaagaattccaacatcattctaaagtaagaataactgttcaaggtggaggctcaggaacaggcctaagtcaggtacaagcaggagccgtagctattggaaattcagatattttcgcacagcaacaaccaggaattaaagctgaaaaattacaagataataaagtagctgttgttggtattgcacctgtagttaataagaaagtaggtatagataatttatctatggagcaattaaaaggaatttttacaggtaaatatactaactggaaacaggttggaggaaagaatcaaaaaatcattgtaattaatcgtgctcagggaagtggaacaagaaaagcatttgaaagcgacgtattaaaaggtgaaagtgctattaaagcacaagaacaagattcaagtggaacagtacaaaaaatgatagctgctacaccgggatctataagttatttagcttttccttatttgaataaagatgttcaaaaattaagtatagataatgtaaaacctaatgtaaaaaatgttgaaaataatgattggaaaatttgggcatatgaacatatgtatacaaagaaaaaggtagataaaaaagttaagaaatttattgattatatttatacaaaagaagttcaacaaaatctagttaaaactttaggctacattacaattcatgatatgaaagttcagaaagatgagaacggaaatattgaagaaattcagagatga

SEQ ID NO: 332 - DNA, 810 bp, Lactobacillus salivarius
  isolated from gut, Lactobacillus salivarius
atgaaaaattataaaagtttaaaagacttaactaataaagttgtgttgataactggagcatcaggtggtttaggtgaacaaatagcttatcaagtagctaaaaagggtgcaatagttgtagcttgtgcacgtcgtaaagaaaagttagatatagttgtagaaaattgtcaaaatttgtctaagagattagcatatgcataccaactagatatttccaagccagaagaagtagaaaaagttgttaatgaggtagaggaagaagtgggacctgtctcagttttaattaataatgctggctttggactaatggaagacttccttgattttgatatggatagagtagaagcgatgttcagagtaaatgttttaggattaatgtatgctactaaatatgtagctataaaaatggctgaaagacaagtaggtgcaataattaatattgcttctatggctggcaaaatagctacacctaaatcaactgtctattctgcaactaaatttgcagtgctaggcttttctaatgctctacgtttggaattgaaaccattgggaatttcagtaatgaccgtaaatcctggacctatcagaacagaattctttgataaagcagataaaacacataattacctaaattctctaggagatatagttttagacccagaggaagtagcttataaaattgtttcaaagattggaactagtcgacgtgaagtgaatttaccatattacatggaagttgctcatcacttatatgaagtcttcccacatatggctgattatttaacaggtggtatttttaacaagaaatga

SEQ ID NO: 333 - DNA, 2646 bp, Lactobacillus salivarius
  isolated from gut, Lactobacillus salivarius
atgtggattaaaatgaaatcttttataaataataaatatccatttttacttagcttttttggccctattgtcataatgttagcctattttattgctcgtcacatgtatccatttggttctagtacaattctaactgttgacctaggacagcaatatgtagacttctttgcttttttcagagaaaccttacttcatcatcctgggagtttcttctactctttctcaaaagctattggtggtgaaatgattggagaatgggcttattacctacttagtccatttaatttattattcatctttttccccggtaaatcgattgccgctggagtcttagtcgttactctcttgaaatatggtttttgtggcctatcttttgcgtatcttttatctaaaagaaaattgcaaaaaggttggatgatacccacattttcaattagttatgctttaatggcgtggaatgttgttaaccaacttaatttattatggatggatgcggctattttacttcctctaattattgctagtttctatgatttaatggaaaagcgtaagatgaaggcctatcctcttttacttgcattgatgcttatagataattattacatggcatatatggtgtgtatcttcctagttctattctttatttggtaccagataacatatactaccaaattcaaggaatttctatctagaacttggttatttgcaagtcgatcaattctagcagggggcattgctgctgttattttaattcctactgcgataacccttactagcagtaaaggccaatacacagaaagctcgattcaagctaaattagaatataatccacttaaaatgttatcaaaattaacgattggttcatttaattttgatcaaatgccatctgggtttcctaatatttttattggtagtcttgcattatttgcctttattttgtacttctttaatcgtcaaaatacaatcaaatccagaataagtgcatttttaatcagtattttctttacagtttcaatgtgctttgaaccactagatttattttggcatggaatgcaatttccggtttggtatccatatagatttacctttattgtaagtttttggatgtttttcttgggaagtcaaggtatcactaatttcattgttaatgttaagccatggaaaattttccttttattcttcatagaagtcggtattatttcctatgtatggattaatgttaaaaaattcaactatgctactactgagactttaattttttctgctacctttgcatttttagttttactacttttaagtattaatagtactaatgacagaagcatcattaagtttctgttacttttcctagtagccgtatctgaaatgtctgccaatatgattttttctctgaataatattagctatttatccaaacgcgaatttgtagatccaacaactgcacttactgctgatagttcttggctacatcgccatgattctagcttttatagaactgctcaaatttattctagaactaaaaatgatggtataacacataatcttaatgctggtgcatatttcagttctgctctagaaaagaatattccagatttttatggtatgattggccaaccagatggtgataactatgttacttattctaatggcagtctgataactgatggtttacttgatatgaaatatgctattgctcctaaaaataataacgaagttactgaaggtagcagtcacggttatcctttaatccaaacttcagagcgtagtgatttaagctcatatcaactactaaaaaataatcctcgtacttcaatttatcaaaatccatatgctacaagtattggttatagtgcaggatctactatttcaaagatgcaacgtttgtttgacaatcccgttatttatcaatctaattggcttaacgctgcatctagttcaatgcctggaacgacttattttacagctatgaactttaataaagttatttttactaataccgcagaaaaaacaactttaactaactcagattttaaaaaaattgataaaagtaaggatgcaagtattacttttgaattcattccgacaaccaataattcttattatcttacattgggtacttcacttgataatgacaatgtcgagtttctaattaatgatcgcgtacttcataattattctacttttagacatacaactcttgtgaatgtcgcaaataacgataaaggtaaaaaaatctctattactgctaaatttaaaaaagataatctttggttgaataattttgttctatatcaactagataataatttagtaaagcaaaagctaactcaaattaaaaaatattcttggaagatacaagattattcgtcaacttcattaaatggaaccattgatattgttaagtcaaatcaatggtttgcaactactattccttataatgatggttggaaagcttatgttgatggaaaagaagtccctacttataagatccaacaaacatttattggattccctatttctaaaggcaagcatcaagtaaaattaacctttactcccccatatctttatcaaggacttgtggtatcagttatttcattgatgttgctatttattcctggattgttaaaaagaaaagttcataaataa

SEQ ID NO: 334 - DNA, 2253 bp, Lactobacillus salivarius
  isolated from gut, Lactobacillus salivarius
ttgaaaaaattattgggtgttgaggtgagatttatgaaaaaagaaacaatttggtcagctcaagatgtaattgatatgtgcaaaggatacatgaatgaaaatcatgttaaatttgttgagaaagcgtgtgaatttgccacttatgttcacagtgagcaagttagaaaatctggtgaaccttatataatccatccaattcaagttgccggaattttagcaaacttaaaaatggatccagaaactgttagtgctggttttttacatgatgttgtcgaagacacaaaggttacactaggagatattggtgaattatttggaaaagacgtagaagttattgtagatggtgtaacaaagttaagcaaaataagatataaatctcatcaagaacagttagctgaaaatcatcgtaaattattgttggcgatgtctaaagatttacgtgtaattattgttaaactagctgacaggttacataatatgcgaactttgagtcatttaagaccagataagcaaagaagaatagcaaatgaaacccttgaaatttatgctccattagctgatagattaggtattagtacaattaaatgggaattacaagatatgtctttgcgttatctaaatcctcaacaatattatcgtattgtacatttgatgaactctaaacgtgaagaaagagttcattatattgatgaagtgattgttgaaattaagaaagcaatcgcagaattgaatattgaatatgatatatatggtagacctaagcacatatattcaatttaccgaaagatgagagatcaacataagcaattcagtcaaatatatgatctttctgcagtacgtgtaattgtaaagagtattaaagattgttatgcagttttaggagctattcatactcgttggaaaccaatgccagggcgtttcaaagattatattgctatgcccaaagctaatatgtatcaatctttgcatacaacagttatcggtcctaatggtagaccttttgaagttcaaataagaactgaagaaatgcatcgtgtggctgaatatggtattgctgcacactgggcatataaagaaggacgtaaagacgcagttcctcaaacaactactggaacgaaattgaacttgtttaaagaaattttagaactacaaaaagagtcaaacgatgcttccgaatttatggaaagtgttaaaggtgacttatttagtgatcgagtttatgtctttactcctaaaggtgatgtgtttgaattaccaaaaggctcaggcccattggatatggcatacagtatccataccgaaattggtgctcatacaactggagcaaaggttaatggtaagattcgacctcttgactatcaattgaaaaatggggatattgtagatattttgacttcacaaaattctgcaggccctagtcaagactggttagatttagtacacacaagcaaggctagaaataaaattaaacactttttcaagaaacgtgatcgtgaagaaaatattgaaaaaggtagagaaatattagttcaagaattaactaatgcaggatataatgctaaagatgttttaaatgataatatggctaagtgcttagagaaaaagcaatttaagaaagccgacgatttgtacgcttccattggttctggtgacactgcaccagttggaattgttaacattttaacggcagatcttagaaagaaagccgatgatgatagaaaacgtcaagaagaaaaggcattattggaaaatcatcaggaaattaataatgatacaaaagaaaataagaagcctaagcaagaaagtggtatcttaattgaaggtattgataatttacttgttagattaagtcattgttgtaatccagttccaggtgatgatattgttggatatattactaaaggtcgtggagtttctgttcatcgagttgaatgtcctaatgtgaaagcagccgaaagccaaggaactagattgatagatgtttcttggaatatcttacctgacgatagagcttactataatgctgatttagaagttcaaggatataatagagatggcttgttaaatgatatacttcaagcaatcaacaataacactaagagtttgaattctgtaaatggacgaattgatcataataagatggcaaatatttctgctacgattggtgttaaagataaggaacatctccaaagaattattgatagaataaagaatattccggatgtttatatggttaaacgtccaatacattag

SEQ ID NO: 335 - DNA, 1059 bp, Lactobacillus salivarius
  isolated from gut, Lactobacillus salivarius
attttgatggacatctcagcagaacgttttggtgaactgaacggtgaaaaggtaaacaaaattacattgacaaacgataatggagtagcaatctcatgtttgacaatgggagctttatggcacgaattcttagtaccagctgcagacggtacaaaacaaaacttgattttaaactacaacacagtagctgaatattacagcaatggtttatgcaccaatcaagtaattggtcgtgttgcaggtcgaattaagaatggtaagtgcgaaattaatggggaacaagtaactttaccacaaaatgaaaacggtaatactttgcacggtggtcctcatggatttaatacttataactggagctttacaacttcagcaaaccgtaacagcattagtgtgattttccaaaaacaagttttaagtgcggttgatggattcccaggagatattttggtaactgttatctatactttagacaatagtaataacgtaacaatttcctttaatgcacttggagacgataaggtagacacactatttaacccaactaaccacgtttactttaatttgagtaatcgttctgacttggctagtcatgagcttaaaatcaatagtgacggatatctagaattagatgagaacctaattccaacaggtcgaattcgtcatggcgaaggtacagcttatgattttactaaaggtgctaacttatacgaagctatccaacaaaatgaaaaaggtggctttgatgatgcatttgttgtaaatggaccaggtaaggctgtagaaccaatcgctgttttacgtgatactcaatctggaaatacagtaacaattgattcagatcgtaacagtttgatcatgtatacaatgaatgatgatttgccagatgttcatttcaaacgtgataatggacgccctgctaagaaacaagaaggggtagctttagaagctcaaactttaccagatgcaattaatcaagaaacatttggggatattgtattaccacgtggagcaaagcgttcctaccacattaagtacacatactccaacgataaaaattaa

SEQ ID NO: 336 - DNA, 765 bp, Lactobacillus salivarius
  isolated from gut, Lactobacillus salivarius
atgatattttcattaaaagattattttagaaaggtaggaattaagatgcgaccaagaatagcaattccagctgatacgctaacagaagcaacaaatgttattaatgaaagaatggcaccctatgcgcctaaaccggtaattgaagcaattgttaaatcaggtggggttccggttatttttccgagtgtttctccagaattggtaccagattatctcgacctttttgacggagttctttttgcagggggagctgatgttgatccaacattttttggagaggaacctcatcaaaggttaggggcaacttatcgtaagcgagatttatttgaaattgaattactgaaacagtccttaaaagctgataagacaattatgggaatttgtcgaggattacagttaataaatgttggtttagggggaactttatatcaagatttatctgaaaatccagaagcaacaatcaaacattctcaagatgcaccaggaaattttccttctcaccacgtcaatgtacaagaagatagtcgtctctattctttagtagggaagcgaccttatgtaaattctcgacatcatcagttactaaagaaaattgcaccaacattacgtgtttctgcctttgccgacgatggagtgcctgaagcaattgaatcaaaagaaaataaccaaattttagctgttcaatggcatccagaaaatatgtttaaacattatgaatattctcaaaagatatttgctgactttattgaaagagctaagcactag

SEQ ID NO: 337 - DNA, 1317 bp, Lactobacillus salivarius
  isolated from gut, Lactobacillus salivarius
atgggattaaaggagagtaaaatgatttcacgttatacacgtccagaaatggcagcaatttggaatgatgaaaagaaatacgaatgttggttagcagttgagttagctgcggatgaagcttgggcaaagcttggtcatattcctgatgaagatgttgaaaaattaaagaaaaatgcaaagataaatgtagatcgtattgcagaaatagaagaagtaacacatcatgatgttattgcatttacgcgtgctttatctgagacattaggtgatgaaaagaaatgggtacattatgggttgacgagtacagatgtcgttgatactgcctatggttatcaattaaagcaagtaaatgatattttacgtaaagatttacaagaatttaaagaaattgttgctcgtaaagctaaaaagtataagaatactgttatgatgggacgtactcatggagtccatgcagaacctactacatttggcttgaaattagcaagatggtattctgagattaatcgtgatattgaacgttttgaacatgctgctaaaggtgtagaagctggtaaaattagtggtgctgttggtacatttgcaaatattgatccttttgttgaaaaatatgtatgtgataaattaggaattagagcacaagaaatttctagtcaagttttaccaagagatttacatgctgaatacttatctgcattggctttaattgctacaagtttggaagaatttgcaactgaaattagaggattgcaaaaatctgaaacacgtgaagtagaagaatattttgcaaaaggtcaaaagggatcttctgcaatgccacataagcgtaatcctattggttctgaaaatatctgcggattagctagagtttgccgaggacatatggtaactgcctttgaaaatgtttctttatggcatgaacgtgatatctctcattcatcagcagaaagaataattttacctgatactacaattttgattgattacatgttacatcgttttggaaagattgttgagaatttaacagtcttccctgaaaatatgaaacgtaatatggatagaacattcggattgatttatagtggacgtgtacttttgaaattaatcgatacaggaatgagtagagaagaggcatacgacttaattcaaccaaaaactgctgaatcttgggataagcaagttccattccgtcctttgttagagcaagatgaagaaatttctaagcgtttatccaaagaagatttagatgatgcgtttgattatcattggcatttacgtcatgtagatgatatttttaaacgcgtgggattagaataa

SEQ ID NO: 338 - DNA, 957 bp, Lactobacillus salivarius
  isolated from gut, Lactobacillus salivarius
atggatattgtacttttagatggttactctctaaacttcgatttaacttggagcaaactatccaacttaggtaattgtactttttacgatcaaacacctgtagatgatactgaagagattattaaacgtattgacaatgctgaaattgtaattacgcataaaacaccattaagaagtgaagttttaaaacaagttcccaacttaaaatatattggtatcatgggaactgggtatgatgtcgtagatattgagagtgcccaccaacataatataattgtaaccaatgttcctacatacggtactgatgcagttgctcaattcacattttctcttctactagaagtaactggtcaagttggcttacataatcaactaattcatgaaggaaaatggtcaaaagttcctgattttacattttgggacaaacctctctatgaattaaagggtaagacattaggattaattggttacggtcgtattgcacaaaaagtagctgaattaggccatgttttctcaatgaatgttattttttataatcatcgtcctaaagaggttaacgtttcctggattaagcaagtttctttagatgaacttctaaaacaatcagatgttattagtttacacgttattcaaacacctgacacaattaatctaattaataaagaaacaatctctaagatgaaaaagaacgtcattattttaaacacagctagaggaaagctaatcaatgaaactgatatagctgaggcgttaaataataatcgcatctatgctttagcaactgatgtagtctctaaagaaccaatttcaaaagacaatccccttttaactgcaaaaaattgctacatcactccacatattgcatgggctcctttggaaactagagagagattacttgaaattacagttaataacttgaaaagctatttgacaggtactcctaccaacataatttaa

SEQ ID NO: 339 - DNA, 2790 bp, Lactobacillus salivarius
  isolated from gut, Lactobacillus salivarius
atgataaaagaaagaatatatgcagtggttgatttagaaactacaggtcctaaacaagatggtagcgataaaataattcaatttagctgtgattttgtacaatcaaataaaattgtaaatcatttttctaccttaataaatccaggaatgcctattccagttgaagtaaagaaacttacaggaataaaagataaagatgtacggtacgcgccatatttcgatgaagttgcaggaacaatttatgcgatgttgcagaatacaacttttgtagcgcataacgtgaactttgattatagttttttgagttctgaattggaaagagctgggtacccagaattggaattaccaatgatggatacagttcaactgacacaaataatttatccaacattagtctcatataggttaatagatattagtaagtatctacaactttctcatatacatcctcataaagcggatagtgatactaaagcaacagctgaattattaattaatttaaaaaagagaattgaaacttttcccttaattctattgcaaagattagcgaaaatgggagattctttaattgctcaaacaggtgaattttttaatgaagtataccttaataaaaaggatagagaagagaagttgcctaataatttaatggttgtagaagatattgtcttaaaaaggcctaaactcatagacgaaaaaatatcaaaacaagaatatcctgagacaaagagagagaagcaaaatcttttttctgaagtcttggaatggcgctctagtcaaataaaaatgatggacgatattaataatgacttgaatgaaaaaaaatcaaaaatttatatatatgatgctgcaactgggattggcaaaacattaggctatctaatgcctattgcatataaagctactgaagaaaaagttgtaataagtactgctactacaactttacaaaatcagttaatagataaggatatatcaatgttaaaagaagttattccttttaatttgaatattgtgaatttaaagggaagccagcattatattgatatagataaattctaccaaagtttatctattcctcagtcaaaaaaggctactcaaatacagatgactttattagtttggcttatggaaacttcaactggtgatatggaagaacttaacttattgagtatgcaagatacaatttttgcacaaatagagcatcatgggataagaggactgaataaaaaaagtgcattttattcagtagactttttaaagcggcaagaaattttgagaagacatgcgaatataattattacaaatcatgcttatttattaagtcatgttgataaattaggtggaaatgacacagtattaatagttgatgaagcacagcacctgaatgataatttgcttaaagaaaacagaaaaataatagattttgatcaaataaaaataatttctgattcattactagtaaaaatggaatcacaattatctttttcatttagagacttggtagagataaattttattactaaagcacaatatactgagttaataagaccaattcaaactatagactatgaaataatgaatctaagagaaatttttatgacttatcttaattcaaatatgaacaaagcatcagatgtatatgttgaagttccaataaaacctttgaatcttagaggaatgattaaggcaaatttatttatattcaaaaaaattgagaaagctttaagaaatttaaaaaggcttcaaaataaattttctcaaaagtatagcatggccattgttactgggagattaggattggatgaaattcagttaataaatgattatcaaaagttacttaatcttttattaaacgaaatgaaaagttggtcatatctagatttaaatagattggaagatgaattggaaacagagtttatctggttgacatatccatataaacaagaaaatggacatttacgtttgaattttatcatgttagatggtgagaacttcttaaataacaaggtatatcaaaaattttctacagtttttctggtaggtgcaaacctagctatgaaagaaactaggagttacatgtttagacaattagatcttgatggtcaggttaagattaagaaatacgataatatttttgattatagcaaacaaactagagcctatattttaaaagatactctggatataacgtcgatttcaaaaaaagaatacatagagtatttatctcgtgatttagagaaaatattgctgaataataatagacagacaatgatattatttaattcattagaaataattgaatcagtttatcctaagttagttaagaaaattggaagtaaacgtgagattttagcgcaaggtataactggtagtgtagaaaaaattaaaaagagatttatgctaggagaaggaaaaattttattaggagcaggcgctttttgggaaggtattgatttacctgaaaataatttagagatggtaatagtcacacgattgccgttccagtccccagatactgtccttaataaagctaggtatagaaaattagagaagaaagggattaattcattttataatttagctttaccagaggcaattttaagattgcaacaagggtggggaagattaataagaacgcctaaagataaaggaatatttgtattacttgattcaagaattgccaataaaaactatggggaaaaatttattagttcgtttccagatggagttaatcttaaaagtttgaaaattgatgatttactaaaagaaattacttcattttttggtgaataa

SEQ ID NO: 340 - DNA, 1842 bp, Lactobacillus salivarius
  isolated from gut, Lactobacillus salivarius
ttgaaaagacgtgaagatattcgtaacgttgcaattattgcccacgttgaccacggtaaaacaaccttagttaacgaattacttaagcaatcagatacattagatgaacatactgacattggcgatcgtgctttggattccaatgatcttgaaaaggaacgtggtattacaattctttccaagaatacagctgttaagtatggagataaacaaattaatattttagatacacctggacacgctgactttggtggagaagttgaacgtatcatgaaaatggttgatggtgtacttttaattgttgatgcatttgaaggtactatgccacaaactcgttttgtattgaagaaagctcttgaacaacatttaacaccaattgttattattaataaaattgaccgtccaggtgctcgtccagaagaagtagtagacgaagtattggatttattcattgaattaggagcagatgaagatcaattagatttcccagttatctacgcttctgcaatgaatggtacaacttctcttgattctgatcctgagacacaagaacatacaatgaatccaatttttgatacaattatcaatacgattcctgctcctattgataactcagatgaaccacttcaattccaagtggcaatgcttgattataacgaatttgttggtcgtgtaggtattggtcgtgtattccgtggaaagatcaaagttggtgatcaagtaacagttatgaaacttgatggttctcaaaagaacttccgtgtaaccaagttatttggtttctttggtttgaaacgcttggaaattcaagaagctaaagctggcgatttaattgcagtttctggtatggaagatattttcgttggtgaaactgtatgtcctgttgatcatccagaagcattaccattgcttcgtattgatcctcctacattacaaatgacatttatgactaacacatctccatttgttggacgtgaaggtgataatgttactgcacgtaagctagaagatagattgaaagttcaacttcatactgatgtttcattaaaagttgaagatacagaatctccagatgcttggactgtatcaggtcgtggggaattacatttatctatcttaattgaaacattgcgtcgtgaaggattcgaattagctgtatctcgtcctaaggtaatctatcgagaaattgatggtaagctttctgaaccatttgaaagtgttgttattgatacacctgatgaatattctggtgcggttattgattctatggctcaacgtaaaggtgaaatgttgaacatggaaactggtaataatggtcaaacacgtttagaattctctacgccaacacgtggcttaattggatacgattcacaattcttgtcaatgactcgtggatacggtattttaaaccatacattctctgaatataaaccagttattagaggatgggaaccaggtcgtcgtaatggagcattagtatcaattaatcaaggaaaaacaacaacatatgcaattatgggtgttgaaggtcgtggaactatttttgtagatccaggtacagaagtttatgaaggtatgattataggtcaatcttcacgtgaacgtgatatttctgtcaacgttacaaagggtaagaacatgactaacgttcgttctgctacaaaagaccaaacagcaacaattaagaaaccaacacatttgacattggaagaatctctagaattcttgaatgaagatgaacttctagaaattacaccagaatccatacgtttacgtaaacgtattttggaaacaaatgcgcgtgaaaaggctgctaaaaaagctaagaaagcaacagaataa

SEQ ID NO: 341 - DNA, 1113 bp, Lactobacillus salivarius
  isolated from gut, Lactobacillus salivarius
gtgacaaattatttagtagtaggtgcagggcttttcggtgcagtatttgcacacgaagctgctcaaagaggacacaaagtaaaggttattgaaaaaagagatcatgttgccggaaatatttacacaaaagaggtacatggtattcaagttcatcaatttggtgcacatatcttccatacttctaagaaagaaatttggaaatatgtaaatcaatttgctgaatttaatcgttatactaatagcccagtagctaattataatggtgaaatttataatttaccttttaacatgaacacatttaataaactttggggagttgtaactcctaaagaagctatggctaagattgaagaacaacgtgcagttcttaatggtaagaaaccaaaaaatcttgaagaacaagctatttcattaattggaacagatatttatgaaaaattaatcaagggttatacagaaaaacaatggggacgtaaagctacagaattgccagcttttattattcgtcgtttaccagtacgtttaacttatgataacaactatttcaatgatacatatcaaggtattccaatcggcggttatacacaaattgtcgaaaagatgttagataatgacaatatcactgtagaaacaggggtagatttcttcgatcgtaaagaagaatatctaaaagaatacgataaagttgtcttcacaggtatgattgatcaattcttcaattacaaacttggagaattggaatatagaagtttacgctttgaaacagaagtgttagatgaagataatcatcaaggcaatgccgtagtaaattatacagatgctgaaacaccttatactagaataatcgaacataagcattttgaatttggtaagggtgaaaaaggtaagacggttattacgcgtgaatatcctgctgattggaaacgtggcgatgaaccttactatccagtaaatgatagtaaaaacaacagcctttacaagcaatatcaagaattggcaagtaaagaaactgaaaatgtaatctttggtggacgtttgggacaatatcgttactacaatatggatcaagttataggagcagctttactaacagtaaagaatgaatttgaataa

SEQ ID NO: 342 - DNA, 1935 bp, Lactobacillus salivarius
  isolated from gut, Lactobacillus salivarius
atggatcacaaaaaagttgctaaaaatgtagttgacgctgttggtagagataatttaatcgctgccgctcactgtgctacgagattacgtttggtacttaaagacgataagaaagtaaaccaagctgctctcgatgctgatccagatgtaaaaggaacatttaaaacaaatggacaatatcaagttatcattggaccgggcgatgtaaataacgtctatgatgaattgattaaagatacaggtttaaaggaattatctacagatgatttaaagaaagttgctgaacaaggtcaaaagtttaacccagtaatggcatttatcaagctattatcagatatttttgttccaattatccctgccttagttgctggtggtttgttgatggctttgaacaacttcttgactcaaccgggattattcggacctaagtcaattgtttcaacatctccagttattaagggattatcagacatgattcaattaatgtctgctgctccatttatcttcatgccaattctagttgcaatctcagcttctaaacgttttggtgctaaccgtttcttaggtgctgctattggtatgattatgacttctccagatttaggtaagactgctaaatactgggatatcttcggaatgcatgttgctcaaacaaactacgcttatcaggttattcctgtaatcgctgccgtatgggtacttgccttcttggaaaagagattccacaagtggttaccagcagctgttgacttcacattcacaccattactttcagttatgattacaggtttcttaacatttacagtaattggaccagttctaaagactgtatctgatatgttaacaaacggtattgtatggttatacgacacaacaagttttgttggtatgggtatttttggtttaacatattctgcaatcgttatgacaggtttgcatcaaagtttccctgcaatcgaaacacaattagttacagcatttgctaacggacatggtgccggtgactttatcttcgttgttgcatcaatggctaacgttgctcaaggtgctgcaacattcgcaatttacttcttaacaaaagataagaagatgaaaggtctatcctcatctgctggtgtatctgctttactaggaattactgaaccagctttattcggggtaaacttgaagtataaattcccattcttctgtgctttaattggttctggtgtggcagctgcatttgcaggcttaatgcacattatcgcagcttcaatgggtgctgctggatttatcggattcctatccatctatccaaaatcaattccaatgtacgttgttgctgaattaatcagtttcgctgtagcatttgtcttgacatttatctacggtaaaggtcatatgaaagaagaacaagtagctcctgttgtatctgcatctgaagctgctgaaacagaagcaaaagttgaagaacaagtagctgctgaaagcaaattaaacgatgaagttgttgcatctccaattagtggtgaatcaaagaaattaactgacgtaaacgatcctgttttctctactctagcaatgggtaatggtgctgcagttgttccaactgatggtacaatctatgctccagttgatggtgaattaacagttgcttatgaaactaagcatgcttatggcttgaaatcagataatggtgctgaagtattaatccatgttggaattgatacagttaacttgaaaggtcaacatttcgaatcattcgtaaaacaaggccaaaaagttaagaagggcgacaagttaggaactgttgatttagatgcagtcaaagcagctggctacgacactacagtaatggttgttgttacaaacactatgaactatgcttctgttgatcgagttgacaatacaaaagtaaatcatggtgacgatttagtagcagtaactgcaagataa

SEQ ID NO: 343 - DNA, 954 bp, Lactobacillus salivarius
  isolated from gut, Lactobacillus salivarius
atgaagggactaattgatatgcgtaaatacttattaaaacgtgttttgtatatgctattaacattgttcctggttgcgacaatcacattcttcttaatgaaattgatgcccggaacaccatatacgaaccaagctaaaatgacagcttcacaaattgaaataatgaacaaacaatatggtttggataaacctatttgggaacaatacttgatttacattttcggtatgttccatggtgattttggaacttctttccaatatagtaaccaaccagtagcatacttaatttctagtcgtttaggtgcttcaatgcaactaggtttacaagcgatgatcttcggagttttcttcggtgtaattctaggtgcagctgcagctatcaagcataatacatgggctgatacaggagcaacagtaattgcgattattggtaaatctgtaccaaacttcgtgttagctatcttgttacaatactatattgctttgaaattgggatggttcccaattgcaggttggggtcaattctccaatacaattttaccaacaattgctttaggggtaggaccattagctgaaacagctcgttttatccgtacaagtatggttgaagtgttgaactctgattatattgaattggctaaagcaaaaggcttaagtaaatttgaagtggtttatcaccatgcattaagaaacagtttgattccattagttacattattaggaccttatacagttgctttgatgacaggttctatggttatcgaaaatgtctttaacattccaggaattggggaacaatttgttaagtcaatcatgactaatgattacccaactattatgggggtaacaatggtcttctcaatcggattggtagtagttattttaattactgacatcatctatggattgattgatccacgtattagacttgaaggaaatggagggaataagtaa

SEQ ID NO: 344 - DNA, 924 bp, Lactobacillus salivarius
  isolated from gut, Lactobacillus salivarius
atgtcaaaaatttataattctatcttagatactattggaaatacacctatcgtgaaattaaatcatgttgtacctgaaaatgctgctgatgtttatgtaaaacttgaattctttaatcctgcaggttcagttaaagatcgaattgctttagcaatgattgaaaaagctgaaaaagatggcattttaaaaccaggtgatactattgttgaaccaacttctggtaatactggtgttggtttatctgcagtagcttctgctaaaggctatcatttaattattactatgcctgaaactatgagtgatgaacgtaaaaaattaatgcgtgcttatggcactgaacttattctcacaccaggatctgaaggtatggcaggctccattgctaaagctgaagaattagttcaaactaaaggttacttcatgcctatgcaatttaagaacttagctaatcctgaaattcatgaacttacaactggtaaagaaattgttgctgcttttggtagcgataatttaccagacgcatttgtcgctggtgtaggtactggtggtactctaactggaatcggtcgtgctttaaagaaggcttcttcagacgtcaaagtatatgctcttgaaccttctgaatctccactactcaaagaaggcaaaaaaggtgcacacaaaattcaaggtatctctgctggctttatccctgatactttagatcgtgaaatttatgatgatgttgtagaagtttcaagcgatgaagcatttgaaactgcacgtgaagttgctaaaaaagaaggtttcctacctggtatctctgctggtgctaacattcatggcgctattgaattagctaaaaaattaggtaaaggtaagaaagttattactgttgctcctgacaatggtgaacgttatctttctaccgctttatatcaataa

SEQ ID NO: 345 - DNA, 1830 bp, Lactobacillus salivarius
  isolated from gut, Lactobacillus salivarius
atgacattttcaattaaaacacgtaaaaatacagttgataaattaaagaatgaagaattagatttgttagtaattggtgggggaattacaggtgcaggtgttgccctccaagctacagcttccggtttgaagactggtttagttgaaatgcaagactttgctgaaggaacaagttctcgttctacaaaattagttcatggtggtatcagatacctaaagacatttgatgtaggtgttgttgcagatactgtacaagaacgtgcagttgttcaaggaattgctccacatattccaagacctttcccaatgttattacctatttatgacgatccaagttcaacattcgacatgttcagtgttaagattgcaatggacttatatgaccgtttagctggagtaacaggcacacaatatgctaactacacaatttctcgtgaagaagtattacaacgcgaaccaaacttgaagagcgataagttattaggtgcaggtgtttaccttgattatgtaaataatgatgctcgtctagttattgaaaacattaaagaagctgatgaattaggtggcttaatggctagtcacgttaaggttgtaggtgttcttcatgatgataatggccgtatcaatggcgtaaaagctaaagatttattaacagatgaagaatttgaaatcaaagctaagatggtaattaatactacaggtccatgggtaactaagacattaggcttagatgacaagaatggcgaaggtgaagtaattcgtccaactaaaggtgtgcatttagttgtagatagctcacgtctaagagttcctcaaccaacatactttgattccggaattggtgacggtcgtatgatttttgttgttccacgtgaaaacaagacatactttggtacaacagatacagactacactggtgactacaagcatccaagagttgaacaaactgatgtagattacctattgaaagctatcaacaacagatacccagaagctgaaattacaattaatgatattgaagcaagctgggcaggtttaagaccacttctatctggtaatggaagttctgactataacggtggtggatctaacactggtaaagtatcagatgaaagtttcgaaaacttaattaagacagctgtagcatacagtaaagatgaagcaagtcgtggcgaagttgaaaaatcaatcagcagcttgaagacagcttcagcagaaaagactctaagcccatcacaagtatctcgtggttcttcacttaaagtaggtgatgatggtttaatcacactttctggtggtaagattactgactatcgtaagatggcagctggagcaatggaattaatccgtaagttattcaaagaattatttaataaagatgtacgcgaagttgattccaagaaattacaagtttcaggtggacacttcgatcctacaaacgttgatgaaacaatgaaattctaccaaaagattgcgatggacaaaggtatgccagctgcagatgctgctgacttagcaaatcgctttggttcaaacacaagtcgtgtaatttcttacgcagacgatgtagaagcagctccaggtttaactttagctgacacattgagcttacattactctgtaaatgaagaaatgaccttgaatttagtagacttcttattacgtcgtacaaactatgttctcttccataaagatgaattaatgatgaagaaagatgcctttgttgatgaaatggcacgcatcatggaatggaatgaagaagaaaaagcagctgcagctaagcaattagatgaaactattgcagaatcaagcttagcatacttgaagtaa

SEQ ID NO: 346 - DNA, 1200 bp, Lactobacillus salivarius
  isolated from gut, Lactobacillus salivarius
atggagagaaaaaatattgctgtatttttaacaggtggaattgctgtttataaagcagcaaatgttgttagaggcgtaattaaaaaaggatttaaagtaaaagtagctatgagtgaagcttctcaaaaatttataactccatatacattccaagctttaacacatgaaaaagtctatactgatttatttgagataacaaatgataacccaataccacatattgaattagctgattgggctgattttgctttgattataccagctacagcaaacataatagcaaaaatggctaatggtatagctgatgattttattactacgacactgttagcaatagatatgccgaaatttgttgttccagcgatgaatgagaaaatgttattgaacagtgctaccaaaagaaatatgcaaactttgataaatgatggtgtaaaaataatgtctccagatacaggtatgttagctgaaggatatactggtaagggaagattgcctaaagaagaagagattattgagtggattattaataaaataaattcaaagaaagatttagttggtaaaaaagtcgttatttctgctggaagtacaatcgaaccaattgatcctgtcaggtatatatctaactattcgagtggaaaaatgggctacgctttagcggaagcagcattcgaacgtggagcaagcgttacattagtaagtggtcctactaatttattggcaaccccaggtgtaaaaatcaacagaattaaaacaactaaagaattagaaagaaaaatgaatgaagaatttaaaactgctgatattgcaataatggcagcagctgtttctgactatcatgttgctaaagtagcaaataacaagattaaaaaaactggagaaaagttaacattagaattggtacaaaatcctgatattttaaaaggactgggctcagttaaggaaaaacaaatattagtaggatttgctgctgagacgaataatttatatgaaaatgctcaaaataagttactttccaaacatgcggacatgattgttggaaatgacgtatctagaaaagatataggatttggaaatgatgataatgaagtaacactatttactttgaaaaatagtcctattaagttacctaagactaataaaaaagaattaagtcataaaattttggatgtaattgttgaaaaacttatgtctaaggagtga

SEQ ID NO: 347 - DNA, 1845 bp, Lactobacillus salivarius
  isolated from gut, Lactobacillus salivarius
atggttaaagtaaataattgggatgctgagtatgatgtagttgttttagggtttggtggagctggagccacagcagccagattcgctgcagatgaaggagcaaaagttttattagttgatgctgctcctgaaggtaatgaaggtggtaacactcgttattctgctcaaatgatcagtgcaagtgatgactttgaagctgaaaagaaatatttcgcagctctaacagatccgatgacacttgaccaagaaatagcagatacttatgttgaaggtatggcaaatatggctaaatatttgaaggaacatttaggcgtggaaccttatcaatataagcgcgattattggaataatcctaaatttgcagcattgagaaaagctattattgataatacagtggaatatccagaatttgaaggtagcgaacaccatgatattttatcagttagtttgggattctttgatggtgctttgtggaagatgctaagacaaaatgtagttgatcgttcagataagattgacgtatggtttagttcaccagctcgtcatttaattcaagatcctgcaacaaaaactgtaataggggttcaaattgaacgtgatcatgtattgagaaatattaaagctaataatggtgtagttatggctactggtggtttcgaaaataacccagaaatgttagaagattacctgggtgcatctaagttagtaccattaggaaccttatacaataaaggcgatggaattaagatggcaactgaagtcggtgctagtttatggcacatgaataactatgaatctttaggaatgcttcatggactagcatttacggttccaactggtaaacgtggtaaattaattttgggagattggaaagctatttatgacggcagtgtcttccttgcaggagatgatggtacacgctattatcctgaagatatgactaatagacatggccatgtttatagccatggttattggaaagttccacaaaataatcatcatccacatattatttttgataaaaaacaatacgaaaaatttgcagataaagagacaagtatctacccacaagcactagatatggtgattgaagctaacacactagaagaattagctaaaaagataggtgctgtaccagaaaaattgcaagaacaagtggcagagtttaacttctttgcaactgaaggaaaggattatgcattccaccgtaatccagaaacgatgcaagcatttgatgctgagggtccatactatgccttatcagtatcacaaacagttttaaacacacaaggtgggccacgccgtaatgcacgtgctgaaattttgtccaatgatggtacacctattccacatctttatggagctggagaactcggtggaatttctgctggacgttatcaagctggagaaaacattgctgaatgcttaatttttggtaaaattgcaggcttaaatgcagctcgtgttaaagaagaagtttttgaacacacgacagaagaacctgacgctgtatcttcagcatctcaaactgaaaaaaaggtcaatttaggtagtgacttagatgttaaagaaacttatatggtgggtgctaaccaatatttaggaagaagtaatgctggtgtaggtaacgaagttgtagttagaattacagtagatgatgataaaaaattaaaagatattgagattttaaaacaaagtgaaactggaattggagcccaagcaattgagagtatgccaaaagaaatgatcagtaagaatacttacgacgttgatagcatttcgggagcatcagcaacaagtagagctttaaaagaagctgtaaaagatgcgatgaataaaatttaa

SEQ ID NO: 348 - DNA, 1008 bp, Lactobacillus salivarius
  isolated from gut, Lactobacillus salivarius
atgaaaaaaatacagaaagaatacagtttacttgaagaagcagtaaaggaactgcaaaaaaatctacaaacaacttatcttgatgcgttaattgaaactttagagaatatcttagataataatcaagttcatgtagaggatgataagcctgataaaaagacagtagcaaagttaaaagaattgtacgctgatagtaatataaagaacttagaagctgatgaaaaaagacaggttatacaattattaattttaaaatcttatagcgaagataagattcaggctaatcatcaaatgacaccagattcaataggaatgatagtatcttatctaatagagttatttgctgactctaaaaaagtattaacaattacagatatttgtgtaggtacagggaacttacttactgatatttataataatttagataagcaaaacaaaaatattcaagcttatggaatagataatgatgatacgctattagctttagcaagtataagcacgcaattccaaaagcaaaatattgaactatatcatcaggatgctatagaagagttgttaatccctaaaacggatttagtagttggagatttgccggttggatattatccaatagatgacaaagtgagtgactatatcaccaaaaataatgatggacattcatatgctcattatgtattaattgaaaaatctataaggcaattaaaagaagatggaataggaatatttattgtacctagagggatttttgaagtaaaagattcggttaaattgcttaaatatattcaaaaagttggttatttgcaaggattattaaacttaccaacagaattatttaatgataaacaatcgatgaaatcaattttagttgtacaaaagaagggaaataaggctaaacaggcagaagaagtattattgggcgatttccctagctttaaaaaacaagaggaatttaaaaaatttataaatgaaatagtaagttgggcaaagaaaaatatttattttaattag

SEQ ID NO: 349 - DNA, 789 bp, Lactobacillus salivarius
  isolated from gut, Lactobacillus salivarius
atgataaatgttttagttgctggattcaaaggaagtatgggaaataaaacaatccatatggtagcaaacaatgataaatttaaacttgcaggtgtttataatccagtagttactgaaaagaatgttaatgaagttgctgaatttgcagacttggatgtgcctgtatatacagattatgaacaaatcccagttaatgatattgatgtatggatagattttacaattccaagtgctgtttatcaaaatgttaagtttgcactagaaaataaaatttcagttgttgtgggtacaactggacttaaggatgaacaaattgttgaattaaaagaaattgctgcaaagaacggtattggtggattgattgcacctaactttggtatttcagcggttttattaatgcaatttgcaaaacaagctgcaaaatatatgcctgatgtagagattattgaaatgcaccatgataataagttggatgcaccaagtggtactgctattaatactgcaaaattaattgctgaagttcgtgaagaacatcaacaaggtaatccagaagaaactgaaagtttagatggagctagaggtgctaattatgaaggaatgcatattcattctgttagattacctggatatgtagctcatgaacaagttctctttggtagcaagggagaagctttaacaattagacaagattcatttgatagagaatcatttatgacaggtgtagctttagctgtagaaaaaattggtgattataataaattgatggtaggtttggagaacttattatga

SEQ ID NO: 350 - DNA, 1308 bp, Lactobacillus salivarius
  isolated from gut, Lactobacillus salivarius
atgaaaaacgagaaattcagaaaccctgaggcaattcttgacgttcaagataaaccaacttttcctcagtggttacttctatcagtccaacatttgtttacaatgtttggatcaactgttttagtacctttattaattggtatgaatccaagtatcgctttgtttagttcaggggtaggtactttggtatatattctgtgtacaagagctaagattccggcatacttaggatcaagttttgcctttatcatgacaatgcaggctttgatgaaatctgaaggatatcctgcagtaggtcaaggtgcaattgcagcaggtttagtttatgttattgtttccttgattataggaaagtttggttcacaatgggtagataaggttttaccaccagttgttgtaggtcctatcgttatagttattggattatcattagctacaactgcagctaacgatgcaatgttcaataataatcattatgatcttaaatactttggagtagcaattttcactttagttgcaacaattatctttaacatgtttttacgtggattttcaagtatgattccagtacttttaggtataattgtaggctacattttcgctgttttcatgggaattgttgatttatctggtgtagcagcagcaaaatggttctccttacctgcatttgacgtaatgtttgttaattatgactttaagtggtatccaggagcaattattggaatggcaccaattgcttttgttactatgactgaacatatgggacacgttatggttttgaataaattaactaagcgtaatttctttaagaatccgggactacaccgtacattgttaggtgacggtttatctagtgtaattgctggtttcgttggtggacctccaacaacatcttacggtgaaaatattggtgtgttagccatgacaaagattcatagtgtttgggtacttgcaggagctgctttcttcgctattttattcagtttttgtggtaagattgctgctttgattcaatctattccaactcctgtaattggtggtatttcattcctattattcggtatgattgctgcaaatggattacgaattttagttgataataaaataaactttgaagcgaaaagaaatttgattattacagctgttatcttggttgtcggaatcggtggtacttatttgaagttaggtaatttccaacttacaagtattgctctatcaacaatctttggaattgttttaaacttaattttaccaaagaaagcagctagtgaagctgaacatgagaaaaagataagaatggatatttaa

SEQ ID NO: 351 - DNA, 816 bp, Lactobacillus gasseri
  isolated from gut, Lactobacillus gasseri
atgccgcaaattgaaattagtgggttgcgttatacttatccagaacactcatttcaggtggaaattgatcggcaatcttttgacagtccactaaccgcaattgttggtcagaacggcgctggtaaatcaactttgttaaagttactgatcggattgataacaccgcaagaagggaccattatgattaatggcgtttcaatagatgagttgaaaccacaggcaaagttgaaacaaattggagtgacatttcaagatccagatgatcaattatttaacgcaacggttcaaaaagaagtggcttgggggctttctcaaattgaatcggatcaattgatgattaaaaaagcggctgatcaagctttggttacggttggattagctgataaagcagccgaaaatccatatgacctttcgttatctgaacgaaagttattaacgtttgcaacggttttggccattaatcctgcaatttatttgtttgacgagccgatgatgtcgttagactggcccagtcgaaagcgaatgactaacatttttcatcaacttgtaaaaagtggtcatcaggtgatcacgattactcatgatatggattgggtagcggctgaattttcgacagttcacgtgatggcgcatggtcagattgccttttccgggacaccttcagccttatttggtaattcaggactggttaagcgggtgggattgctgccaccaagaattatgacgataacgagtgcattaggtgatcactcggtttatttaaccccagaggattactgcaggaagcataaacaagttgttaacaatttaaattga

SEQ ID NO: 352 - DNA, 1647 bp, Lactobacillus salivarius
  isolated from gut, Lactobacillus salivarius
atgaatgataataatgaacaaataaaaaaagatttagaagaaacttcttctaaagaaaaaatgttgaagggctcagcttggatgacagctgggagtattttttctagaattctgggagcaatttatattattccatgggcaacttggtttggagttaattatttacaagcaaatgccttatttactaagggatatactgtttatgcattatttttgatgctgtctactgccggaattccatctgcagtgggtaaacaagttgcacattataattctctcaatgaatatggaatcggcaggcgattatttaagcgaagtttaggtgtaatgatgtttttaggaattatcagtgcaatgattttgtggtttatcgcaccattaatttctcaaggggatgcagcagttattcctgtatatcgttctttggcagttacattgcttttgattccggtaatgagtttaactagaggctttttccaaggatattttgatatggctccgttcgctatatcacaattagtagaacaagttgctagaatcgtttatatgttagcagcaacctatttaattactcaggtgttacatggaagttaccaaagcgcagtagttcaatcaacttttgcagcatttataggagctgttggtggcttattagttttattatggcattattggcgaaaacgaccaactatgaattatcttttagctcacagtaataataaactagaagtctctgataagagattaataaaggaaatattgtatcaatcgatacctttcatcattattggatcaactacaactttgtataatttatttgatcaatttagttttccaacaattatgagttttgttactgattatagtactaaagaaattaatgcattatatgctttatttgcgggaaatgccaataaattgataatgattactatttcagttgctgctgcgatggctgacactgcaattccattattgtctcaagctgttacaaaaaatgataatgaagaagtttcagctgctttattagattcggtagaattattcttttttgtaatgttaccttgttcttttggaatggctgcagtttctagaccactatatgttttattctatccatatgattatacaggtatctttgtattagccttttcatcatatatagctttagcattaggcttatttatggttttagcagcattacttcaaggaatatatgaaaatacaatagcaattaaatttgcggtaattggaatgattgttaaagttataatacaattcccattaacagcatttttacatgtatatggtcctttagcagctacaggtataggaatgaccgtaagtaatgtattaatttttagatacttgtatttcaaatataatttaaatattaataaattacagaaaaatactaatatgatgatgttattcagcttatttatgtttattgtagtactcgttatatcttttgctttagggaaagtaacaaatacatatagcaaattccaatccaccattgtgttaataattggagccggaattggaggatatatttatgctttcttaagtttgaaggcaagactagctgatgatattttaggtgctagagctaactttttaagaagaatattaagaattaaatag

SEQ ID NO: 353 - DNA, 804 bp, Lactobacillus salivarius
  isolated from gut, Lactobacillus salivarius
atgggaaaagcaatagttattacctctggtaagggtggtgttggaaagactactacaactgctaatttaggaacagcacttgctttactaggaaaaagggtatgtttggttgatttagatataggcctaagaaatttagatgttatattaggattggataaccgcattatttataatattgttgatgttgctcaaggaacagcaaaattacatcaagctttaattaaagataagcgatttgatgataagctctatttattgccggctgctcaaaacactgataaatctgctttagagccagaagaagttaaagcaattgtagaagaattaaagccagatttcgactatattttattagattgtccagctggaattgaacaaggctttatgaatgctgttgctggagcagatgaagcaattgttgtttctacacctgaaatttcttcagttagagatgctgatagagttgttggattacttgaacaaaaagaacttacagaaccaccaatgttagttattagtcgtattcgtcgtcatatgatgaatgatggagatatgatggatgttgatgaaattacacatcatttatcaattaaattaattggaattgtttttgatgatgatgaggttatttcatactctaacaaaggtgagccaattgtattgaatgaaaaaaatccagcttcacaaggatatcgtaatattgcccgccgtctagaaggcgaaacagtgcctttaatgacaattagagaaacagaaaaaggcggctttatgaaaaaattcatcagttggtttaaaaaataa

SEQ ID NO: 354 - DNA, 1023 bp, Lactobacillus salivarius
  isolated from gut, Lactobacillus salivarius
atgactatatttaaaaaacgtgcattttggcttgctgctcttcttacttttatttgttctgtcctaggtagttttttagcaaaacttccttaccttagtttaattggagctttagttctttcattattgttaggaattgcattccaatcatttcctcaaactattaataaagcttcctctggaataggttttatttctaataaatttctccgtttagggattatcctattaggattcaaacttaatctcataactttagctaatgcaggaataaaaaccattattctttcaattattgtcgtaagtggtatgattactctcacttattacctctgtaaaaaattgggtgctgaatctgaattggctatcctaactgcgtgtggttgtggaatttgtggtgcagctgctgtaatgggtgtttcccctcaaatagaaactactaatgaagaaagaaaacgtgaaaatgaagttttagctgttgcagttgtctgcgtaatgggtaccgtatttactttgattgaaatttttctaaaaccatttatcggattagatgccagccaatttggtattatggcgggtggatcacttcatgaaattgctcatgctgtagctactggtggtgctggcggtgcaatcagtcttcaaaatgcaattattatgaaattatcccgtgtcctacttcttgctcctgtagcacttctagtaggtctttggtatcgtaaaaaaatggctgcaaatacccttaatactaaaactactaattctaaattacctatcccttggtttttaggtggtttcatcttaactagcattatcggtacatttgttccattcatcgcaccttatctcgatagccttgttcaaatcgcttatctctttttaggtatggctatggctgcattaggcatgtctgtaaactttaaagttatcttcaagcgtggtaaaagtgtattttcagctgctgcaattagctctactgttttattaatttttatgataattgccgctaaagccttattttaa

SEQ ID NO: 355 - DNA, 657 bp, Lactobacillus salivarius
  isolated from gut, Lactobacillus salivarius
atgaatagaaaatttttaggacagttaaagattgtgcatcaagattttattgaaatgggattagaagctgcagaagcaataaagttagcaacagaagctttcgaaaatcacgacttaggattggctgataaagttatagaacatgatgaggtaattaacaatttagaaataaaattggaaaaaaagactagtcagttaattgctttgcagcaacctgttgcgacaaatttaagaaaagtaatagcaattttaaaagctagttctgatgtagaaagaattggagatcatgcggtagatgttgccaaggcagtaagaaatattaatgttaaaagaagaaatgttgaaattgaatctttaataagagaagttagtgaacagacgcaagaaaatttagtaaagatagtaagtatgtttgctaagtttgatgaaaaaggcgccgttgagattgctaaaaagaatcaggaaaagagagaaaaaattaatgagatcaggaaactatcaattaatgcaataaaagaagatgcaaactttgcagaagaaggtatagattatttaagcattattgcacatattaaaaggataaatgattatataacaaacttagcagagtggatagtttatgaggaagaaggaaaaattacagaattaacgttctaa

SEQ ID NO: 356 - DNA, 1488 bp, Lactobacillus salivarius
  isolated from gut, Lactobacillus salivarius
atggatgataaattactattagatacatttataaagcaagtaattgaacaaggaaattatacagaacttgatagaaattacttatataatcggattttgaatttggtaggagaaggtgttgaaaaactaacaactactaaaaatgaaattattgatttaaaaaacgagctagttgaatatgctgtccaacatggtaaagttggtgaaactttgaatgaacaagattgtttaggtgcagagttgatgaatttcattactcctttaccaagtaaagttaatcaagatttttggcaaacctatcaacaaaagtcgccagaagaagctattcaaaatttttatgatttaagtaaacgaaatgattatattaaaacgaaagctattgccaaaaacatttattttccagttgaaacatcatatggacaattagagataacaattaatttatcgaaacctgaaaaggatccaaagcagattgctttagctaaaaagatgaaggcaagtggataccctctatgtcaactttgcatggaaaatgaaggttatcaaggaagaattaattatcctgcaagagcaaatcatagaattattcgtttcaatttagatgatgaacaatggggattccaatattcgccatatgcttattttaatgaacattgtattttcttagatacaattcatgaaccaatggaaattaccaagcaaacattcaataatttgttaggtattattgagcaatttccaggatattttgtaggaagcaatgctgatctaccaattgtaggtggttctatattaacgcatgaacattatcaaggtggacggcatacttttgcaatggaaaaagcaccaatcgaaacagaattaaaatttgcaggttatgaagatatacaagcaggaattgttaagtggccaatgtcagttattcgtttacgtggaaattcaaaagaagatttagtagatctagctgataaaattctaaaaacttggcgtggatattctgatgaagaagtttctgttttagctgaatccaatggtgaaaaacatcatacgattacgccaattgctcgcaaacgagatggacagttagaattagatttggtattgcgtgataatcaaacttcagaacaatatccagatggtatctaccatcctcatccagatgttcaacatattaagaaagaaaatattgggctaattgaagtaatgggattagcaattttacctcctcgtttgaaagatgaacttcaagaggttgagaaatacttattaggtcaagaaaataaaatggaagaatatcatcaagtgtgggctgatgatattaaacaaaaatattcagatataggtcaagataatgttggtacaattattcaacaagaattaggtcgagtatttgctagagtgttagaagatgctggtgtttataagcatgatgaaactggcagaatggcatttaagcgttttgtagaggaagtaggaattgtggattaa

SEQ ID NO: 357 - DNA, 444 bp, Lactobacillus salivarius
  isolated from gut, Lactobacillus salivarius
atgaataatcaagaacaattaatgatggctgcagaaaaattaaagaagcgtcatattaagaatactccacaaagacaagtaattttagcatacttaatgtcatctaaggagcatccttcaattgaaatgatctattcatatgttaaggaaaatggctttagcgtaagtttggcaactgtttataatacattagagttatttatggacagaaagttaattattgaagtaacgccagacaacgaaggacatatgcgatatgattattttgcagaaccacactatcacgttatttgtgtaaactgtaataaaattatcgatgtacctaatgatgaatatgtaaaattagaaaaagatgcggctgagaaaacaggctttaaagtctttaatagtcaatatgaggtctatggattatgtccagaatgccaagctaagatagctgattag

SEQ ID NO: 358 - DNA, 1527 bp, Lactobacillus salivarius
  isolated from gut, Lactobacillus salivarius
atgaatattattaaaaagattgataattggggaactacctctcccaataaaatcgcctatgactatctaggcactacaaatacttatgctgatttaaaaaattattctgataaattagctacatatttaaatcagttaaacttagatactaaaaatccaattatggtttttggtggacaagactttaatatgattgctacatttttaggaattgttaaagctggttatgcttatattcctgttgatacacattcaccagtagaaagactaaatgttattaatgacatcgctaaaccagctgcatgtattgctgttgaagaacttcctgaaggttttaacggccttgaaagtttacctattgtagatcaagctaagttaaaagatattttttcaaatggcgacgtagtaataaatgaagaaaaatatgttagtggagatgataatttctatattatctttacatctggaacaactggtgtacctaagggtgtacaaattagtcatgataatttgttaagtttcttaggttggatggaaaaagactttggaattaaagaagatgtaaactgcatttctcaacctccatattcctttgatttatcagtaatggacttatatccaactcttactagaggtggaaaattatcagttcttcctaaagaaacaaccgataattttaaagaattatttgctactttaccaaagctgcatgctaatgaatgggtttcaacaccttctttcatggatctatgcttgttaaatccagcatttaatgaagaaaatttaccagaattaacacattttctattctgtggtgaagaattaacccatcaaacagcgcaaaacttgcatactcgttttcctaatggacatatctttaatacttacggtccaactgaaacgacagtcgctgttacacaagttgagataacagaacaagttttaaatgattatccacgtttaccaattggtataacaaaagatgatacaaagattgtattgctagatgataacttaaaagaagttgctgcaggagaagctggagaaattgttattttaggaccaagtgtatctaaaggatatatcaataatcctgaaaaaactcaagcagcgtttattgatttccaaggtcaaaaagcttatcgtactggagatttagggcaatttgatgagaatggtcaattgttatacaagggtcgtatcgatttccaagttaaattacatggattccgtatcgaacttgaagatgttgatcatcatctcgatagagttagcttggtatctcaagcaacaactgttccaaaatacgataagaatcataaagttcaacaattgattgcctatgttgtagctaaggaaaatgattttgaagatgaatttaaattaactcaagcaatcaaaaaagaattaagtgaaactatgatgagctatatgatgcctcaaagatttatctatgtagattcattgccattaacaaataatggtaaaattgatcgtaaatctttaatgaaagaggtcaataaataa

SEQ ID NO: 359 - DNA, 1182 bp, Lactobacillus salivarius
  isolated from gut, Lactobacillus salivarius
ttgaaaaaagaaatatctttattcgctgtattgctaggctctttttgtactagctttgaaatgagttttatttggccattaacaagtgtttatttgcacgataatttacatatttcactagcactggtgggcttagtgttattttttaattctttggctagtgtaattggaaatatatttggtggattaggatttgataaattgaatccatattatttattgttattaggcggaggagttacaaccttatccctagttgttttagtatttttccaccaggctttaccgttttctatctgtctattctttttaggattaagtgcaggatggaatggaactttaataagtgcattaggtgcgatattgaagaaatatgacggtaattatgtgtttaatatgatttattttatccaaaaccttggaattgttatcggatcttcaactgtagggttcttgtatggttggaatataaagttgccatttatagctgctatgctaattagttttggctttttgttagttgtaatgataggatttcgtgcattgaagtacgaaaatatacatggtagtactcataaacatagtaaagttaaggttgttttaccaaaaataaacatgtatttaatctatagtttgtttgcgatgttgttggtgacttggacaatgtatcaacaatggggaagtaatgtttcagtatatattacaagtttagggataccatttcgttattatagtgttttatggactatcaatgcaggattaatattagtaattcaaatttttattgttagattaagacatttaataaagaataattatattccaatttattttggtatatttacttttgcattatcttttgtagttttattttttgctaaacaatattatttatttgtcgtagcaatgatattactaacatttggggaagctttagcctttcctcaagttccagttatcattaatcaactgacaccaaatgaagttaagggtaaatatcttgggttagttaattcatttggcagtgctggaagagcaattgcccctttatttggcggattggttattgaaggttttggatatagaaatctatttttaattgctataattttcaatttagcaatattaataatagtgtatttagttagattgagagtcggaaataatgtaaaaagttattaa

SEQ ID NO: 360 - DNA, 795 bp, Lactobacillus salivarius
  isolated from gut, Lactobacillus salivarius
atgcttgatatatcaacaattatgagaaaatatgggttcaatgaatcagaaataaaagtttatctcaccttaattaatcatgagcagatgacagggtatgaagttagcaaattatctggtgtggctcgttcaaaagtttacaatgtcttagaaaatttaatacaaaagaatatggttttagtaaatcaaacagaaaataagatgtaccgtgcaattcctacagatgaatttttagcaagacttgagcatatttttaagaatgacttaaaaaatctgaagcaaggttttaaagagattaaagaacctaaacgagatgctggacacctttggaagattaatgattacacaagtatgattgaaaaaataaaatatgttatcagtaacgcaaaagaaagtatatatattcaaatatggacttctgatattgatgatgagctggttaatttaataaaattggcagaaaaacgacttactaaagtagttattattttgttcaaagatagtgaagataattttgattttaaaaatgtgtattaccatggttttgaaaaggataagttatcagatttcggttctcgttggattaatgttgttgcagataacaagcaagtagtgtacggcactattaatcatcatacaacaaatgtaatttggacagaaaatacagctatgataagtttagcttcagaatatgtaaaacatgatgcgtatactttgaagatttttagagatttaccggaagatctaaagaaagagtatggtgtggattttgaaggagtaagggaaatttattga

SEQ ID NO: 361 - DNA, 2586 bp, Lactobacillus salivarius
  isolated from gut, Lactobacillus salivarius
atgagtaagaaaattttatggaaagatgcatttcaagctattactagctcactgggtagatttatcgctatttttctattaatgatgctaggctcgtttacattaatagggctaaaaattactgggccagatatgagagaaactgcgactagtttttaccaacaacacaaattagcagatacaactgtggtatctaattacggcttggatgctaatgatgttcatgtaataaaagagtattcaaaaatcaaaaactatgatttaggttattttcaagatactaaggtaaatgatgggcaaacggtagttagagtattttctaatccaaagaatatttcaacctatgagttggtaagtggtaagatgccgcataaaagtaacgaaattgcgcttagttatttattaaaaggaaaatataaaattggacaaacaattaatttagataaaaatacaagtttaaagcatgaaaaatttagaataacagggtttgttcgttcaagtgaatatttagataaaaatgatctcggccaaactaatgtaggtacagggcaattaaatggagtagcagttgttgcgaaaaaagcatttaagaccaaagtatatacaattgcaagaattagatataaaaatactgcaaacatgaatccctattctgcgcaatatagaaatactgttgagaagtatcagaaaacaataaaagataggctagataagaatagtcagaataaattaaataaatatcaaaatgaaattaagcaggctagaaaccagataatgcagggaaaagaacagataaatcaggtgaaattattttcttcggcacaagctagtcaacttgaaaaagaaattagccaaaagggaatagaattaaataaagaagaacaaaatataaaacaactaggttatccaacttataacgtgcatagtcgtgattataacccaggttatactttgtatcgatctaattctgaaagaatagatattctagctaatattttccctgtgattctattcgcaattgcggcactagtttgtctgactacaatgacaagatttgtagacgaagaaagaataaacataggaacgttaaaggcattgggatacagtgatggtgatgttagaaagaaatttgtcttatatagcttggtttcaggaatccttggaatcttattaggcgcaactttaggatatacttttctgccaagattgatttacaaagcttatactactaatttaacgatgcctgaagttaagttacaattttcatggatatatttattagtaacattggctattggactattatgtacaactttcgcggctttgtgggctttgagaagaacgttaaatgaaaaaccagcgcaattactattaccaaaggtaccaaaaaagggcgcacggattttactagaaagaattacgccactttggaatcgaatgagttttacttataaagtaacagcacggaatcttttccgttataaaagtagaatgttgatgacgatttttggagtagccggatgtacagggctattagtaatgggatttggtataaaagactcgttgaatggaattagtgagatacagtataaaaatatcattaagtatgatttagtaactgtacagcaaaataatttgaccaagaaacaacaaaataagctagatgaagtattaaatagtgatgaaattaagcagtataaagatgtacattatgaacaactaacgaaaaaagctggagtagatgatacagaacaaatgataagtctacttgtaccaagttcgaataaaaatttgggaaagtttattggattgcatgagcgcaagactaataaagagctaaaattaacagctaatagtgtaattatctctgaaaaactagcagatctattaggcgcaaaaaagaatagtacaattactttaaaagatgatgaaggaaaatggcgtaagtttaaagtaacagacattacagagatgtatatgggacattatatgtttgtgggaaagcatgcatatcaaagaagtatggacaaaaaatatgcgactaatggggagttagtaacacttagaaataaaagtaataaaaatgttcaaacgatgtctgaaagatttataaagacgaatgcgattagtgtggtctcacaaaatataaataataaaaagacaattgacaatgttatgaatggattgggtagagtaatctttattttaattggaatagcagtgattttagctgtggtggtaatttataatttgactaacatcaacgtgtcagaaagaataagagaactatcgacaattaaggtgttgggattctatgataaggaagttacaatgtatatttatcgagaaacgataattttatcgttcatagggattttatttgggtatctgcttggaaaatggttgcataactttataattacgagtttaccaccaacgaatgcgatgtttgatcctaatatgtatgcgatgaattacattttatcaggggcaattccactgattgtaacgctaattctggcctttgtaatgcataggaagatacgttcagtagatatgttagaagctctaaaatcagttgattag

SEQ ID NO: 362 - DNA, 1500 bp, Lactobacillus salivarius
  isolated from gut, Lactobacillus salivarius
atgaaaatttttaagaagatattaatgcttttagctgtactcatgatggtagttacaccatttgctgcgattactgctgatacaacttctagcagttcttccgctgatacagctaagacaacagatgattcattgaaaaaggtaaaagaaaagggaacattggtagttggtttaagtgccgattatccaccttacgaatttactactaagcaagatggcaagactgaatatgtcggaattgatattcaaattgctaagaaatttgctaaagatttaggcgttaagttagttattaagaatatgaacttcgattccttactagttgcgcttgaaacaggtaagatcgatacaatcatttctgcgatgaacccaactgaagaacgtcgtaagagtgttgatttctctaacatttactactctggtggtaagtacattgttatcaacaagaaagataagagtaaatacacatctaaggaaagttttaaaggtcaaacagttggtgctcaaaatggtactttggaatacaatttgattaagcaacaattccctggagcaacagttaaagggttagctaagttaaacaacttaatcattgctttacaatctggtaaggtatctggggtattgatggaagaaccaacagctaaggcttacgtacaaaataatcctaacttatatgcattcaactctaaagtaagtgttgacgttaacgaaacaggggctgcaatggcatttcctaaaggagcaacagctttaactcaagctgctaacaagacaattgctgatattaagaaacaagatttattagacaaagaatacgttccagaagctgctaagtatatgaagcaatctagcaagcacaacacaatggctagttactggacatacttcgcaaaaggtattgaatatacattaattatcacagttgtatctgtattaattggttttgttttaggtatcattcttgctttgatgcgtttaggtcacaacaagtttctacacggtttagcagttgcatacattgaatttattcgtggtactccattaatggtacaagtaatgtttgtatatttcggaattggtgcagttattcaatcattacctgctttggcagctggtattatcgctgtatctctaaactccggtgcttatgtcgctgaagttattcgttcgggtattgaatcaatcgcaattggtcaaactgaagctgcaagaagtttaggtatgagtcaaaagcaaacataccaatatgttgttattccacaagcaattaagaatatttggccagctttaggtaatgaatttattaccttgattaaggaaagttcaattgtatcggttatcggtgtaggtgacttgatgtatcaaacacaattagttcaatctgctacttataaaggtgtagctccattggctatcacaatggtaatctactttgtactaacctttacattatctaaaggcttgaattactttgaagggaagatgaaacatgagtaa

SEQ ID NO: 363 - DNA, 726 bp, Lactobacillus salivarius
  isolated from gut, Lactobacillus salivarius
atgaaaataaataaccagagaatacaattacaaaatataaagaagaaatttggaaatgataatgtcttaaattctgttaatttaacagtaaattcaggagaaatagtaggtttgattggtccgtctggctcagggaaatcaacaactatcaaaattctattgggtatggaaaaagctgacgaaggtgaggctttaattttagaaaagagaatgcccaatcgaaaattattagcagatattggttatatggctcaatcagatgcgctttatgaatcaatgacagctagggagaatttaagtttttttggttatatgaaagacgttgcgaagagagaattgcaaaaagaaatagaatatgttgctgaagttgttgatttaacgaattatttggataagaaggtttcaggatattctggtgggatgaaacgaagattgtcactagcaatagctttactagcaaaacctaaaataattattttagatgaaccaacagttggaattgatcctgctctgagacttaaaatatggagagaattagctaaattaagagatgaaggaagaagtattcttgtaacaacacatgttatgtctgaagctgagctgacagatagggtagcacttctttttgagggaaaaatcatagcctttgataaacctaagaaattagaagatgaatataaagttaataatattgaagaagtatttttgaaagtcgagggtgagtag

SEQ ID NO: 364 - DNA, 858 bp, Lactobacillus salivarius
  isolated from gut, Lactobacillus salivarius
gtgtttggtaaacgaaaagattctaaaaataaagccatgagagataatgaagaacttacaccttgggaaagacagcaattgttacgagaagaaaatatagagaaaaaacaaaagaaatctaaaaaagtcttgataagtagcaatttagttaaatttaatggtcttagaaagaaaagacttcaaaagcgagtaataactctagcatcaatttttggaattagtgcagtaatatctttatacgcaatccttccagttagtagagtgagtaatatagagatagaaggcacagatagccaaacaaaaactgctattatagaggctagtcaagtgaaaaagaacgaatctttattcgcggttgtacctactaaatttttgattagtcaacgtataaaaaatgatgtagcaactgttaaagatgttaatatctctttgaaaaaaaacgtcgttaaatttaaagttactgaatatgatgttgtcggatatattcaaagaaagaataattattacaagttaacttcaaatggacgtgaattggatgtaggtcaaaaggcaaccaatggaaattacccattatttcttgatttcaaaaagaaaactttattacatgaagcagcacaacaagtaggggagatgcctaaaaaagtaagatttggaatttctgaaatacattctaacccaacaaaggtaaaccctaaacgtgtgagattagtaatgaatgatggaaatgaagtaataggaagtatagatactttagcaacaaaaatgagttattatccaagcatggctaaagctctaggtaaaaaaggtgtgattgatctagaagtgggtgcatatgcttatccttatgataataagtaa

SEQ ID NO: 365 - DNA, 867 bp, Unknownn
  isolated from gut, unidentified
atgcggaaaattgagagagaagtagaactaaaatggcgacgagctactataaaaaatgacttgatttttacctggctattttttgaaaataagaaattaactttaaggttactgcaaattattttaccagagttaaatattaagaaagttggtgatactcagcgagaaaacaaccaaaagaagaataagatttatcgtggggtcagatttgacgtccttgcagaagatgagcaaggcaggacttatgacattgagatgcaggtcgctaataacgatgatttgggtaaaagaatttcttattatcaaggaaaattatcggctaaatctttaaatgaaggtgagaaatttttcgagaaaagggatacctatgtgatttttatctgcgactttgactattttggcttgaatttgcctatgtaccatacaacaactagattagaagaagacataaacaaagtagttgacactggggaatacaatgttattctaaactcaagagcaacagatttttcgacagtaagtaccgaagtgaaggcatttttaaagtatgtgcgtgacaataaggttgctgatgattttacaaagagtttagataaagaagtcgttaagataaagtcaagtacggaagtgagggaaagctttatgacgtgggaagaaaaattagcagaagtagagtattacgcaggcaaaagagccgaagaaaagggaagagaagaagcaaaacgagaaatgataaccaatgctattaagaatcaagaaaaattaggaaatagccgacaagatatcattgacagtgttgcaactttcctaggtattgataaatcggacgttgaaaaatactatgatgaattgctaattaaaaagtga

SEQ ID NO: 366 - DNA, 1029 bp, Lactobacillus salivarius
  isolated from gut, Lactobacillus salivarius
atgcgcgaggaagtagagttgattgagtcaatcgttccagatttaattgatgttctaaggaaaagattcattatcttaagaaatattgattggtctgaaccagttggcagaagagtattagcacaaaccttgggcatgagtgaacgagttttacggactgaaacagattatttgaggaagcaagaattaattgtttcaacaaagtctggtatgattttgactgctaaaggtaaaagaacaatacaaggcctttccaagttgatggactctttattagggttacaacaaatggagaaagaattatctcgatacctaggtataagaaactgtttaattgtttcgggagatagtgatagacagcctttgattattgaggacatgggcaagttagtaaatgatatcctaggtaaggaattgcctaagggtaaaaatgtcattgctgcaatgggtggtactacgatggccaaagttgctacctgtttgacttccgaaattgcagtagatagagatttgactttcgtgcctgcccgtggtggtataggcgaaaggttagatattcaggcgaataatgtatgtggcttaatggctaaaaaaactggtggtaatcacaggacattatatgtgcctgaacaggttagcgaagatacttatcgtccgcttcttaatgaacccgtagtacaagaagttgtgaatttaattagacagagtaatgctgctgttcatagtataggtgaagcaattagtatggcagagagacgttcgatgcctaaaaatgtggtagcaatgctaaaagagcgtaaggctgtgtctgagacttttggttatttctttgacgataaggggaaagttgtttacaagattcctagaattggattgcaacttgaagatctcgcgaatatggattgtataatcgctgttgctggtggtagttctaaggcacgagcaatagcagcatacatgaagaacgctcctgagaaaacatacttgattactgacgaaggagctgctaagatgattttaaaagggtag

SEQ ID NO: 367 - DNA, 1233 bp, Lactobacillus salivarius
  isolated from gut, Lactobacillus salivarius
atgccttgtaaccaaattacttataataatgggggaattaaattgacagaaaaacacctttttacttctgaatcagtatcagaaggtcatccagataaaattgcagatcaaataagtgattcaattttagatgcaatgttagaacaagatcctgaggcaagggtcgctgttgagactacagtaactacaggattagtagtagtagtgggtgaagtttctacaacagcacatattgatatacaaaaagttgttagagaaactataaaagaaattggatacaagaatggtaaatatgggtttgatggtgataattgtgccgtcataacagctatagatgaacaatctccagatattgctttaggagttgataattctcttgaagtaaaaaatggagatgtagatccacttgaccaaattggtgcaggtgatcaaggaatgatgtttggatatgctataaatgaaacaccagaattgatgccattgccaatctcacttagtcatcacttaatgaaaaaagtagctgaagttagaaaaaatggaactttagcctatttaggacctgatgctaaagcacaagtgacagttgaatatgatgacaataatcaaccgttaagaatagatacagttgttttatctacacaacatgatgaaaatatttcactagatcaaattagaaaagatgtaatggatcaagttatcactaaagtaatacctgataaatatttagattcaaatacaaaatattttattaatccaactggtcgttttgtaataggtggaccacaaggtgatgctggtttaactggtagaaaaattattgttgatacttatggtggatatgctcatcatggtggtggggcattctctggtaaagatgctacgaaggtagatagatcagcaagctatgcagcaagatatattgctaaaaatattgtagctgcaggattagcatctcaagttgaggttcaaatatcttatgcaataggggtagctcaaccagtttcagtttccgttaatacatttggtagcggaaaagtttcaaatcaaaagttagttgatgcaattagaaaagtttttgatttaagacctgctggaatcatcaaaatgttagatttacgtagacctatctataagaaaactgcagcatatggacattttggtagaacagatattgatttaccatgggaaaaaactgataagataaatgaattgaagaaagagttagatttctaa

SEQ ID NO: 368 - DNA, 996 bp, Lactobacillus salivarius
  isolated from gut, Lactobacillus salivarius
atgaagaaaattatcaataatccagcagatgttgttccagaaatggttaatggaatggttcgtttatatccacaatatattgaaaagattgatggtactgaagtaatggtgcgtagtgacaaagaatctatgcaaggtaaagtaggtattgtcagtggtggtggtagtggacatgaaccatcacatgcaggatttgtaggtaaaggtatgttaagtgcagcagttgcagggcaagtatttacctctccaacacctgatcaaatatacgaggcaatcaaggctgttgatagtggcaaaggtgtatttttagttattaaaaattattctggcgatgtaatgaacttcgatatggctaaagatatggcagaaatggatgatattgaagttaaatcaattattgttaatgatgatattgccgtagaagatagtttgtatacacaaggtcgccgtggtgtagctggaactgtattaatgcataaaatcttaggtgctgcagcagatcaaggtgcaagtttagatgaaatcgaagaattggctaagaaagtattacctaacttgaagactattggggtagctttatcagcagcaactgttccagaagttgggaaaccaggatttgaattagctgaagacgaaattgaatatggtgtaggaattcatagtgaacctggctatagaagagaaaaaattaagccatccaaagaattggtagcagaattaattgaaaaacttgatgaagaacttcatttagataaggataagaaatatgctgttttaattaatggtatgggtgcaactccattaatggaacaatatgtatttggcaacgatgtgctagatgcattggaagcaaaaggtgttaaaccagtatttacgaaagctggtaattatatgacatcaattgaaatggctggtatttctttaacaatatttgaattagctgaagataagtggctagaatatttaaattatccagtagaaacaattgcatggtaa

SEQ ID NO: 369 - DNA, 999 bp, Lactobacillus salivarius
  isolated from gut, Lactobacillus salivarius
atggctactattaaagatatcgccaaacttgcaggcgtttcaccagcaaccgtctctcgtgttttaaattatgatgaatcgttatctgttggtgatgagactaaaagaagaatttttaaaactgctgaaaagttaaattattctaaacataaaaaaaagaataaagaagaacatttaaataagatagcaattgtgcaatggtatactgaagctcaagaattaacagacttgtactactattcaattcgtctaggaatcgaaaaaagagctcaagaattgggatatgaagttgttcgtattttccacgatgatcctttagatgcaatccaaaatgtcgatggaatcattgcaattggaaaatatagtactaatgaaatacaacaacttgataatctaaatgctaatttaatctttgttgatagtgattccttaagcaatggctttagttgtgtcgtaactgatttccaaaattccgttatcactgttttagatcacttcttagaaaaaggtcaaaaaaacatcggattattagcaggtgaggaacatacttcggataattctcaaactttgattgatttacgttttactatatttaaagattatcttagtcgtttaaatctttacaaccatcaaaacgtatatgttggaagtttcaatcctgaatctgggtacaaaatgatgaaaaaagctatcgtagaactaggcgataacctcccagaagcattttttgctgccaatgatgctattgctatcggcgcagtcagagcacttcaagaagaaaaaatttctattcctgaccgagtaagtatcatttcttttaacgatacctctattactaagtatgtttacccatcattaagtagtattaaagtattcactgaagaaatgggcgttgaagccgttaacttactattggattacattgctcatccatttaacgttgcaaaaaaagttaccttaggaacaaaattggttcttagagatagcactatcaattaa

SEQ ID NO: 370 - DNA, 2844 bp, Lactobacillus salivarius
  isolated from gut, Lactobacillus salivarius
gtgtataatttggctcaaaataaaataaaaattcgcggagcaagggcacataatttaaaaaatatagatgtcgatatacctaaagataagttggtagtagttactggtttatctggctcaggtaaaagttcattagcgtttgatactttatatgctgaaggacaacgaagatatgtagagagtctctcagcatatgcacgtcaattcttgggacaaatggataaaccggatgttgattcgattgatggattatctccagcaatttcaattgatcaaaagacaacttccaaaaacccaagatcgacagtaggaacagttactgaaatcaatgattttttacgattattatgggcaagagtcggaacacctatttgtcctaatgatggtcatgaaataacaagtcaatctccagaacaaatggtagataagatattagaattgccagaaagaactaaattacaaattctagctccaattgtacgagggaaaaaagggcaacataagaaaattattgaaaaagtaaaaaaagatggatttgtacgcattattgttgatggtgaaatccatgatgttgaagaagaaatagagttagataaaaataaaaagcatgatataagtgttgtagtagatcgaattgtattgaaagatggtattcgatcaagattgtttgattcactagaagccgctttaagattaactaacggcaatgttgcagttgatgtaattggtgataagatgctgcaattttctgagaatttctcatgtccgtattgtggttttaccattggagaattagaaccacgtatattttcttttaacgcaccatttggagcatgtcctgattgtgatggtataggtgtgaaattagaagtagataaagatttggtaataccagacgatacaaaaactttaaatgaaggtgcacttgcaccatggaatcctatcagttctaagtactacccaacgatgttgcaacaagcatgtgaggcatttggtattgatatggatactccatttaaagatttaccagacaaagataaaaaaattatattgtatggagctggagatagagaatttcattttaaatttgaaagtgacttcggtggtttgaaggatattgatacaacatttgaaggtgttattccaaatgttgaaagacgttatagagaaacaaatagtgattttacaagagatgttatgcgtcaatatatgactagtttaacttgtcaaacatgtcatggatatcgtttaaatgaacaagcattatctgtaaaaatagcaggtaaacatattggtgaagtgtcagattttcctattaatgaaagcttgaatttctttgaaaatctaacatttagtgaacaaaatcaagagattgccagaccgattctaaaagaaattgatgataggttaacatttttaaagaatgtaggtttagattacttaacacttagtcgttcggcacgtacactatcaggtggagaagctcaaagaattcgtttagctacacaaattggatcaaatttatcgggtgtaatgtatgttttagatgaaccatcaattggtctccatcaaagagataatgatagattgattgcttcattgaaaaaaatgcgtgatttaggtaatacactaattgttgtagaacacgatgaagatactatgagagcagcagattatttaattgatattggtccaggcgctggcgagaatggtggacaagttatagctgctggaacttcaaagcaggtcgaaaaaaagcgtaattctttaactggacaatatttgtcaggtaagaagtatattgcaattccaagtgaacgacgaaaagggaatggaaagaagatagtagttaagggtgcttcggagaataatttgaaaaatatagatgttggtttcccactaggtgaatttatagccgttaccggtgtatctggttcaggaaaatcaacattggtaaatatgattttaaagcgtgccttggctcaaaaacttaatcataattctgaaaaaccagggaaatatcaaaaaattgaaggtgttgaaaacatcgaaaaaattattgatatagatcaaacgccaattggacgtactcctagaagtaatccggctacatataccggtgtattcgatgatattagaggactatttgctcaaaccaatcaggctaaactgagagggtatggcaaaggaagatttagctttaatattaagggtggaagatgtgaggcatgtaaaggcgatgggattataaagattgaaatgaactttttaccagatgtttatgttccttgtgaagtgtgtcatggtacacgctataattctgaaaccttagaagtagagtataaagataaaaatattgctgatattttaaatatgactgtatctgaagctttaacattttttgaaccaattcctaaaattaaacggaaactacaaacgattgtagatgttggtttaggttatgtaaaattaggacaaccagcaacaactttatctggtggtgaagcacaaagaatgaaattagcttcagaacttcataaaaagtctaatggaaaaactttttatattttagatgaacctacaacggggttacattcagaagatattaagagactattagaagttctgcaaagattagttgataagggaaatactgttcttgtaattgagcataatttagatgttataaagactgcagattatttaattgatctaggtcctgaaggtggagatggtggcggtcaaatagtagctaccggaacaccagaagaagtcataaaagttaatgatagctatactggtaagtatttaaaagaagtgctagtacctgatcattatgcatag

SEQ ID NO: 371 - DNA, 2418 bp, Lactobacillus salivarius
  isolated from gut, Lactobacillus salivarius
atgtcatataagcatattgaaatagaaaaaaagtggcaaagatattgggaagaacacaaaacattcaaaacaactgaagatgatgataaaaagaattattatgccttagatatgtttccatatccatctgggcaaggacttcatgtaggtcatcctgaagggtatacagctacagatataatggctcgtatgaagagaatgcaaggatataatgttttacacccaatgggatgggatgcattcggtttacctgctgaacaatatgcgttgaatacaggaaactcaccacgtgaatttactaaaaaaaatgttaataattttagacgtcaaattaaatctttaggtttatcatatgattgggatcgagaggttaacacgacagatcctgcatattataaatggactcaatggatttttgaacaattatataaaaaagggttagcctatgaagctgaagttccagttaactggagtccagatttaggaaccgttgtagctaacgaagaagttattgatggtaaaactgaacgtggtggttttcctgttattagaaagccaatgcgtcaatgggtattaaaaattacagcttatgctgatcgcttaatagatgatttagatgatttagattggccagaagcaattaaagaacaacaacgtaattggattggtcgttcagttggtgcagcaataaactttcctgtttcaggagatgaaaatacaaagattgaggtattttctactcgtccagatacaatatttggtgttgcagctttagtattggcacctgaacatgaattggttaagcaattaacaactcctgaacatgaaaatgaggtagaagcatacatagaaaaaatatctcataaatcagatttagaaagaacagatttagctaaagataaaacaggtgtatttacaggtagttatgttgtaaatcctgtaagtggagaaaaattacctatttggattgctgattatgttttaaattcatatggaacaggtgcggtaatggttgttcctgcacatgatgaacgagatcatgaatttgctcaaaagtttgatttgcctatcgtacaagttatcgaaggtggagatgttcaaaaagaagcatatactggtgatggagttcatatcaattctgatttcctaaatggcatggataaagaagaagccattgatgctataaataactggctagaggaaaatggagtaggggaaaagaaagttaactatcgtttaagagattggttattctctagacaacgttactggggcgagcctattcctgtaattcattgggaagatggtgaaacaactctagttccagaagatgaattacctttatatttacctaaagcaacagatattaagccttcaggaactggtgaaagtccattagctaacttagatgattgggtaaatgttgttgatgaaaatggtagaaaaggacgtcgtgaaactaataccatgccacaatgggctggtagttcctggtacttcctacgttatatagatccacataacaatcatgaagtagcagattatgaaaaattaaaagaatggttacctgtaaacttgtatgttggtggtgctgaacacgctgtattacatttattgtatgctcgtttctggcataaattcttatatgatttaggtgtagttccaactaaagaaccattccaaaaattggtaaaccaaggaatgattttaggttctaatcatgaaaagatgtccaagtctaaaggaaatgtagttaatccagatgatatcgttgaacaatatggagcagatacattacgcttatatgaaatgtttatggggcctttagatgcatctatcccttggagtgaagaaggacttggtggcgcacataagttcatcaaccgtgtttggaatttattgattgatgaaaatgacaatttgcgtgatagagtaactacaattaacaatcatgatttagataagatatataatgaaactgttaagaaagttacagaagactatgaggctatgcactttaatactgcaatttcccaattaatggtttttgttaataatgcttataaagcagattcattaccattggaatatgtggaaggcttagtaaaattgttatcaccagttgttcctcatattacagaagaattatggtctaagttaggtcatgtaggtagcatagcatatgctaagtggccaacctatgatgaaagcaagttggttgaagatgttgtagaaattgttgttcaaattaacggtaaagtaagacaacatttacaagtgtctaaagatgctagtcgtgaagaattacaagcactagctttgaacgacgaaagaataaaacaagaacttgcggataaagaagttaaaaaagttattgcagttcctggtaagttagtatcaattgtagtagcaaaataa

SEQ ID NO: 372 - DNA, 828 bp, Lactobacillus salivarius
  isolated from gut, Lactobacillus salivarius
atgaaaaaagaacgtgtagatgtactattagttaaacagggattattttctacaagagaacaagctaaaagggctgtaatggctggcgaaattttaggagagaacgaagaaagattagataaacccggaatgaaaatttctgtagatactgagttacattttaaggggacaaaaatgccttatgtaagtagaggcggtttaaaactcgaaaaagcacttaaggtatttaaagttgatgcaaaaaataaaactatgttagacataggatcgtctactggaggatttacagatgtagctctacaaaaaggggccaaattaagctatgctttagatgtaggaactaatcaattagcttggaagttgcgtcaagatgacagagttgttgttatggagaatacaaatttcagatacagtaaattagaagattttactaaaggacaaccagatttagctacaatagatgtttcttttatttctttacagttaatattaccaactttacatgagattattcaaaataatggtgatgtaatagctttaattaagccccaatttgaagcaggaaaagaaaaagttggaaaacatggaattgtaagagatccaaaggttcatctagaagtactaaataaaatcataagttttgcagctgaagaaaattacgatgttgttgaattagatttttcacctatcactggtggggaaggaaatattgaatttttagttcatctggtatctaaggaaagtgttggaaatatttcgcctagtgtaaatcctgagttaattgtgaaacaagctcatgctacattagatattaaaaagaaagcataa

SEQ ID NO: 373 - DNA, 837 bp, Lactobacillus salivarius
  isolated from gut, Lactobacillus salivarius
atggaaaaagcagtttcattaaactttatttcagttccaagtgatcaattacaactagcaaatgtaggacgctcagatacattgagtggacataagtatggaccagcagttagaccatattaccttatccactatatcttagctggttctggaacatttaaaactgatcaatcaatctacaaattacatgctggacaaggttttctaattgaaccaggacaagaaacgacctatattgccgataaaaatacgccttggtcttatgtgtggattggcttttctggtaattttgctgatcaacttatgcagcaaattccactaaatcaacatgaaccaatcttcagtttaaatgatcccaaacgtttaattgagttagttaatttattgttattaaagtcagttaattcaacaacaaagaaattactcaatcttagttatttgttggaatttttgagtattatttccaatgctacaattatatctcgtgaattaaccacttctatttctgatgtttatgttgagaaagctatttctttaattaataaaaactttcctaacatctcggctgcttcattggcacaaatgatcggactagatagaagttatctggggaagagatttaagaaagtaacaggaatgacacttcaaacctatttgaaaaattataaaattacacaagcacgacatttaattgaatcaacaaatctttctttgcttgaaatttctcaaagatgtggctaccagcgagttgattccctagcaagaacttttaaagctacctatggtttaacacctagtgacttcagactacaacaaaaagagcttctaacattatga

SEQ ID NO: 374 - DNA, 891 bp, Lactobacillus salivarius
  isolated from gut, Lactobacillus salivarius
atgaaatctacgtggaataaagaaagtgacgagaaaatgacactcaaaaaatttttaaagaataagggtgtcagtcatcgaactttaagtagtttgaaaaaaggaaatggaaaagttttagtagatggcaaaaaaaggtcattatctattgaagttggtaaaggaaaaataactttgattttaccaccagaaaaatcagatgaaaatgtcaaaatgagtaaggaaccgctagatattatttatgaggatagcaattggctagtggtagataaaccacctttactttcaagtgttccaggtcctagtaatcgcaccgataccttagttaatcgggttaaatttcatctatggcaacaaaaatcaaaagacttagttccgcatgtaattactcgtttagatagagatacaagtggcttagttcttgtagctaagcatcgttttgctcaaggattgattaacaaacaggttgaagaacatagtatagataaaaaatacttggcagtggtcgaaggaattattacagaaaagcatggcataatagataaaccacttggacctagagaaaatggaatcggacaaatggtaactgacacaggaaagattgccaagactgagtactgggttagagaatacttaggagacaaagctactttagttgaatgtaagctacatacaggtaggacacatcaaataagagctcactttagtagtattaatcatgctttggtaggcgatgagctatatggtggcagattggattggggactagaaagacaagcactccatgcatatcaactagcttatgtagatccatttactcaagaagaaaagttatttaagagcgagatgccaaaagatttagaaaatttgatagttagattgaaaaattaa

SEQ ID NO: 375 - DNA, 2661 bp, Lactobacillus salivarius
  isolated from gut, Lactobacillus salivarius
atgacaaaagaagtagaaatgtcaactaaatacgatccaagtcaagtagaacctggcagatataaagaatggatcgaaaaaggtttatttaaacctaatgaagataaagaagcaaaaccatattcaatcgttattccaccaccaaatgtaactggtaaattgcatttgggtcatgcatgggatacaacattgcaagatatgataattcgtcaaaagagaatgcaaggctttgatactttatggttaccaggaatggaccatgctggtattgcgactcaagctaaggtagaggctagattagctgaagatggaatttctcgttacgatttaggacgtgaaaaattcgtagaaaaagtttgggaatggaaaggcgaatatgctgacatcattcatcaacaatgggctaagctaggtttgtctttagattacgatagagaaagatttactttggatgatggattatctaaggctgtaagaaaagtctttgttactttgtacaaaaaaggattaatctatcgtggtgaatatattattaactgggatcctaaagctcgtactgctttatcagatattgaagttattcataaagatgataaaggtgcattttaccatgttaaatatccatttgctgacgatacaacatttaatggcaagaactatattgaaattgctacaactcgtcctgaaactatgatgggtgacgtagcagttgccgtaaatcctgatgatgaacgttataaggatattgtaggtaagactttagttctaccattacaaggtagacatattccaattattgctgaccaatatgttgatcctgaatttggtacaggtatggttaagattacaccagctcatgaccctaatgactttgaagtaggtaatagacataatttggaacgcatcaatacaatgaatgaagatgctacaatgaatgccaatgctggtaaatatgaaggtttagacagatttgaagcacgtaaggcaattgtgtctgatcttgaagaacaaggctacatgttgaagattgaaccaatcgtacatagtgtaggacattctgaaagaacaggggtacaagttgaatcacgtctttcaacacaatggtttgtaaagatgaagcctttagcagaagcagctttgaagaatcaagaaactgatgatagagtagactttgtgccacctcgttttgaacatacatttacacaatggatggaaaatgttcatgattgggttatttctcgtcaattatggtggggacatcaaatcccagcatggtaccacaaagaaactggtgaaatttatgtaggtgaagaagcacctgaagatattgaaaattgggaacaagattcggatgtattggatacatggttctctagtgcattatggccattctcaacaatgggttggccagatactgaaagtcctgatttcaagcgttatttcccaactaatacattggttacaggttatgatattattttcttctgggtatccagaatgattttccaaagtgttgaatttacaaagcgtcgtccgtttaagaacgttctaattcatggtttaattcgtgatgaacagggacgtaagatgagtaaatcacttggaaatggtattgatccaatggatgtaattgataagtatggggcagatgcattgagatggttcttatctaatggttctgcacctggtcaagatgtacgtttctcatatacaaagatggacgctgcttggaactttatcaataagatttggaatgcaagtcgttttgttattatgaacttagatagcgatgttgaattaagtttaccagaagcatcagaatggcaattagctgataagtggattctaagtcgtcttaatgatacggttcgcgatgtaactcgtttattcgatagttttgaatttggtgaagctggtcgtgctctatataacttcatttggaatgatttctgtgactggtacattgaaatggctaaggaaaatcttacaggtgaagatgaaaaacttaagaagaatacacaacgtatcctacgttatgtattagatcaaattctacgcctaatgcatccaattatgccatttgttacagaaaagatttggttatctatgccacatgatggtgcatccttggttgttgctgaataccctgttgaacatactgaatttgataatcaagtagcagaaaaagacatggataatttgattgagttaattaaagcagtacgtaacagtcgttctgaagttaatgctccaatgtcttcagcaattgatattttaattaagacaaaatatgatgatacaagaaaagtgtttgaaaacaatgttgattatatcaatcgtttctgtcatccaaaacgtttagaaatagctgcagatattgaggcacctaagttagctatgacatctgttatcacaggagcagaagtttacttaccattagctgatttaattgatttaaacgaagaaatttcacgtttacaaaaagaagctaagaaattagaaagtgaagttacacgtggtgaaaagaaactaggtaatgaaaaatttgttgccaatgcaccagaagccgttgttgctaaggaaaaagaaaaattagctaattataagcaacaacttgctgcaactgaaagtcgaattgaagagttaaaagctgaaatttaa

SEQ ID NO: 376 - DNA, 393 bp, Lactobacillus salivarius
  isolated from gut, Lactobacillus salivarius
atgttagagaattggttagaacttcaaaaattcacaaaacaagtaaataccgaattggaacgatcactaagtcaaatggtaccagcagtaacagtgaatgaattttatgtgttacattttttagaacaaaatgcgggacatgacttacgtgtgagtgacctaagtcaaaaattggatttaagtcttagcgcaacttcaagaatgttggtgcgttttgaacaaacttgtaatgttattacgcgaaatcagggacaagaagataagcgtagtgttaggattaatttaacggcagaaggtgaaaatgttttgtcggaagctaaacaaagaattgatgcagttttgagtaaatatgaggaaaaattagttaattttgggggaattaagaatgactaa

SEQ ID NO: 377 - DNA, 1698 bp, Lactobacillus salivarius
  isolated from gut, Lactobacillus salivarius
atgagtgatataaaaatcatctcgctaggtggggtacgtgaaaatgcaaaaaacatgtatgctgtagaagttgatgatgaaatatttattttagactgtggattaaaatatccagaaaatgaattattaggtatagattttgttattcctgatttttcatatttaagagagaattcacgtaaaatagtgggtgttttcttaacacacggtcatgcagatgccataggagcgctaccgtattttgttagtgaatttgatgtgccagtttttggatcagaattaacaattgaactagctaaaattgcatgtgaaaatgaagaagatgctagaaaattcgatgattttcatgtaattgatgagagtacagaaatagattttgaaaatgcaacgatatcattttttcaaactacacattctattccagagtctttgggtgtggttattaaaacagaaaatggaaatattgtttatactggagactttaaatttgatcagtctgcagaaaaaggttatcgaacagattatgcaagattaactgaaattggtcgtgaaggtgtgctagctttattaagtgagtcagccaatgctgaaaatcctagagaaacagttaatgagcgagcaatatatgattttattagtgaaaattttgaatatcgtaaaggaagaattattgtagcttgcgtagcttcaaatattttacgagtacaacaaatttttaatgcagctgcagctaataatagaaaagtggctcttactggacatgatgtagaaaaagttgttaaaactgcaatgcgtttaaataaattagtattgccggaagaggatttactcatacctattaaaaaaattaacgactacaatgatgatgaaattgtaattcttgaaactggacgttctggagaaccattaaaatcattgcaaaaaatggctatgggtagacatagatttgtcaatctacatgaaggagatttggtatttattacaactactccatctcatgctatggaaactaaggttgcaagaactagagacatgatatatcgctcaggagcagacgttaaagctatttttgatgaattaaattcttcaggtcatgcaagtaagaatgatttgcagttaatgatgaacttggtaaaaccacgttacgtcattcctgttcaaggtgaatatagaatgttgtctgcgcatgcagaattagctagagaactagggattcctagtgaaaatatctttttactcaaaaaaggtgatgtcttagaatataagaaagatgagatgacaatttcatcaagtgtagaagtaggcaacactatgattgatggaactggcgttggggatattggaaatattgttttgagagatagaaaaatcctatcagaagatggaatttttattgctgtggttactattgatcgtaaaaagaggaagattgttgatactcctaaaataacatctcgtggtttcgtatatattaaaacaagtaaagatttgatggttgaaagtagggatattgtagctaagattgttcaaagagatttggataataaggaatttgactggagccaattaaaacaagatattcgagaaaatttgaataatttcttgtatgagcaaacaaagcgtcatccagttattttaccagtaattatggaaataaatcaaaataatcatttttctaagaagaaaaagaaaggttaa

SEQ ID NO: 378 - DNA, 1587 bp, Unknownn
  isolated from gut, unidentified
atgattaaatacatagataatcaggaagttatcatgattaaagctgggcactgggaggtacttatgcagacattaatacagacatttatggatcggcggagtgatttgctcactgcgttgtggcaacacttggggatttctttggccgcgctagtcattgcaatggtgattgcgattccactggcgatttgggtcgttcgccgaccacggtgggccgaggggttattgcaattgaccagtgttttgcagaccattccgtcgctggcactattgggattgctgattccgctagtcggtattggcacggtgcccgcggtgattgcgctagtgatttacgcgttgttgccaatctttcaaaatacttatttagggatctcggaaatcgacgcgtcaattgaagaagcggccgatgcgtttggaatgtcgcggatgcgcaagttgttcaaagttgaactgccgattgccttgccacaaatcattgccgggattcggaccgccctagtgctcattatcgggacggcgacgttagcggctttgattggtgctgggggtctagggacgtttatcatgcttgggattgaccgtaatgatacgtcgttgctgttgattggggccatttcgtcagcgctattggcgattctgttgagtgcactcgtgcgctggttccagacggctaaaccccgccacgcgttgatcgtgttcgtgggtattttggcgttactcggtggtggcgcgtacagcgtttatgccaatcgagttgaaacaattacaattgcaggtaaactcgggtccgagcctgacatcttgatcaatatgtacaaacaattgattgaagctgaagacgaccacatccacgtgaccttgaaaccgaactttggtaagacgaccttcttattcagcgctctgaagaataatcagatcgacatttacccagaattcactggttccgtattggaaactttggtgaagggcaataatccggccagtcaaacggctaatcagacttatcagttagccaaaaagcggctagctaagcaggaacagatgacttacttgaagccgatgcagtacaacaatacgtacgccctggccgtcactaagaagttccaacaagaacaccatttgaagaccatcagcgatttaacacaagtcgaatcgatcctcaaaccagggatgacgctcgaatttatcgaccgcgatgatggcttgaagggaatcaagaagacgtatggcttggatgttacggccaaatcgatggaaccggcattgcgctatgaagcgattagcaaggggaaaatcaatctggtggacgcctacgcaacggatagcgaattacgacaatataacttggcgctgctgaaggatgataagcacttcttcccgacgtatcaaggggcgccactcatgaagaccagctttgctaacaaacacccgaaagtcgtccaagcattgaataagttagctgacaagatttccgaaaccgatatgcaagagatgaactatgaagtcaatgtcaaaaagaaatcggcttccacagtcgcacataactatctcgtcaaacacggcttgttaaaggaggaacgctaa

SEQ ID NO: 379 - DNA, 837 bp, Lactobacillus oris
  isolated from gut, Lactobacillus oris
atggcgagggtaattaaatataccaaagcttttaaaaaacagttcaaaaagcggcgccaagaccccaagtggcgttcaatatttaaaagttcactacctcaagagcttgatgatcaaaagcggaatccttggaaatatattattcagtgtttaattgaaaataaaaccattccagattatttttatccgcatactttagaaggtgttacaatggaaaagcaagaaacgacaagaaagaaaaagaggtttgatatgaaaaggtctttcaggcggatttccgctgtcatagcaacgatggctttcacgacaggtctggccgcctgcggttcctcccagtcgactgccccatcggcgaacaaagccacttcctccgtcactgccccccagggctggaagaagttcacgtccaaggatctgggctattccgtctatttcccgggcgttccggagaaggacacctataaggatcccaccggcgcttatgcccgctattcgacggtcaatgacaaggatcacatcaactacgctgtgtccgtcaccaaattcactcggaagcaagtcgaggactccaaggggttcaatgacgcgcagaaacgtaaggttttgaccaatgtcgctcgtcttctgcagattgacaagtattcctttaccaccgtggacgggcatatggccatttcctacaccggtcacgatagcgaggactcctcggtgatcatgcgtcgagaggtcgtttactcgtccgctggcctctatggcctcgaatcctttggaacttccagctcggaatacaagcagttcgtcgataccttccggctttccgaagatacgcaaaaatga

SEQ ID NO: 380 - DNA, 903 bp, Lactobacillus salivarius
  isolated from gut, Lactobacillus salivarius
atgcgctggttcgaatccagctaccccaattctagcgcagatcatgttgatgatttgcgtttttttattacatttattattactgtaaagcaaaggatggttgagattatgaagattggtttcataggtgtaggaaatatggcaaaggccataattgaaggtctaatgagtaagggtgtagaagcaaagaatatttttattcatagcgcacataaatccaattatgaagtatatagtcaagaaactggagtatctgcttgtgaaagtaatagtgaagttattgaaaaatcagatgttgttttcttagcagtaaaaccaattgtagtagaaaaagtcttaaaagaagtaaaagattcagttctaactcacaacccagtcttagtatctgttgtaacaggtgtatctgtagctgagttagaggatatactaggaagtaaagatgtaaaaatagtaagaacaatgcctaacgttaatgtagagataggtgaaggcatgacagctttacataagaatgataatgtaagtgatgaagattaccaacttgtaagagaattatttgaaaagataggtaaagttgcagaaattgaagaaaaagattttagtacattcgtagctttagctggaagttccccagccttcgtgtacttctttattgatagtttagcacgatcaggtgttaaatatggattaaataagcaaaaagcaactcaaatagctgcacaagccgttttaggaagtgcattaaaagtgttgaaatcagataaaacaccatgggaattagtagatgatgtttcctctcctggtggaacaacagtagctggattattagcaatggaagaagcagggtttatgacttctattgttaaaggagtagatgcaacaatttcaaaagataagggatag

SEQ ID NO: 381 - DNA, 996 bp, Lactobacillus salivarius
  isolated from gut, Lactobacillus salivarius
atggtttcaatcaaaatgtttggtgttcgtgatgaagaacgtccaatggctgaaaactgggcaaaagaacacaacgttaacattgatatgactagtgacatccttacatccgatactattgatgaagttaagggttttgacggtctaactttaatgcaagtagcggaagttactgatgatttatatcctaaattgaaagaatttggtatcaaacaaatcgcacaacgtagtgctggttatgatatgtacaatttagatgctgctaaagaaaatggcatcatcattactaacgtacctagctactccccagaatcaattgctgaatacactgtaactacagcattgaacttagtacgtaaattcccactaatcgaaaaacgtgttaagaaacataatttctcatgggaacctgaaatcagaggtcgtgttgtcggtgacatgacagttgctgttatcggaactggccgtattggttaccatgtagctaaaatcttccatggtttcggcgctaaagttgtcggctatgacttatatcctagtgataaattagatggtatcttggaatatcgtgattccgtagaagatgctatccgcgatgcagacattatttccttacatatgcctgctttcaaggaaaatcatcatatgtttaactatgaaatgttcaagaaattcaaatctgacgctgtattagttaacatggctcgtggtgctttaattgatacagaagatttattgaaagctttagacgatggccttttggctggagctggtcttgacgtttatgaacacgaaggtccattagttcctattgacctaactggaaaggatattgaagacgaaacattcaagaaagtacttgaatctgataagattatctactcaccacacgtagcatactacactgatgaagctgttaaaaacttagttgaaggtggtttaaatgctactttagaagtattggaaactggcgatgcttcaacacgtgtaaactaa

SEQ ID NO: 382 - DNA, 1386 bp, Lactobacillus salivarius
  isolated from gut, Lactobacillus salivarius
atggctgaaaaatttatttttgaaccatgggatatttcaaaattacaaagtagttatgatgttgtgatcgtaggttctggtagtacaggcttaacagcagctattcaagcacatgaattaggtttgaagccagttgttttagaaaaaatggaaaaattcggtggtaatactaatcgtgcttcttcaggaatgaatgctgctgaaactaacatccaattacatcatggaattgttgataatatggatgacttttataaggaaacttataaaggtggtggaaagttaaatgatccagaattattaaaatatttcactagtcattcagctcttgcaatcgactggctaaaagatcatggaattgaattagacgaactaactttcactggtggtatgagtaaaatgagaactcatcgcccatctagcatggcaccaattggagctttcttgataaagaacctattaaagattgctcaagatgaaaatttaccagttttcaataatgtaactgttacaaaagttaataaagaaaatggtcgagtaaatggtgtgactgtaaaaactagcgaaggtgaaaaagtaattaatgccaaaacagtattattagctacaggtggttttggtgctgctcaagatattatcaagaaatatcgtccagatttagctagctacaagacaactaaccatcccggagctactggagatggaattaagttagctgaagaattaggtgcccaagttgtacaaatgaatttaattcaagtgcatccaactgtacaacaagatacaccacatgccttcttaataggtgaagctgttcgtggtgaaggtggtattttagtaaatggtgaaggacaacgttttgtaaatgaacttaatacaagaaaagttgtttctaacgctattactgctttgcctgaacacagtgcatacttaatttttgataaagatattcgcagtcgagtaaaagctattgaattctacgatagtatcggcttggtagaacatggatctgatttgaaagaattagcagaaaagattaatgttcctgcagataaattagaagcaacagttaacaactggaatcaaatggttgctgctggtaaagatactgattttgatcgtaaaacaggaatggaaagaaagattagtgaagctccatactacgctattcatattgcacctgctatccattacacaatgggtggaatccatatcgacagtcgtacaagagttatagatggaaatggtgatataattccaggtctcttagctgctggagaagttgcaggtggtttacacggtaataatcgtatcggtggtaactctattgcagaaacggttattttcggtatacaagctggacgcgaagcatttttagaaaaataa

SEQ ID NO: 383 - DNA, 894 bp, Lactobacillus salivarius
  isolated from gut, Lactobacillus salivarius
atggcgattaacaatattttaatggactatttgcattatttgaaagttgagcgtggcttatcagaaaatacgattaacagctatgggattgatctcaaattatttttagagtatttaagagaaaatgaaattccatcttttaagcaagtaaataaagaagttatcgtcaactatatgcaatctgagaagaataacaataaagctaattccagtattttacgtagtgttagcagtttaagaaagttcttccagtacttagcgcaagaaaaaattattgaaaaggacccaatgttgttaattgatacaccaaagaagaaacaacatttaccccaagtgctaactaaagaagaagttgaaaaattattgcgttcacctaatactggtcaggttttaggtttaagagatcgggcgatgctggaattgatctatgccactggtctgcgaatcagtgaaattatcaacttgaaacttgaagatttacatttaacaatggggacacttcaaacgttaggtaaggggcataaagaacgaattgtcccagtaggcgatgaggcaattaaatgggttaatcgttatttagaagaagctcggcctaaattgttgaaacaaaagcgtagtaattatttatttttgaactttcatggaaataacttaacgcgtcagggtgtatggagaaatttgaaggcagaagtaagaaaagctggaattcaaaaaaatataactccacatactttacgtcattcatttgcgactcacattttagaaaatggagcagatttaagaattgttcaagagctattaggacatgcggatatttcaacaacacagatctatacgcatctttcaaataagcaattggcggatatttataatcgtgctcatcctagagcataa

SEQ ID NO: 384 - DNA, 1764 bp, Lactobacillus salivarius
  isolated from gut, Lactobacillus salivarius
atgaatttagcagcactttatcacaggccagatagtgaaatggcatatttagtaaagaaagatgactttcagattaggttaagaacggggacaaatgaagttgaaaatgtaattttatattatggagatccatatgacgttaccataaatgataaaaagaagcagatttgggaatatcaagttcaagaaatgaatctacaagcttcaacaagcctttatgattattggcaattaaatgtgagcgttccactaaaaaggttacaatacttttttaaaatcaaatttagaaatggcaaagaatttttatatgatgatagacatatttggagttattctaagatacatttagagaatagttctggttttagaatgccttatttccacgaaatagatcgcataaaaacgccagattgggtgaaaaaaacggtttggtatcagatttttcctgaacgctttgctaatggtgatcattcaattgatcccaaaggaacattgccatggggaagtgaaaagcctagtagaacaaatttctttggtggtgatcttcaaggggtaatcgatcatttagattatctggaagacttaggaattaatggaatctatttttgtccgatttttgctgcacattctaaccataaatatgatacgatagactattttaatattgatcctgcttttggcagtaaggaaaaattcaaagaattagtagataaagcacacgaacgtggtattaagataatgttagatgctgtattcaatcatatgggggacttttccatgcaatggcaagatgtcataaagaatggagaaaaatcccgctttgccgaatggttccatattaataaattcccagtatcttatgatgaaattagtctggaacaagcagaaaatttaacctatgaagtttttgctaagacaccacatatgcctaaattaaatacagctaatcctgaagtgcaagattatttgttagaaattgctagatattggattgaacaatttgatatcgatgcttggaggttagatgttgctaatgaaatagatcatcacttttggaagaagttctatcgagaaactcataagttgaaatcagatttttatgttgtaggagaggtctggcattcagctcaatcttggttagatcaagctgaatttgatggtgtgatgaattatccatttactgatgcaattattgatggaattattttgaataagatcaatattacagatatgaaggatacacttataaataatttaatgaaatatcgggatcaaaataatcaagttatgttaaattcattagatacacatgacacagccagaattttgacgctagcaaagggtgataagaataaagtaagacaagctttagtatttatgttcatgttgacaggaagtccatgtatttattatggtactgaaattggtatgactggaggaccagacccagattgtagaagatgcatgatttgggataaaagtcagcaagatttaagaatgttcaattttatgaaagatttaattgctataagaaaaaagtattcaaaagtattaaattatagtaatataacatggagtttagtagacaagggtaatcatagtgttgagttaatacgagaattacctgggtgtaaagtgcaatcaatttttaattttggaaagaataatatagatgtaaaagtggatggaaagaaaattttagcaagtaatatcgaaaaaaatgaaatcgctccaggtggctttataataactgttactgactaa

SEQ ID NO: 385 - DNA, 897 bp, Lactobacillus salivarius
  isolated from gut, Lactobacillus salivarius
gtggatcagatcagggtggaccaacaaaacttacccaaaaaggaacgatatgggattggtgagcttctaaaaacgattgacttgaagcgaccaacctattacgatgaacgcaaacgtatcatcaataaaaatgataagtatgctgatgttaaggtggtaatcaaagaaatagcggaaaaaggtaaatggaggggttcttacacatacggctatcgccgtataatgccacttcttgagaaagctggatatcacatggctgaagccactttacgtcgcctaatgaacgaattaggtgtacaaccagctatgtataatcgtcgtaaaaataatcactattcttcttataaaggtacagttggtaaggtagctgataacttgttaaaccaaacatttgatgctacatctccttttaccgttcttcatacggatgtttcacaggtacgtctaggtgattcgacctgggcttacatgtcagtcattttagatcaagctaccaaggaagttttagccgcttctgttagccaaagcccaaataaattgttgattatggatacattaagccagcttgaggataacctccctaataactttagtccaattatccattctgaccaaggatggcactaccaattagaatattaccgtgaaaagattgattcattaggtttaattcaaagtatgtcccgcaagggaaactgcctagataatgctccaatggaaagctttttccatctttttaaagttgaatcacagcctgaaataaagaaatgtaagagtatttctcagttcacacatttctttaacaagtatgtcaattggtacaataatgaccgaatttccaataaaacaaaaaacatgagtccggttgattaccgaacccatgtcttagctgcttaa

SEQ ID NO: 386 - DNA, 1140 bp, Lactobacillus salivarius
  isolated from gut, Lactobacillus salivarius
atgtatcttgaaaaattggaacttaaacattttcgaaattatgaagatgttaatgttgctttctctcctcaagttaacgttttgattggaaaaaacgctcagggaaaaactaacttgttggaatctatatatgttttagcaatggcacgtagtcatagaacgagcaatgatagggaaatggtaacttttaaaaaagatgccgcattaattagaggagaagttcatcagcgtttaggtaacacgaagttagaacttctgataagtcgtaaaggtaaaaaagcaaaagtaaattatttggaaaaagcaagattgtcacagtatattggacaattgaatgttattttgtttgcaccagaagacctagcgctagttaagggggctccatcagttcgtcgaaggttcatagatatggagtttggacaaatagatgctctttatttacatgccttgaccgaatatcgtgcggttttacgccaacgaaataagtatcttaaagaactacaaacaaagaaagcaacggataaagtatatttagaaatattatcggagcaactttcagaaagtggttcgcaaataatttttaaaagattagagtttttgcaagagttagaaaaatatgccgataagttacataaccaaattactcaaggtaaagaacatttacaatttcagtatgaaagtacattgaaagaataccaagggaagagtgtgtcggaattaaagcaatccttgattgaacagtataagactatgatggataaagaaatttttcaaggaacaacattgctcggcccgcatagagatgatgttcgttttatgttgaatgacaaaaatgtccaagtgtatggatcgcaaggccagcaaagaacagcagcgttgtctgtgaaattagctgaaatagatttgatgaaagaaaaaacacatgaatatccaatcctgttgttagatgatgtgttgagtgagttagatggtgctcgacaaactcatttattgaaaactattcaaaataaagtacaaacattcctgactacaccaggattatcagatgttgcgcaacaattaattaataaacccaaaatctttagaatagataacggaaaaattacagaagaaaattcatttacgattgaggaggaatag

SEQ ID NO: 387 - DNA, 762 bp, Lactobacillus salivarius
  isolated from gut, Lactobacillus salivarius
ttggaaataacatcaacaagtaatagtagagtaaaagaatggaagaaattaaatactaaaaagggaagaaaaagacaaaataagtatattcttgatggtttacatttagtaaaagaagcactaaaagcaaataagaaagttgaagaattgttaataacttctaaatttgagcatctaaatgaaatagaaatcccagatgaaactaaggtgattatgatttctgaggaagtttcaaaaagtatttcagaaactcaaacaccacaaggaatttttggaattgtgtctattgaagaagaaaaaatcacatatcctcaaaaggacgtaggtgcttggttaatgttagatggtgttcaggatccaggaaatattggaacaatggtacgtactgcagatgctgctggtttcactggagtaatcttaggagaagggtcggcagatttgtataatcctaaagtcgtaagagcaatgcaagggagtcaatttcatattaaagttattaatgataatctctctggttggattagacattttaaagatatgaaggttcctgtttttggaagtgaacttaatgaacatgctagagagtatactaatgtcggacaacatactgattttgctttagttatgggaaatgaaggaaatggaatgagtaaagaaattctagagatgacttcgattaatttgtatattccaataaccaatgctgaatcattaaatgtagcggtagctgcaggtatattaatgtttgctttgaagaaataa

SEQ ID NO: 388 - DNA, 1470 bp, Lactobacillus salivarius
  isolated from gut, Lactobacillus salivarius
atgaattcagaatcaatggacaaagctttctttggtcatcctcgtggattatcaactttgttctttactgaaatgtgggaacggtttagttactatggtatgcgtgccattttactattctatatgtactattccgtgtccgatggtggtctaggaattgataagaccacagctgcttctatcatggctatatatggatcacttgtatacttatctagtgttataggtggtttcataagtgatagaattttaggaagtcgccgtacagtatttatcggtggtgtattaataatgctaggtcatattgcattatcaacaccatatggtaagggagctttgcttttatcaattatcttgattgttttgggtactggcttattaaaacctaatgtatctgaaatggttggtagtttgtattcttcaaatgaccctcgtagagatgctgggtttaatatttttgtttttggtattaacgttggtgctttggtttcaccaattgttgttggacaattaggttttaacgttaacttccatttaggattttctttggcagctattggtatgttcttcggtttattacaatactggttagacggtagaaaatacttatcaaaagatagcttatatcctacagatccaattgaatctgacgaattaaaaggtttacttacaaaaacagttattggtattgctgcaattgcattaatattaataattatgaatttattgaatgcactaaatattactaatattatcaatttaatttctattattgctgtattaattccaatttattatttcgtgttaatgctaagtagtagaaaaataactaaggtagaacgttcacgtgtattggcatatatacctttattcattgcctcagttttattctggtcaattgaagaacaaggttcagttgttttagctttatttgctggtgaacaaacaagattatcattgtttggattccactttgcacctagtttattccaaagtatgaatccattattcattatcatctacgtaccattctttgcatggttatgggtaaaattaggaagcaaacaaccatcatcaccaatgaaattctcaataggtttattcttcgcagggttatcatttatgtggatgatgttaccaggaatgttatttggaactgataagttagttagcccattctggttgattattagttgggctttagtaatcattggtgaaatgaatatctcaccaattggattatcagtaactactaaattggcacctaaagcattccaatcacaaatgatgagtatgtggttcttaggtgatgctgcagcacaagctattaatgcacaaatagttaaattgtatagtcatggtacagaagttatgtattatggtgtagttggtgctattacaattgcatttggtattattttgttattctttgtacctaagattgaaaagttaatgtcaggtgttttataa

SEQ ID NO: 389 - DNA, 771 bp, Lactobacillus salivarius
  isolated from gut, Lactobacillus salivarius
atggactatcaaaaattgccattatttatacatgattatccacaggaggcagtaatcaatccagatcatgaacatttggattataagctaccagaaaaattaatttatgcttttgtgactaaagaaaatattgataaatttctagcaaagtattcttatcgaattgtagggagtatggaaactatttcttttaatcccaatgtctatgaaattgactatgaaggacaaaaaatagggctatgtcaggctccgcttggggcaccagcagctacacaactattagattggctaattggttatggagtaaggaaagtattaactgttggttcatgtggagcattggaagattttgaagaaaatgaatttgttatcccaacaaaggctattagagatgaaggaacctcgctacattatttgcctgctagtgaaagtattgagttgacttcaaaatttgtgaaacaggtagaacaaatcttacaagactttaattatcgaattcatgaagttacaacatggacaaccgatggcttttatcgagagactgtggagttagtcaatcattatcgtaaattaggtgttgctacagttgaaatggaatgtgccgctttagctgcatgtgcacaatttagaaatgtggattttgcgcagattttattcacagcggactcactaaaagatgttgataattatgacgaacgagattttggaattaattcacatctaaaagtattaaaaatagcgacaaaagttatggtgaaattaaaaaactaa

SEQ ID NO: 390 - DNA, 1467 bp, Lactobacillus salivarius
  isolated from gut, Lactobacillus salivarius
gtggtaaaaatagagtatgatacagtagtaaatattaatttgacaaggagaaatattatgacttctaaatatgctatcatcttggctgctggtcaaggaacacgcatgaaatcaaagctatataaagtactacatccagtatgtggaaagccaatggtagatcatgtattaactgaaattgaaaagaataacatggatgaaattgtgacagttgtaggtcacggtgctgaaatggttgaaaaaactttaggtgatcgtacaaaatacgctttacaagcagaacaattaggaacaggacatgctgttttacaagctgaaaagttacttggtgataaagatggtatgactttaattgcttgtggagatacacctcttttcacagcaaagacatttgaagaattatttgaatatcacaaatctaaaggtgcggtagctacagttttaacagctcatgctgaaaatccatttggctatggtcgtatcatccgtaatgaaattggaattgtggaaaagattgttgaacaaaaagatgcaacagttgaagaagctacagtaaaagaaatcaatacaggtgtgtactgctttgataataaagaattatttgcagcattacaccaaattaaaaatgataatgcacaaggtgaatattaccttccagatgtaatggaaatcttccaaaaacaaggtaaagttgttgctgcttaccaaatgaagaactttgaagaatcaatgggtgttaatgatcgtattgctttatctaatgcaaccaaagtaatgcgtcgtcgtattaatgaaaacttgatgcgtcaaggtgtaactttaattgatcctgatacaacttatattgatatcgatgtaaaagtagggtcagatacagttatcgagcctggagtacaattaaaaggtaagacagaaattggtgctgattgctatattggtgctcattctgaaattatagacagtgtaattgaagatggtgtcaaggttacaagttcttatattgaagatgctgtaatgcataagaattctaacattggtccatacagtcatttacgtcctaaagctgaaattggcgaaaatgctcatatcggaaactttgtagaagttaagaaagctacaattggaaagaatactaaagttggtcatttaacatatgttggcgatgcaacattaggtagagatattaatgttggttgtggcacagtatttgttaactacgatggaattaacaagcaccatacaacagttggagattactccttcattggtagtgcttcaaatattatcgcacctgtaaatattgctgatcatgcttatgtagcagcaggttcaacaattactgatgatattgatgcacatgacatgggaattgctcgtggacgtcaagttaacaaaaaaggttattttgaccgttatccagtagctgaagctgcacgtattgctgaagaaaaagctaaagaagaataa

SEQ ID NO: 391 - DNA, 657 bp, Lactobacillus salivarius
  isolated from gut, Lactobacillus salivarius
atgaaaaaatttaattggtcatttgacataattatgctaatatttattgaaatttcaatgctggtatcattagtttcaagttttattgaacataaaagtatgttatacatagcagaaacaattgcagggattttactagctttggctcctgtgattgcctcaagcctttttagatttaacttgcctaaatttctaaatgcgttttatttattatttatatatggttcagtttatctaggtacattgttacatttttatagcgtaccttattgggataagggacttcatttaataagtggagctttattggctagttttggattttcactatatggcatgattgttcctaagcacttaagagaacatatgccagctggattcttagtactttatgcattatcgtttgcaattttttgtggagtgtgttgggaattttatgagtttacttgcgatggtttatttggaatgaacttacagcgttatgctagcagtgcaggaaaagcttttgtaggtcgagtagcattgatggatactatgggagatctaattgctgatactatcggtgcaggattgctatgtatttatgcatattttaatattaaacgttcatcacgatggttacagggattttattttcataaatcatttagattctaa

SEQ ID NO: 392 - DNA, 696 bp, Lactobacillus salivarius
  isolated from gut, Lactobacillus salivarius
atgtggcgtacagttattagttctttacctgagttaatatcagctggaataaagtacacaattccgttagcaattatttcatttattctagggttgattttagctttggttacagctttaattagaatttcgcaaactaaaggacctttcttggttatcaaagcaatttttagattttatgtttggctatttagaagtacaccattattggtccaattatttattgtatactttggattaccgtatctaaaaatcaagggactagcaccagaaggaataaagttagatccatttacatcaggaattatagttttttcacttaataccggggcatatgcttccgaaacaattcgtgcggcaattacttcaatccctaaagggcaatgggaagctgctgcctcaattggaatgactcataaacaagcattgatgagaataatcatccctcaagcagctagagtttcattaccaccgttagctaatagtttcattggtttagtgaaagatacatctttagcagcttccattacgattgtggaaatgtttgaagttagtcaacaaattgcagctgaaaattacgagccgttagtaatgtactgcacagtagcagtcttatatgcaattctatgtacggtattatccttcttacaaggatggcttgaaaaagtaacgtcacgttatgtggcaactcaataa

SEQ ID NO: 393 - DNA, 1038 bp, Lactobacillus salivarius
  isolated from gut, Lactobacillus salivarius
atgaaagttatggaaaaaatgcaatacgttgtaatgaaaacagatgatattagaacaaacttggccacagaacaatatttaatgaatagcgataagataaaacctccgttcatgttattctacattgaaaagccatgtattattgttggtcgtaaccaaaatacaatggaagaaatcaaccaaaaatattgtgaagaacatggaattactattacacgccgtctatcaggtggtggagctatgtaccaagatttaggtaacctttgctttagtttcgtagtaccagcagaaaatcaaaaatttggtgactttaaatctttagtacaacctgttgtagatgctttgcataagatgggtgtaacaggtgcagaaacaaccggacgtaatgatattgtggtcgatggtaagaaattctctggtaatgcaatgtatacgcgtggtggcaaaactttctctcacggtacactaatgtttgatgttgatactgatgcagttgctgatgctttacgtgttcctaaggataagattgaatctaaaggaattaagtcagtacgttctcgtgttacaaacctaaagccatatgttagtgaagagtataaagactttgatacattccaatttagagatgaactaattaaactaatttggggtgttgactctttagaagaagcacaacaatatgaataccaattagacgatgaagataaaaaaggtattgaagcaattgaacaaaagctttataggaactgggactgggtatatggcaagtctccagaattcacagttaagcgtcgtaaacactttactagcggtacaattgatgcacgtttcttagttgaagatggtaagatcaaagatattaagatttacggtgacttctttggttcaggcgatgtaaaagatgtcgaagatgctttacgtgggttgaagtatgatgtgtcaactataaaagaagcattaggtaaacttgacttgaataaatattttgttggaattgatgctgaagatattaaagaattaatctcaacacaacaatag

SEQ ID NO: 394 - DNA, 1347 bp, Lactobacillus salivarius
  isolated from gut, Lactobacillus salivarius
atggatagcgcattgaataaactatcaccaaaagatggatatttagtatctgcatctacctatatagataatcatgatattgaaattgttcaagtgctgtatcagccaataataggtattgtagcggtagcattatattcatatttacgttttgaaattgaccctaaattaatattaagtgagagaaaactgaataagaatattatagatggcttaggtataagtattcctgagttatatgatgcacgtttgaaacttgaggctactgggcttataaaaacgtttgaaggtgaagataaattaggtaagtatcatatctatgaacttcaaaaaccattaaacgaagtgaaattttttacagatgatttattaagcacggcgttattagaaatggttggaaatgaaaaatttaaaaaattatctttatggaataaatttgataataattatcatgataaaaaagaagttacaaagcaattttttgatgtatttaatttaaataaagataatattgttttacaagctcaattaaataatagtaagatttcaaatgatgaatctcttattaatcgtcaaaaggtgtcattagacatgacagtttttagtgatttcataaagaactcatatgtaagttcagatgatgttatgaatcacttagatattattaaaagtgtcaaattagtttatggtatagatgaatttcaattagtaaaacttttagaaaaagcaattaatgtaacaaataataagattgattataatgaatttaaaaaattagctcaaaaaaattttgatagcggaattcgaagaaactttaagaaaaacaagatagtagaaacggctaaagctaaagatgacgaaaaagataagaatattgatcctttagttaatgcttttaaagcctatgttccattagaatttttagagattctaaaaaatgagttaggaagttttgtcactgctaatgaaaggtatgctgtaaaaacattggtagaaaagcagatgttaccaaatgaagttattaatgttttaattcattatttgttagttgttcaagatagttctaccatcttaaaaggaacatttgaaagaattgctgctgattggacaaagaaaaaaataaaaaacgctcaagaagcgatgacttacgttaaaagtttcactcgagaaaaatcgctacaacgcaaagcgacaaaaaaagattcaaaaggccgcaaaagtaatgtaattgttaaagagaaattacctgaatgggctaaagaaaagggaaagaataagctaacagatgttggaaagaaagaaaataaagaaattgacgagctattgaaaaaaataaatggaaagtag

SEQ ID NO: 395 - DNA, 1200 bp, Lactobacillus salivarius
  isolated from gut, Lactobacillus salivarius
gtgaatatcggaatatttacggatacttattatccgcaagtaagtggtgttgcgacctctatcaaaacgttacgagaacaattagagaaacaaggtcacacagcgtacatttttacgacaactgatcctaatgttgacaaaagtatttatgagcgtaatatttttcgcttttcaagtattccattcatttcatttacagatagacgtattgctgtaaggggactttttcatgcttatcaagtagctaaagaattaaatttagatattattcatactcaaacagaattttcgatgggattaattgggaaattcgtcgctaaaaatttgaaaattccatgcatacatacttatcatacaatgtatgaggactatctacattatgtggctaaaggaagattattaaagccttatcatgttaaacaaatgtctaaatctttttgttaccacatgtcaggaatagtagcacctagtttaagagttaaagagacattagaacgatatggaattgatgaacctattgaaataattccaactggagtagatatctctaaattttctaaaagtacaaatgaaaatattagggaaaaatataaaataaattcagagcaacctttactactaactttgagtagattggcctttgaaaaaaatatagataagttactaaatgctatgccggatattttagctagagttccagaaactaaattgatgatttgtggtgatggacctgctagggagagtttggtacaacaggtatctgatatgaatttaactgatagcgttatttttactggagaaattaacaatgatgaagtaggtagctactataaggcagctgatgttttcgtttcaacttcagtatcagagtcacaaggattgacctatatagaagcaatcgcttcaggcacaaaagtaattactactcatagtccatatacagattcaattttgacagatgcaagtataggtatgacttttacaggtgaagatgaattggttaacaaggttgttgattacttattgaatggtgaaaaatataatgattctaaaccgagagaagaattgttgaatagtatttctgcagataattttgggagaaaagttgtttctttttatgaaaaatgcatgctagattttgatatgaaaaagaaattaagatttaattctgatgagctgaacaaagcgaaaggaagataa

SEQ ID NO: 396 - DNA, 3231 bp, Lactobacillus salivarius
  isolated from gut, Lactobacillus salivarius
atgattttatgcaaattattgatcaaagaaaggaagagagaaacaatgcctaaaagaacagatgtccacaaaataatggtgattggttcaggtccaattattatcggtcaagcagcagaatttgattattctggaacacaagcttgtttggctttacgtgaagaaggatatgaagtagttttagtaaactccaatcctgctactatcatgacagatacagaaattgccgataaggtatatattgagccattaacagttgaatcagtttctcgaatcattcgtcaagaatttccagatgcaattttacctactctaggtggtcaaattggtttgaacttagcaatcgcattggctaaaactggaattttagaagaattaggaataaagcttctaggaacgcaattagatgcaattgatcaagctgaagacagacaaagattcaaagacttaatgcaagaattaaatgaaccagttccagactcaaagactgttgaaactgtgcaagaagctttagattttgcagctgaaattggatatcctgttattgttcgtcctgcatttacaatgggaggaactggtggcggattgtgtgataatcctgaacaattaaaggaaatagtagccaatggtctagaactttcaccagcaactcaatgtttgattgaaaaatcaattatgggttataaagaaattgaatttgaagtaatgagagatgctgacaataatgcgatggtagtatgttcaatggaaaactttgatccagtgggtatacatacaggtgattctatcgtgcttgctccaactcaaactttatcagatagagaatatcaaatgttgcgtaattgctctttgaaattaataagagcattgaaaattgaaggtggatgtaatgttcaattagctttggatcctaatagttatagatactatgttattgaagtaaatcctcgtgtatcacgttcatcagcattagcttctaaagcaacaggttatcctattgctaaattagcagctaagattgccgtaggattgacactggatgaaattaaaaatcctgttacaggaacaacatttgctgaatttgaacctgctcttgactatgttgttgctaagattccacgttggccatttgataaatttactcgtgcaaatcgtcgtttaggtactcaaatgaaagcaactggggaagtaatggctattggacgtagtgctcaagaagctttacaaaaagcagttcgctcattagaaattgacgaaaaagatttaatttctgctaaagcacaatctgcaactgatgatgaagtagaagaaaaattattccacgcacaagatgacagactattttatatagcagaagcatttcgtagaggttacacaattgaagaagtacacgaattaaccaagattaatttgtattacttagatattgtaaagcaaattgtagagttagaaagtgaactttctcaaaataaagaagatttggatgttttaaaacgtgcaaaacgttacggatatagtgattacacaattgctaagttatggggcactacagaagatgaagtaagaaatttacgtaaagaacataaattgttacctgtttacaagatggtagatacttgtgcagcagaatttgattcaagtacaccttatttctatagctcatatgacttagaaaatgaaagtaaaaaatctgacaaaaaatcagtgcttgtaataggttcaggtcctattagaattggccaaggtgtagaatttgactatgcaactgtacatagtgttaaggctatccaaaaattaggatatgaagcaattgtaatgaattctaatcctgaaacagtatcaacagatttctcgatttctgataaattgtatttcgaatctttaacacttgaagatgttttaaacgtgattgatttagaacaaccaatgggagtaattgtacaatttggtggacaaacagcgattaacttagctgctggattagaaacacacggtgtaaagattttaggtacaacagttgaagatctagatagagctgaagatagagaactatttgaccaaacaattaagagtttaggattgaaacaaccaattggtaaaacagcaactactcaagaacaagttattgcttgtgcagaagaaattggctatccagtattggttcgtccaagctatgttttaggtggtcgtgctatggaaattgttaataatgaacaagagttattagattatttagcacaaaatgctcctgcagaaattgatcatccaattctcgtagatgcttacttatcaggtctagaatgtgaagtagatgcgatttgtgatggtaaagatgtattacttccaggtattatggaacatattgaacatgctggcgtccacagtggtgattctatggctgtttatccacctcaaagctttgatgaaaatataaagcaacaaattgtggatgcaactgaaaagttagctgtcgcattaaagtgtgttggtattatgaatattcaatttattatccataataatgaagcatatgtgttagaagtaaatcctcgtgctagtcgaactgtaccattcttaagtaagattactggaattgaaatggcacaagttgcaacaagagtaattctaggagaatcattagcagaacaaggatatcaaagtggtttataccgtgaaagtgatatggtacatgttaaagcaccagtattctcatttagtaagttagcagatgttgatagtttcttaggacctgaaatgaagtctacaggtgaagttatgggtagtgactacacctttgaaaaagcactgtataaagcatttacaggtgctaagatggaattgccagataatggaaatgtactattgacaattgaagataaagataaggatgctgtattaccacttgctaagagatttagtaagataggttatcgtatgtttgcaactgaaggaacaagtcaatttttacgtgaaaatggtttgtttgtacaaactgtagataagttaggtaaagatactggtaatgaaacttcattacatgatctgatcgttaatgatggtgttgatttagtaatcaatactatgagtcatgatcaagaagtagcatcggatggatttgtaatccgtcaattagctatcgagcataatattgcattgctaacatcattaaatacagcagatgcattattaaaagcacttgaaaatcgttcatttgctactaactcactttaa

SEQ ID NO: 397 - DNA, 1119 bp, Lactobacillus salivarius
  isolated from gut, Lactobacillus salivarius
ttggcaaaagaaattttagaaaataaccctgcattcacaaaaactttacgtgatttaattcgtgaatataagccacaaaaacaagttaattataaggtacttacagataagttagttacaccatttaagttggatgcagatcaaatggatcaattgattggttctattgaagatagagggatttctgttgttgatgaaaatggtgaaccaagtgctcacagtttgaaggcagctacaaaagaagcagaaaaggcagaaaatgacaaagatgtttccgcaccatctggcgttaagattaatgaccctgtacgtatgtacttaaaagaaattggacgagtaaacttgttgactgctgacgaagaagtagctctagctttaaagattgaagaaggagatcaagaagctaagcaacgtttggcagaagctaacttacgtttggtagtttctattgctaagcgttatgtaggtcgtggtatgtccttcttagatttaattcaagaaggtaacatgggacttatgaaagctgttgaaaagtttgattaccgcaaaggatttaaattttcaacatatgcaacatggtggatcagacaagcaattactcgtgctatcgctgatcaagcacgtacaattcgtattccagtacacatggttgaaacaatcaataagttaattagaattcaacgccaaatgttacaagatttaggtcgtgaaccaatgcctgaagaaattggtgctgaaatggacatgccaactgaaaaggtacgtgaaatcctaaaaattgctcaagaaccagtatcattagaaactcctattggtgaagaggatgattctcacttgggagatttcattgaagatcaagatgcaacaagtccagctgaacatgcagcttatgaattgttaaaagaacaacttgaaagtgtattagacacattaacagatagagaagagaatgttttacgtctacgctttggtttagatgatggacgcacaagaacacttgaagaagtaggtaaagtgtttggtgttactcgtgaacgtatccgtcaaattgaagctaaagcattaagaaaattacgtcatccatctcgttctaagcaattaaaggacttcttagaataa

SEQ ID NO: 398 - DNA, 642 bp, Lactobacillus salivarius
  isolated from gut, Lactobacillus salivarius
atggcaaatagggaaaataaaccagtaataataggtgtaacaggtggatcaggttccggtaagacaactgttagtcgagcaatttttgaacaactacatggtcactcactattgatgttacaagaagattcttactataatgatcaaagtgacatgccctttgaagaacgcataaagacaaactacgatcatcctaatgcatttgatactgagttgttggttaaacaattaaaagatttattagattggaaaaccattgaaaaacctatttatgattatacagagcatactagaagttcagaggttgaaaaggttgagcctaaagaagtaatcattctagaaggtattttagtattgaatgatcctgctttgagagacttgatggatattaaaatctttgtagatactgacgatgatatccgtatcattagacgtattcaaagagatatcgaagaacgcggtcgctcattacaatcagttattgatcaatataaatcaactgtaaaaccaatgtaccatcaatttatcgaaccaactaagcgttatgctgatattattgtccctgaaggtggagaaaaccaagttgctattgacttgttagttactaaagttagggatattttaagaaaacgagaaaaataa

SEQ ID NO: 399 - DNA, 1287 bp, Lactobacillus salivarius
  isolated from gut, Lactobacillus salivarius
atggaaactatcaatatcggtattttaggtttaggtacagtaggtagtggtgttgttaggattttacaaagtcacgcagataaaatctcaagcattactggcagaaagttaaaggtaaaaacggtagttgtacgtgatatgactaagaaaaggacagttgatttagatggggtaaccttgactgatgattttgaaatgttgatcaatgacgattcgattcaaatggtagtggaagtaatgggaacagtagaaaaagcacgtgaatatattaagcgtcttttagaagctggcaagcacgttgttacagcaaataaagatttgattgcgacatacggcccagaacttacaaaactagccaaggaaaagaaatgtgatcttttctacgaagcaagtgtagctggtgggattccaatcttacgaacaatcgtcaattcatttgcggctgaccaaattgtatcagttaagggaattgttaatggaacgacaaactatattttgacacagatgaatcaaaataatattgcttatgaggaagcgttaaaagatgcacaagaattaggttttgcagaagcagatccaactaatgatgtcgaaggaatcgatgctgcatataagatgataattctgacacagtttgcttttggaaaagatataactttagacgatgtgaagattgaaggaatttccaagatacaattatcagatatcaaagaagctaaacgtttaggatataatattaagcttttaggtgtggcagaaaaggtcaatgaccacattactgtatcagttggacctgtattagtacctcaaactcatccattagcaactgttattaatgaaaataacgctgtttttgttacaggtgttgcagtgggtgaaacaatgttttatggtccaggtgcaggcgaacttccaactgccaacagtgtgttaagtgacattattagtgtaactaaaaatattgtaatgggaattacaggcaacagttttaatgattattcacatgagattaaactagcaactccagacgaagtgaagaatccatattatatctcattaattgttccagacaagacaggggaaatgttaaaattaacagaattgtttactaatgtagaagctagtttcaagttaattacacaaacagaagctaatgaaggctttgctaaaatctcaattgttactcatgcaatgacagaagctcagttgttgaagattgaagaaggtcttaagcaagcaaaagacgtagaacttctagcagcatataaagttttagaaaaggggtag

SEQ ID NO: 400 - DNA, 813 bp, Lactobacillus salivarius
  isolated from gut, Lactobacillus salivarius
atgtctgattctattactaatatttttgttatctctgattcagttggcgaaactggtcttagtttaattactgcaggtaccgttcaatttcctaatagtaaatttaacattcgccgttttccactaacaaaaactatttctttacttcaaggtattttgaataaggcaaaaagagaaaatgccattattttacatacttttgttaatcctgaattatctgactatgttaataattttggtaaagaaaataacttgcatgttattgatgctctaactggtgtggtccaaactttagccgagataactggagaaaaacctttaaatgcagctggattaaagcacaaactcaatccagactatttcaagcgtattgaagctcttgaatttgcagttacctatgatgatggtaaagatccatctggtttccttaaagcagatattgtacttttaggtgtttccagaacatctaaaacacctttatcactatatcttgctaaccaaggatataaggttgccaatcttccattagttcctaaaactcaaattcctaaagaaatttatcaagttgataaaaaacgtatcttcggtttgactaatgatcctgaagttttaaacaatattagacgtcaacgcatgatttcttatggtctagatccagatactgtttattcaaatatggataatattaatcaagaattagaatttgcaactaatctatataaagaattaggatgcttacaaattaatgtagcaactaagtctattgaagaaacagcaacccttattattgaaagtcttgatagtgaagattaa

SEQ ID NO: 401 - DNA, 801 bp, Lactobacillus salivarius
  isolated from gut, Lactobacillus salivarius
atgaaaaaattatttttaatagtatttacagctttttttgtcgtgctttcatttttaaatattccagtagtatctgctagttcttctcatcatcgcaaagcacatactcattggaaaaaagtaacagctcctgttagtttcccaatcttgatgtatcatagcatcgcaaatatcccgggaaatagtttatgcctacctcccgaacaatttgaacatcagatggaattattacataaggaaggatattatacccttactcctggtgaagcatatcgtgttctaacaaggcaagaggtaccagttggcaaagaaaataaaattgtttttattacttttgatgatggttataaaaacaattattcttcggcttatcctattctaaagaagttttctttacatgcaacaattggtatgattaccgacaagattaatacacctgatatgctttcaactaatgaattaaagaaattacgtaaagaaaaattggtcagtattgttagtcataccgtttcacatactgagctcaacactttaaatactgagcaacaattagtagaaatggctaactctcgtgggctactcaatcgttctctaaaacaaaataccattttacttatatatcctgttggtagatatactccagcttcgcctttcattgctcaacgtgctggatataaatttgcacttactactaaacctggattagcaaatgctagtcaaggtttatacgaacttcatcgtcaacgtgtcattcctaatatgtctgatgaaagttttaaccaattattatcaggaaattaa

SEQ ID NO: 402 - DNA, 1440 bp, Lactobacillus salivarius
  isolated from gut, Lactobacillus salivarius
atgttagatcaaaagaaacattatatgagctggccagttattgctttgctcgactttgttacaattattagttttgaaaatatattctatccttttcaaaatcaaggattatctgttgttatttcatggattttcttactttttacttatgttattccttatgcattaattgctacacaattaggtttaacttttgataatcaagatggtggtcttgcttcttggattcgtcgtggtactcatagtgatttattcggatacattacttcctggatgtattggacgcaaacaattccatacttagtggacgtttcaaactctgttattgtttctataagttggattattttaggtaataatactttaggacatcacatgtctacgtttactttcggaatgttaacttttgttattattttattattcattatcttcgaaaatgttttccgtgattccctagaagtactttccatcattggtggtggtgcgatgttcttgatttcaatgctttttgttttcatgactgtatgggcattaatacacggtgcacatattgctacacaaccatttaatcttcatgcatttaagccaaactttagtttacactacttctctacaactggtttattgatcttcgctatgtctggtgctgaattagctgctccatacattaacaagatgcgtaatcctaagcgagattttcctaaagctatgtggatgttagctttgatgactgctttcttaactatctttggtactttatcattagctgtcttctttaacgctaaccacattcctaacgactttaagatgaatggtccatactatgcattcaaacttttaggtgaacaagttggtatgggtaagagcttgatgtatgtctttgctgtagttcaattgatgtttatgttagctcaattagctattttaattgatgctgctagtcgtgtattcgctagtgatactgctgctaaatacatgcctagttggcttatcaagaagaataaagctggacgtccagtacatagttatactttaactgctggaatcagtttgttacttcttcttttaagtggtactttaccaaatatcaactccatctataactggttgttgaacttaaatggtattgtttcaccatataagacagctttagtattcgttgcattcctagctattcgttggcaagaagaacaatttaagtccgattacgtttatattaaaaatagaactggtgctttaattgttggtttctggtgcttcatcttcacctttgtctgcgcaacaatgggattcatcccacaagatgctgctcctggaactaaagcatttgatcaccaattatttatgaattttgtaactgttggattcttagttgtacttggtttcttattaccatggttacgcaagctagaattaaagagagctgcaaaaaaataa

SEQ ID NO: 403 - DNA, 948 bp, Lactobacillus salivarius
  isolated from gut, Lactobacillus salivarius
atggaagaaaaaaagttattagatttttcaataaatgaaaatatggatatttttgttttgattaaaagtgctgaagtaagagtggcgaaaaacgggaaaaagtttattgcctttaattttgctgataaatcaggtgaaataagtgctaaattctggaatgcaactgaaaaagaaatcgaagaatttaaagaaggaaaagttgtcagattaaaaggaaaaagagagaattatcaagataatccgcaaattaagatatttaatttaagaattgctacagaaaatgaacctaacaaacctgaatattatttacaaactgcaccagaatcaattaaaaaaattgaagaagaaattaataatacattttttgaaattactaatcctaaatggaatagaatagtgagatatttgctaaataaatatcatgatagtttcttttcatttcctgcggctaagaaaaatcatcatgctttttctggaggattagcatttcatacagtatctatgttgaggttagctaaagcgattgccaaggaatatgatgtattaaatgagtcattgttatatgcaggagttcttcttcatgacttggggaaagtaaaagagctatctggaccgatagcaactaaatatacactagaaggtaacatgatagggcacattgtaattgttgacgaagaaattgtaaaagcgtgtgagatattgcagatagattataatagtgaagaagtaattttgctaagacatatgatattatcacaccatggcttgttagaatatgggtcaccggtcagaccacatattatggaagctgaggtattacatcaaatcgatcaacttgatgcatcgattcaaatgatgaagagttcattaagtcatacggaatctggtgaattttctgaacgtatttttggccttgatggtcgtaatttctataaacctaaagaataa

SEQ ID NO: 404 - DNA, 1116 bp, Lactobacillus salivarius
  isolated from gut, Lactobacillus salivarius
atgaaatttttacatactgcagactggcatataggaaaaaaactacacaattttgacttaaattatgaagaagatgacgcgtttaaacaaattgaaagaattgcagaggaagaaaaggttgatgcaattattatagctggtgatttatatgatagatcattaccaagtgaagaagcagtaaaaagtgtaaatgaaaaattaaagaggctaaatctggttgataagtatcctttattagttataagtgggaaccatgattcagcaacaagattaaatactggtagtgaatggtttaaagctacaaatttatttttaaatacaaaaatttctggagcatttgaaccagtagaaatagaagacacacaattttttctcttaccatattttgaaccacaagaggtaagaaattattttgacagacaaaatttgaaaaatgttcaagaagcgatgcaacttattgtagaaaaaataaaagaaaagtttaaacctaacatgaaacatgtgttggttgcacatttttttgctgctggaagtacacaaactgattctgagactaatgttatggtcggtggtttagacgccattccaacttcttatttgaatgattttgactatgttgcgttaggacatttacatgatgcaagagcaagtcaagcggagattataaaatatagtgggtcacctgtaaaattttcagtgtcagaagcgacatcgcaaaagggtgtttggattgtagatactgaaaaaatatcacctaaattcgttccattagttccagttcatgaaataaatgtattagaagattcatttgacaatttaatttctccatcggtatatgaaaagtattccaaggaagactattatgctattagattgactgacactaaggtcattccagatgtgattaataaattaagaaattactatcctaagatcttagaattgagacgtgttggtgaaattcaagagctgaaagcagaagagaataaagaaagagatttaactgatcccatgaaattagttagtgacttttttactgaagttacaggtgagaaattaacttcaaatcagcaaaaatgggtaaaaaatgcattaaaggatgtgaataaaaaatga

SEQ ID NO: 405 - DNA, 1512 bp, Lactobacillus salivarius
  isolated from gut, Lactobacillus salivarius
atgagcattaaggctgaggaaatcagtgctctgattaaacaacaattagcaaattatcaagatgagcttactgttgatgaagttggtactgttacttatgttggtgacggaattgctcgtgctaatggtttagacaatgcgcttgctggcgaattggttgaatttgatgatggtacttacggtatggctcaaaaccttgaatctaatgatgtaggtatcattattttaggttcttttaagggaattcgtgaaggagatactgttaagcgtacaggtcgaatcatggaagttccagttggtgaagagttaattggtcgagttgtaaacccattaggacaacctattgatggtttaggtgaaattaaaacaaataaaacacgtccagttgaaagaaaagctccaggtgttatggaacgtcaatcagttacagaaccattacaaacaggtttgaaagctattgatgcgttagttccaattggtcgtggacaacgtgaattagttatcggtgatagaaagactggtaagacatcagttgctatcgatacgatcataaatcaaaaagatcaagatatgatctgtatttatgtagctattggtcaaaaggactcaacagttcgtacgtctgtagaaactttacgtaaatttggtgctatggattatacaattgttgtttctgctggtccatcatcaccagcaccattattgtacttagctccttatgctggtgctgctatgggtgaagaatttatgttcaatggtaaacatgttttgatagtatatgatgatctttcaaaacaagctgatgcttaccgtgaattatctttgattttaagaagaccacctggtcgtgaagcatatcctggtgatgttttctacttgcattcacgtttattagaacgtgctgctaagttaagtgacgaattaggtggaggatcaatgacggcattaccgtttattgaaacaaaagcaggggacgtttctgcttatattccaactaatgttatttctatcacagatggtcagattttcttagatagtgatcgtttctattcaggtattcgtccagctattgatgctggtacatctgtttcacgtgttggtggtaacgcacaagttaaagctatgaagaaagttgctggtactttacgtacagacttggcatcttatagtgaattagagtcatttgctcaatttgggtctgatttagatgaagcaacacaagcaaaattgaatcgtggacgtcgtacagttgaagtactaaaacaaccacttcataaaccacttcctgttgaaaaacaagtattgatattatatgcattaacacatggattcttagatccagttaaagttgatgatattttaccatatcaagatggtttatttgattatttcgatgcaaatcataaagatttacttgatgaaatagcaaatacaggtaaattacctgaaactgaaaaattagatgctgcaatcaaagaatatgcagctacattccaagctagcgaaaaataa

SEQ ID NO: 406 - DNA, 336 bp, Lactobacillus antri
  isolated from gut, Lactobacillus antri
atgagatatcaatataaaccacgaaaatcgtttgaacgaaacttagcttatcttgcacagcttgatgtaacaattattgatgaagtaaaagacgctatttttattctcctcgatggcgacatacttcccgataattttcatgatcacgaattagaaggaaactatattagctatcggaaatttcatcttcgtgatactcccaaagggcagcaaccaactgaaataaatgacattgtagttatctataaagtcaacaatcaagatttagtactcgttgctgttaatattggttctcataaaaaattattccatggtcgttatcataagaagcgttaa

SEQ ID NO: 407 - DNA, 1563 bp, Lactobacillus salivarius
  isolated from gut, Lactobacillus salivarius
gtgacttacttgaaaaaaacagcacagaagttattagtaggtacagtcggtgctgcaggagtacttctggcatcaagtactgccgctaatgccgattcaactactacacataaagttaagcaaaatgaaacagtttgggccttatccaagaagtatggtgtttctattcaatctattgaaaagttaaaccgtattaacagcaatcatttaattattacaggtcaaactttacaaattccttcaaaggatggctctcaaactgtaaataaaaatgataataaatctacttataccatcaagagtggtgatacattatggagaattgcccaaaataatcacatttctcttgatgagttgttatctttgaacaacttgaatgctagtgacattatctatcctggacaagttattaagttaacttcagctgctgctacaagcacatcaaatactcaacaacaagtacaagataaagcagctactgctactccagcaactgataatcaaagcagtcaagcacaagctacttctgcttccagcagttcacaagctgtttcaacagctcaaagtagctctgctgcaacaacagctgctagtccttccgtaactactccagctgcttcacaagctgctactacaagttcaagcagctctgtttctcaacaacctgctgctagctctagttctgcagttcaacaaagttcttcacaggtaactactcaaagtagttctgaagtaaaagatgacaatgctcaaaaagtacaatacacagctaaggctggcgactcattgtactctattgctcaaagttttggagtttcaattgattctcttcgttcaaataataatcttggtgccacattattaccaggacaaacattgacaattgttaaccctacaaagatacctagccaagaagaaagttcttcttctaatagtgttgctacaaataatactgcagctactaattcagttgctcaaagtagttcacaacaatctgttgcaaataattctgttgcccaaacaagcagcagtcaacaacaaactgtaactactccagcagcatcaagtagttctgctgctagctccagttctgttgctcaaacaaacaatactcaacaagcaactacaactaatactgcagctacaaacaacaacgctacaacagttaatacttctaacataactacaacaactaatactggttctgcttcagctagtgcaatcattagttacgcacaatcattcattggtgttccttacgtttggggtggatctacaccatctggttttgactgctctggcttagtacaatacgtatacgcacactatggtgttaacttacctcgtgtaacaacagctcaagaaaacgctggtacagttatccctgtatctgctgctcaaccaggagatctatacttctggggtgctaaaggttcttcctaccacgttgcaatcgcaactggtggtggtagctttatccatgctccagaacctggtgaaagtgtaaaagttggtagcactcaatacttccaaccatctttcgcagttcgtgtgcttcaataa

SEQ ID NO: 408 - DNA, 699 bp, Lactobacillus salivarius
  isolated from gut, Lactobacillus salivarius
atgattgaaggattacaagaaatgttaaaaagagattttaacatcacttttaaagatgtagacttattggatgcggcatttactcatgcatcgtatgtaaatgaaactccagaaagaaagaaaaagttaaaatattatgaaagaatagaatttttgggtgatgctgtaatgcagttatgcgtgtccgaatatatttatgaacattatccagaaatgcctgaaggaaaaatgtcaagactaagggcggctatggtaagagctgatagttttagtaaatttgctattgaatgccatttcaatgagtatattagattaggtaaaggtgaagaaaaaggaaatgctcgtcagcgtccaagtttgttatgtgatatttttgaatcatttataggtgccttatatttagatcaaggaaaagatgaagttgtaagatttatttctaaggttatttttccaaaattagaattgggttggtttgatcatatgatggataataagactgaattacaggaagtcttgcaacaaaacggggaatgtaaaattaaatataatgaagttaatgttacaggtccggataatgaacgtgtctatacaatgaatgtagttgttaataatgaagtcatgggcgaaggtactggacgtactaaaaaggctgccgaacagatggcagcatatcaagctttaaagaaactcagaaagtag

SEQ ID NO: 409 - DNA, 1413 bp, Lactobacillus salivarius
  isolated from gut, Lactobacillus salivarius
tttaatattttatgtcataaaaagttacatatatctaaaaatgaagttgattttatttgttttgatgttataatttttgacatcaaaggcataggagggctttttatgattaatcaggcaaacacagcttttgttctcatttcgacaatattggtattttttatgacccccggtttggcatttttctatggaggattggtttctaaaaagaatgtcgttaataccatgttttctgtttttgttattagtggtttagcgattctactctttgtttctgtaggttatgtaatttgctttggaaaagatgtatctgggatatttggttggggacatagtttctttctaagcagatatgaattaacgaagatgtattctaaaagtttaggtattgataatggtacatatctagtatttcaaatgatgttttcgattattacaccagcactttttgttggagctgttgttgggagaatgagatttaactttttaattttatttgtatcgttatggtcgatttttgtatattatccaatggtacatatggtttggagtcctaatggtttattaggaaaaattgggatgctagattttgctggtggaacagttgtacatattaatgcaggtataactgcattggtgctatctatatttttagggcctagaattaaatataatattgaaaacagcgaacactacaatttaccttgggtattacttggaacaagtatactttggataggatggtatggttttaacgttggttcagctttaggaatagataaagtggcaattcaagctttcttaacaactacggtttccactggtgcttccttaatagcgtggatgatattggatcttaaatttcattccaaaccatcgttagtaggaatttgtacaggagcattatgtggtttagttgggataaccccggcagcagcatatgtttcaactttaggagcaatcataataggagttttgtgcagtattgtaagttttatttttgtagaaaaaataaagcccaaactaaaatatgatgatcctctagatgcttttggatgtcatggaatttcaggaattttaggttcgattttaacaggcgtgtttgcaaataaagcaataaactcaaacatttctgagagtggattattatatggtggggtgcacttgtttttaattcaagttttaggaactgtttgtacaattatttttgtaatcattttatctacgattttagtagtttgttgtaaaaaattagttaaaatgagagttacaagtgaagaagaattgattggtttagataaagttgaacataatgaaaaagtagattcttatgtgaagagtgatgcctctgatgttaggaaatatcgtgccgaatttagagggcaattatctaagtttgaaaaaagaagataa

SEQ ID NO: 410 - DNA, 3003 bp, Lactobacillus salivarius
  isolated from gut, Lactobacillus salivarius
ttggatttggagagagatattgaagaaaaattgatcaaccgcttaactcaaggtgtcagtcagtggacaagaagagatgatataaaaactgttagtcaattatgggataacttttttaagatactttctaaaaataataaagctcagttacatgatcacccattaactgaaaatgaaaaaaatacaattcgtacacagattacaaaacctaatttttatcaagcagctaagtttatggtaggggcaaatcgtcaagttaaattccatttaaaacgtgaagattcgactttacctgatgctgacttgactattttagataatacaaatatagctggtggaatttctgtttatgaagttgttcatcagattcaattagcaagaaagtttgaattagatcaagatcgacgttcagatataactttgctaattaatggtttgccaatgatacatattgaattaaagaaacctagtgaatcaattattaaggcctttaatcaaattcaaaagtatattaatgaagcaaaatttacagatattttttgcttcataaaaatgtttgttgtaagtaataagacaattacacgatacatttctgcagggcaaagtttgcgtgaaaaatttttaactgcttgggtagatgataagaatcaacgtgttgataattatctagattttgctagagaagtcttgtcgataccacaagcacatcatatgttagctgattacacagtgttagataatcaagccaaaaatattattctattgcgtccttatcagattcatgctatcaaagctatttttaaggcttcacgtgaacaaaaatctggttatatttggcatacaacaggttcgggtaagaccttaacttcatataaggtagctagaaatttactgcaaataccttccatacaaaaaacggtattcttgattgaccgccaagacttggatgtacagacagtaagtgcatttgaagcttatgcttataatgacacgattaatgttgatgatactgacaatagctatgatttggctaaccaattaattgataatgagaaaaaagttattgttacaactagacaaaagttacaagcaattttcagaagaattgatgaacaaaaagataacttatcaaagaaatatttaaaactgaaagatgtaaaactagcttttgtagtagatgaatgtcatcgtgcagttacaccgtcacaaaagagagaattggataagttctttaataaatcacctttgtggtatggatttacaggaactccaattatggataaaaatgcgcgtgctgaaaatggcaatgatgctagaactacaaaagaactttatggagatctattacacacttatacgattaaaaatgcgatagcagataatgcggtgttaggattccaaattactaatattggtcaagaaaacgttgaagatgaagaaaatactgaaaaatgggataagctttaccttaaggatgtacatatgaaggctgttgttaagaagattttaaatttagcttatgttaagcaaggactaaaagatggtaatcgatacgctgctatttttacaacttcatcaattaaacaagctcaaaaatattatcacatatttagagacatcgctaatggcgaaagtgagataaaagttcctaaggtaattaaagaaaaagcagtagattttccaagagtagcgataacttattcaaattcgcaaaatgagaatgattcaaaggataaccaagatgacatgaaagtttcacttaaagattacaatgcaatgtttgggactaactttgagatggggcaaattgatgcttataaccgaaatgttaacgatagacttgcacgaaagtctaagcagtatcaagctccaagccagcaattagacattgttattgtagttgatagacttttgacaggttttgattcaccaacgttatcaacgttatatattgatagacgaccaatgaatccacaaaatatgattcaagctttttcacgtactaatcgaatttacgataatactaagcaatggggacagattgttactttccaatatccagaaacttataaaaagaaaattgatgaagctattcaactttattcaaacggagctgccacatctgatataactgcgccagtttggacagaatctcggaagaaatatattgcagcacgaaatggaataaatcaatatttactagacaaaaaagcattagacagaatagttgatgcaccaattgaagaaatgaaagcttttgctaaagattttcaaaaattcgacaaggcatttatggcaattcaaacttatgatgaatattacaatcaagatgaattaccagaaaaagaaagaatatctataccagcattaactgatgaagaattagagcatctacagggtgtttattctaatgttattgaaaagataaaaaaacgtgacagagatgaacctgatccggaatttgactgggaatatgaattaacccccatctacaataataagatagatgaacgctatattactaatctaattcaaaatgtggtatctgatactaacgaaagtgaactattccttaatgaaaaagatgtcgaagaaatcgatgaaactatcgataatttagaaaagataaacaaaccaaaagcagatataatcagaagtttatgggataaagttaagcaaaatccgcaagaatatgctggaacttcgattagtcaattagtagaagatttgattaacaaggaaaaccatcgtttgatgcaagaatttgctgataaatacaaagtggattataacgatctacgttatgtaattaacaactatgtttctgatggggacagtactcgtcaaaaaggtatggcagaaatgattgataaggaagcttacgagaaatttagggatgcatatccaaatgcagagtcattgttaaagtggaaacatagaatgcgtcaagaagtagatactttctacacagacaaaataagaccactaatgtatacagaataa

SEQ ID NO: 411 - DNA, 3639 bp, Lactobacillus salivarius
  isolated from gut, Lactobacillus salivarius
atgcagatcggtcttgcttcttccgataagatccgtagttggtcttatggcgaagtaaagaaacctgaaactattaactaccgtacattgaaaccagaaaaagatggcttgtttgatgaacgtatttttggacctactaaggactgggaatgtgcctgtggtaagtacaaacgtatccgttataaaggtgttgtttgtgatcgctgtggggttgaagttactcgttcaaaagtacgtcgtgaacgtatgggtcatatcgaattagcagctcctgttacacatatttggtactttaaaggtattccaagtcgtatgggtcttgtcttagatatgagtccacgtgcattggaagaaattatctactttgcatcttatgtagttacagatgcaggtgatacagcacttgaaaagaaacaactcttaactgaaggcgaatatcgtgaaaaacgtgaagaatatggtgatggctttaaggcagcaatgggtgctgaagctattagaactttactaagagatgtagatcttgaaaaagaatgtgctgaattaaaagaagaattacgcgaagctacaggtcaaaaacgtactcgtgcagttcgtcgcttagatattttagaagcatttttgaactctggaaatcgtcctgattggatggttatggatgcaatcccagttattccacctgatcttcgtccaatggttcaattagaaggtggacgctttgcaacttctgacttgaatgatttatatcgtcgagttatcaaccgtaacaatcgtttgaagcgtttattagatttgaatgctcctggaattattgttcaaaacgaaaagcgtatgttgcaagaagctgttgatgctttaattgataacggtcgtcgtggtcgcccagttactggtcctggtaaccgtccacttaagtcattgtcacacatgttgaaaggtaagcaaggtcgtttccgtcaaaacttacttggtaagcgtgttgactattctggtcgttcagttattgatgtaggtcctaagttgaagttaaaccaaatgggtattcctcatgaaatggctttggaattgttcaaaccattcatgatgagagaattggttaagcgtgaaatggcatctaacattaagaatgctaagcgtaagattgaacgccgcgatgaagatatttgggatgttttagatgatgttatcaaggaacacccagttctactaaaccgtgcccctacgcttcaccgtttaggtatccaagctttcgaaccagtattggttaacggtaaagctatgcgtctccatccattggcttgtgaagcttacaatgccgactttgacggggaccaaatggctattcacgttcctttatcagatgaagctcaagctgaagctcgtttattgatgttagctgctcatcatatcttagctccaaaagatggtaaaccaatcatttcaccatctcaagatatgacaatcggtaattactacatcacacttgaagaagctggtcgtgaaggcgaaggtatggtatttaaggatgttaacgaagtaagaacagcttaccaaaacgggtatgtacatttgcatacaagaattggtttgcaagcttcttcattagctaagttaggtacaccatttactgattggcaaaaagaacgtattttaataactacagctggtaaagcaatctttaatgaaattctacctgctgatttcccattcttaaacgagcctacacaagaaaacttaacaggaatgactcctgataagtactttgtagaaccaggaacagatattaaggaattcattaagaatcaacctttagtaggaccatttaaatctggattcttatcagatattatcgctcaagtttataaagagtataaagtaactgcaactgcagaattacttgaccgcatgaaagatttaggttattacgaatctactaaatcaggtttaactgttggtatcgctgacgttactgttttgaaagaaaagccagaaattattgaacaagcacacaagaatgttgcaactgttgctaagcaattccgtcgtggtttgattacagatgaagaacgctacaatcgtgttatctctatctggaacaaagcaaaagatgatattcaagctaaattggttgaaaacatggatccatctaacccaattcaaatgatgagtgattcaggtgctcgtggtaatatttctaactttacacagttatctggtatgcgtggtttgatggctgctcctaacggtaagacaatggaattacctgttatttcaaacttccgtgaaggactttctgttttggaaatgttcttgtcctctcacggtgctcgtaaaggtatgacggatacagctttgaagactgctaactctggttacttgactcgtcgtttagtagacgttgctcaagatgttatcattcgtgaagaagactgtcatacagatagaggtttggatgttactgctattactgaaggtaatgaaatgattgaaccattatatgatcgtattttgggtcgttatactatgaaagaagttaaagatcctaatactggtgaaattattgttccagctaatgtattagtagaagaatccgaagctcgtaagattgttgatgctggtgtacaaaaagttactattcgttctgcattcacatgtaacacacgtcacggtgtttgtgaacgttgttatggacgtaacttagctactggtgatgaagttgaagttggtgaagcagtaggtaccgttgctgctcaatcaattggtgaaccaggtacacagttaacaatgagaaacttccaccaaggtggggttgctggtggcgacgatattactcaaggtcttcctcgtgttcaagaattatttgaagcacgtaatcctaaaggtcgtgcagtaattacagaagttactggtgttgttgatacagttgaagaaaatcctgctgaacgtacaaaagaagttactgttaaaggtgaaacagatactagaacatatagcttgccatttacttccgttcttaaagttaaggaaggcgatcaagttcatcgtggtgatgcattgactgtaggttctattgatcctaaggaacttatcaaggttcgtgatgttttatctacagaaaattacattttacgtgaagttcaaaaagtataccgtatgcaaggtgtagatatttcagataagcatattgaaatcatgactcgtcaaatgttacgtaaagtacgtattatggatccaggtgatacagatatgcttccaggaactctattggatattagccaattcaaagatcgcaatacaagtgcaatcattgaaggtagaattcctgctactgcacgtccagttcttcttggtattactaaagctgctcttgaaacaaacagtttcttatctgctgcttcattccaagaaacaacacgtgtattgacagatgctgcaattcgcggtaagaacgatccacttgttggtttgaaagaaaatgttattattggtaagacaattcctgcaggtacaggtatgaagaagtatcatgatatcgaaccagaagttgttaatagcaatgtaacagatggtgtttattcaatctctgaattagaagaaaagattaatgaacaacaaaataatgttgaatcttcaaactag

SEQ ID NO: 412 - DNA, 1143 bp, Lactobacillus salivarius
  isolated from gut, Lactobacillus salivarius
atgaaatttgaaacaaaattaattcatggcggacaaagtgaagatcaagcaacaggagcagtatcaatccctgtatatcgttcatcaacattccatcaatatgagttgggtggtaatcctaagtgggaatacagtcgtacaggaaatcctacacgtgcagccttagaagcgttgattgctgatttggaaggtggggtagctggatttgcctttgcttcaggttcagcagcaattcatgctacattctctatgtattcagctcatgatcattttatcgtaggaagcgacgtttatggtggaactttccgtttgataaataaagtgttgaaacgatttggtttagaatttacagttgttgatatgcaagatttggcagcagttgaaaatgcaattcaagataacacagtggcaatctactttgaaacaccaacaaatcctttgttacagattgcagatattgcagctattacaaagattgctaagaaacataagttaaagacaatcgttgataatactttcgcaactccatacaatcaaagaccacttgaattaggtgctgatattgtggtccattcggctactaaatatttaggtggacatagcgatgtagtagcaggtttagcagttactagtgatgaaaaaattgcagaaaaactagcatttctacaaaattcaatcggtagtacattaggaccagatgatagctggttgattcaaagaggaattaagacattaggtgctagaatgagagttcatcatgctaataccgaagctataattaagtttttagaaaatgatgatcgcgttgcaagaattctttaccctggtttacctgatttttctggctatgaagtagctaaaaaacaaatggatcattttggagcgatgatttcttttgaattacaagaaggattagatactaaaaagtttgttgaaagtttgaaagtaatttctcttgcagaaagtctaggtgggattgaaagtttaattgaagttccatcagtaatgacacatggttcaattcctagagaaattcgtttagaaaatggaattaaagatgaattgattcgtttgtcagtaggaattgaagatgaagaagacttgattaacgatttgaaacaagctttggataagattggataa

SEQ ID NO: 413 - DNA, 705 bp, Lactobacillus salivarius
  isolated from gut, Lactobacillus salivarius
atggcaaaacttgacgctcatgatattattagaacaatagctgaatcaaaaaagaagacgccagttaaggtttatgtaaaaggagatttaaattctttagacgtaccttcaaatgttgaaacatattttactaataatgttggtattatgtttggtgattgggcagatgtagaacctatcttgaaggattcctctgttgaaagttatcatctagaaaatgatggtcgaaatactggggtagcgatggtagataagaagaaattcaatgcaagaattgaaccaggcgcaattatccgtgaccaagttgaaattggtgataatgctgttgttatgatgggagctgtaatcaatattggcgctgaaataggtgaaggctcaatgatagacatgggagctgtattaggtggtcgtgcgattgtcggcaagaactgtcatatcggtgctggaacagtgttagcaggtgtggtagaaccaccttctgcacaaccagttgtaattgaagatgatgttttaatcggagctaatgcagtagtccttgaaggtgtacgtgttggtaaaggtgcagtggtaggtgctggcgctgttgttactaaagatgtagaaccttacactgtagttatgggaatgcctgctaagaaagttaaagatgtttcccaagtggatgattctaaaactgaaattgttgatgacttacgtaaattataa

SEQ ID NO: 414 - DNA, 1461 bp, Lactobacillus salivarius
  isolated from gut, Lactobacillus salivarius
atgatagaaaaatttaggaaaaatatttctccgcccctactagcctgcgttttagcagcagtgatagtggggtatttgttatttgtatctccaattaatggatatgcagataacggggattttgccagggtaatttatattaatggaatctacccattagatacgaagaattaccagtatacaacttatttaacgcaacattatgggttatttaaatactacaatgaacacattgcgatgctattttcctcacaggggatttttgtaaaaacagcagtattgttaaataagttattctacagcaaaacagtgtttgatattaggtttatgggattagtttattatgtcttttatttaggggcaatttacttactgactctagctgtaacaaactcaaataggcgcaaaaatgtagattatgtaatagcgttaattgtagtttttatgtttgctgattcatcgctaacactgtattttaactcttttttcgctgaaccagttatgataatagcaatgatgtatattacagcttctttattattactgatgaaaaaacattttgctcgtagttggtatatgctagcagtgtattttttggcatcattagcattggtaactgttaaacagcaaaatgcaccattagcattgagtttagttgtagttacaatcggaatttattttgtgtatagaaataaattgtctagattactaattccaatttcttgtttaatcttattgggatcagggattgcgacttatgtaatgattacagatcaatttagtaatattaatagttatcaatcaatgactcgaggagtaatgttaaaagaacaagatccgggtaattctctagaaaagggtggaatatctcgtcaatatggattgttgaaagaggatatttatacccaaacttatgccgcaacatctattaagtctaaaaacataaccaaggattttattccaaaatataattttgcttggattttgaaatattatctaacacatgagcaacaatttaatgaaatgttagacgtagctgcacgtgatggttacctagtacaaattaaagcggtcggtgattttactaaaaaatctggtgcaaaaccgcatcaacaagtgcaatactttactttatatggagcgatgatgaaggctttcttccctaaaaagtttgctttctatatgacattatgtgtagttttagttgctttatatatagtaatttttgttattagcgtaaaaagtaatgaaatggaatctgcaatcaaagtttttatggtaattggatatacaacaatggtaatagggacctttattacagcggttgttggtgacggtgatgctgatttagctaagcatttattaatggtacctttatcattaaactttattttcttgcagataatttcagatgtcttacatcataatttttggcatccttcgagggagggtgaatattga

SEQ ID NO: 415 - DNA, 1485 bp, Lactobacillus salivarius
  isolated from gut, Lactobacillus salivarius
atgtccaaatgggatactaaatttgttaaaaaaggatatacattcgatgacgtactattaattccggctgaaagccatgtcttacctaatgaagttgatttaagtgttcaacttgcgaaaaacatcaaattaaatatccctatcattagtgcgggaatggatacagttacagaatctgcaatggcaatcgcaatggctcgccaaggtggattaggtgttattcataagaatatgacaattgaacgtcaagctgatgaagttcgtaaagtaaaacgttctgaatcaggtgttattattgatccattcttcttgactcctgataataaggtttttgaagcagaagcacttatgcacaaatatcgtattagtggtgttccaatcgttgaaaatgctgaaaaccgtaaattctgtggtatcattacaaaccgtgatttacgctttgttactgatagcaaggttaaaatcgacgatgtaatgactaaagaaaacttaattactgctccagaaggaacatctttagaaaaagcagaagaaattttacaacaatataagattgaaaaattaccaatggttaatgaagaaggtcaattaactggattaattacaatcaaagatattgaaaaagtagtagaatttccacatgctgctaaagatgaacacggacgtttgttagtagctgcagctgttggggttacaagtgatacttttgaacgtgcagaagctcttttaaatgcaggtgcagacgcattagttattgatacagctcatggacattcagctggtgtattacgtaagattaaagaaattcgtgaacatttcccagaagcaactttgattgctggtaatgttgcaactgcagaagcaacaaaggcattgtatgatgctggtgttgatgtagttaaagtaggtattggaccaggttctatttgtacaacacgtgttgtagctggtgtaggtgttcctcaaattactgcaatttatgatgctgcaggtgttgctcgtgaatacggtaagacaatcatcgctgatggtggtattaagtactctggtgacattgtaaaggcaattgctgctggtggtaatgctgtaatgttaggttcaatgttagctggtacagacgaagcacctggtgaaacagaaatttaccaaggacgtcgctttaagacatatcgtggaatgggtagcttgggtgctatggactctacacatggttcttctgaccgctacttccaaagtggtgttaacgaagctaataagcttgttccagaaggtattgaaggacgtgttgcatataaaggtagcgtagcagatattgtataccaaatggacggtggacttcgtgcaggtatgggttattgtggtgctcctgatttagcaacacttacaaatgaagctcaatttgtacaaattacaggtgctggtttagttgaatcacatccacatgatgtacaaattactaaagaagctcctaactattctaaataa

SEQ ID NO: 416 - DNA, 3561 bp, Unknownn
  isolated from gut, unidentified
atgcttagcaagaataatcattatggcaaacaacttgctaatactccacatacacctcgctacgctcttagaaggcttaaagttggacttgtttcagtcgctcttggaactgtctttttctttacaccacaagctctagctgatacaactagtggagttgatacgagtacagacccttctacattaaccactactaatgcagctgaaaatcacacaactaatgctttgagtagtgctaatgctgccaacaaagtcagtttaactaatactacttcaaagaatacagtccaggcatcttctacttccaataacactgaaactgttacaaatatatccacgccgactactacaagtggaacagaaaacaatactgctaatactcaaagtagcaacaccaatgctatcgaaaataacacagctaccgatactacaataaaagctaataatagtaaggttcaatcgaagctacaagctactccaagtaatactagtgcttcaatcagtgataacaacactaatcaagtaacactttctcatggtcaagcacaaggacaacgtgtcgttaatattactactgacgctactagtggggacacttttacaattgaagtaccttacatttttacagccacaaacaatgctaatggagatctcttctctgcagagacgaaacttactcccgtaaataatcctgcttttatttcgagcaaaccgctctttaatactacttttatttatcatattaaaaatgttaatggaaatatttcatttaacgtcaatttattaccacagttacgtgactgggctctattaaaacccggtcaagtattcaaattaacagtagctcgcaataatcaacaggtaggcgatatcacttacacaattggcccacaacctttaataaatgatgtaacgattacctttgatcataatcaaagcaacaacttacttcctaaccagacatatatggtaggaattggactacctaatgatggagtaaatgacggcgataacttcactggaacaattaaggttgatgttccagatggatttgtctttgattctagccgttctaatggcgtggttaccggttctaatattggtgacgatttaggtatgtttaatactttaggttcgatggaagggatatccatcagtcaagaagctgctggaaaacctattatcattgaatataaccgtacaaaatctgaattaggtaaaggattcatccttctttacggtcactacactaagaatattgatgctagtcaaaacactttcacagctacagtaacagcaacaacaactaatgcagatggcgataaagcaaactatgatggatcaattcaaacaattaccaagagtcgtaatattagtatgccagtagaaaatccggctcgaaattctctcgactcttcatttgctattggggaaaacaatatttatcgtgaccaggtcaatccagatggtagtcatagatctgatgatccaaagttaacatatggggcacaacgtcggattgaaattatcaataatggaaaccaaactcaacaagatgttactacccatatcaatctagaacctggaacagtacttgttaagttaagtaatggaaaatatggattgctactaaattcttcagatatcaacaaaccaaagtcaatagtagctactctcgaggacggaagaaaagtaaatattcctattaatatctctactttcagcgatggtcgtagtattggctatgctgcactaattacttctgacttagttaattcaggagtaaatgcagacggaacaaatattacttctcttgatgttacctatacttcactggaaccaggaacaaaattagaaatttcttttggaaataacggtttgatttctgacaagaaacctggagaagttgctacttactcctatacagtaacctctgctaatggagctagtcataacggagttcaatctattccgattgccgatccaaaggggtttcaatatcaatttactggttggattaactttgctggtggcgattaccaacccaacagtgaaaatggtggaaatattgccaaaatttcctatactcttcaacacgttaattattcagatgaagcaagttcttacctaattgaaattcctagaggattcactgttaacccaagtgatcttcatctctttcaaaataataaagaagtaaaagatggaaagattgaatatttagggactgttggagaacacggggaacaaacttttgttatttctctcccattcatgcccttttacggaattccagtttatgtgaaggatgctaataaccaagacttaaccataacggcaacacctaaccaagcacctgcgaactactcatatgctccaactttggttgatactaatcctttaattgctgaaattgtaacagataagaataaatttactccagtttcataccaagcgttccatactattactcgtggtaatcagacctttactattcttaatatgcctggtttcggcccaaactgggttaactattcttttagttatgcttcaacttatagtagttttgattcaattcgttctaatggcgattatattcaagctggtgacagcttaactaatccacctaaattaaactatattcaaaacggccaagtggataacaccaacggaagtcttaaacttaatacttatttatctgatcttggaaaatctgattgcagttataacctagtaaatttaccagacgttgcacttggggataatacaactatttcacttactggacaaggaacaatcagtgaaaataggaacggagaaaatgtacagcttctttactctacgaaacatattaacaaaactgaagctctcactgaagatgacttcaaagactttataactgctgataaagttacagattggtctgctattaaaactgtactcctaaaagctggtactcttactagtccaggaaatatcactgctgaattgccgttcaaagttactgagatgaaagatggagagattaatactaacgtaatcttcaacactaacttcactggttttcataatgcaattactcatagtaatccacaactagcacttaatgtgcaacgttatatcaacgttactaccaaatgggtagacgatgatactgatcaagagctagctccaagtactacccaaatggtacgctctggcgatacttaccaaactatcgctaagccagctgatcttaatccaaattatcgtcttgaacgtgtagaaggaaatcaatatggagttactggtgctaatgatcttattgttacttaccattacaaggctctaacagatgactcgttaaaagaaagcaaatccataactagaactattaactatgtggttaatgatggtcaagtccaagctccagatacggtagtccaagctgttactctcattcgccatggaagtaagaacttggtaactggtaatataacttggggacaatggagtgatgatcaatggaatgaagttgtttctaaaacagttaaggatatcacccagataaagaatctgtag

SEQ ID NO: 417 - DNA, 432 bp, Lactobacillus salivarius
  isolated from gut, Lactobacillus salivarius
atgactttggttaaggaagcaatcagtattttaaaagagcataatttaaaaataaccaaacaacgacaagctttactggaatatttgagtaattatcagcatcgatatgtggatattacacaggtagataaatatatgcatactctttttccaggaatgagtcataatacaatctatcgtaatataaaagattttgataatttagggatcattgagactcaagagaaaccatcaggagcttgtgtaaaatatcaatgtgattttggaaatttgcatcatcatcattttatttgtgagaagtgtgggaaagttgaagaaattaatctttgtcctctagatgatttattacagactcaacttcctggatatcaaattgatggacatagatttgaagtatatggtgtatgcgacaaatgtcgtaaagactcttag

SEQ ID NO: 418 - DNA, 2442 bp, Lactobacillus salivarius
  isolated from gut, Lactobacillus salivarius
atggtaataaatattctaaaagaaaggatcgttattatgaaattcaatcaattcgctcatgtcaaagttccttttgaacaaaaattagcagaactcaatcgtattgcttttcttcacgctggtgatgaagatttagctagcaatcatatttatcgcttatttttggagcgtgctttcccaaatttcaaaactgaaacagctaaaaatcacgctctttccaatctagcagctactgagaatgctgatattttaacttatttaaactctagtaaaataaatgcccgcgttttctatgctgttggattacaactcttaggatttgaagctgagcttgattttgatttaaaagatccattttctgcaatggataagctaaacttgccataccaaaaagaaataaatcatcgcgatgatgttattaatgcttggtatgatttactatgtacttcaactaaaaagggacaaaatttactcgatattctagctaatcgtggatatttcacacaattctaccaattgaatctgacagaaccaattttctttaacggaaaggctcaacctgtttttgatacaaataaacttatccatgaagtagtctatgttgaatcagaattagataccgatcaagatggcaagcgtgatttgctaaaagttatcattactcgtccagcaatgactgataatggtatgaaagtccctactattttcacagctagtccctactatttaggaactaatgatgctagtgctgagaaaatgatgcacagtgtcgacttaccaattaagcgtaaggaagttaagcctctttcttatcaggatattgaataccataagccagaaactaaacttcctaagaaacgtcctgttgtgatctctactaaaaatgctgaagaaagttgggaacacttatttacatatacttttaacgattacatgttagctcgtggatttgctgttgtttattctggtggagttggaactctggattctgatggctaccgtacttgtggcgatgaagctgaaactctaggagctaaagatgtagttgaatggttaaacggaaagagaacagccttcacaactaaagaagctaataaggctattccagcttggtggtcaaatggaaaagtagcgataactgggaaatcatatctaggaacacttgccacagctactgctactactggtgtagaaggattagagactatcattagtgaagctgctatttctagctggtacgactactatcgcgaaggtggccttgttattgcacctggtggatttcctggagaagatgccgacatcttagctgaagaatgttttagccgtcaaaaaagtgctggtgactataatcgtgctaaagatggttttaacaaattcctatcaactattactaaagaccaagatcgcactactggtaattacaatactttctgggatgcacgtaactatttaaaagatgtgggtaacattaagtgtgacattgtgatggttcatggtctcaatgactggaatgttaagttaaagaatgtatttaacttatataacaagctcagtgatgttgaagtaacgaagaaacttatcttacatcaaggtcaacatatctatatcaacaatttccaatcacttgatttcacagatatgatgaatctttggttaagtcataaattgtatggtgttgagaataatgctaaagaattactcccagatatcttagttcaaaataatactaaagaaagtacatgggaaacttattctagttggcaaagtaagaattttactaagttatacttaaattctgattctctctctgcacaaaaaaaagaaaaacaaattttagaatttagtgatcatttgccagaagctacatttaaacactatcaagcaaatattaatagttggaaagaagatattcttgcaccaactagtccaaaacttgaaaataatcgtttaatcatcactagcgaacctttaaatcatgaaactttacttaaaggtgtcgctaaaatcaaattaaagatcgctagtcaacttgatcatggcttggtcagtgttaagttggttgattatggcgatgctaagcgtctaggagctactcctacaattcttgaaagacgtggtttagacttaggttatcattggcaagaagataatttagtagaatttaaattagccaagaaaacaccatttaagatgattacacaagctcacttgaacttacaaaatcgtcataatgactttagtacagatgaacttgaagctaataagttctatgatgttgaaattactacacaacctatgttctatcatcttcctaagggacataagttaggcctagtaatctatgcaactgatatggaaatgaccttacaaggcaatgaagaaaattcatatcgcattgatactgccggctcatattgcttacttgtaagtactttataa

SEQ ID NO: 419 - DNA, 501 bp, Lactobacillus salivarius
  isolated from gut, Lactobacillus salivarius
gtggataatgtaagaattaggttaataactgaagctgatagtggagaattatatcaattgattgtggataatcgtaataatttggaaaagtggattgagtggataagagatattcacaatgaagatgagatgcatacatatattcaaagaattatccacactgaacgtaaagaagcaacaataacttttgtaattttactgaatgaaaaagttattggaatggcagatattagcgatatatcaccagatggcaaaatgggtgaggttggactttggctaagtgaagagtatcagggaaaaggaattgcaggtgctgttataagtgagattgaaaagtactctaaatcaaaaacaaagataaatactctgaaaatgttaattaaagctaataatgttaatagtttgaaaatggcacataaattaggatatcaagaggttgaaaaattaacatcttggaaaaacggagaagttaaatggatagtatgtgctaaaaaattctaa

SEQ ID NO: 420 - DNA, 597 bp, Lactobacillus salivarius
  isolated from gut, Lactobacillus salivarius
atgattaaaacgtctgatgaatttcaaaggatttttgaagagataaagctagatcctcaaaatcaagaatacactgaaaaggggattgaacctttatattatgctaatcctaaggctaaaatattaatagtgggtcaagcacctggacaaaaagctcaagatacgcatatggtctggaatgatttgagtggagataggttgaggacatggttaaatgtgtctcgcgatgaattttataattcaggtttgtttgcgattatgccaatggatttttattttccaggaaaaggtaagggtggagatttgccaccacgaaagaattttgcagcaaagtggcatccaaagttaagaaagttaatgccaaatattgaattaactattttggtaggtagctacgctgttaagaaatatttgaatctaaaaagtagtgctaaattaactgatattgtaaaagattatcaaacgtatctgccagagtactttcctttggtacatccttcacctaggaatttaatttggttaaagaaaaatccatggtttgaggaacaagtagtgaaagacttacagaaattagtatctgaaattaaaaataaataa

SEQ ID NO: 421 - DNA, 1677 bp, Lactobacillus salivarius
  isolated from gut, Lactobacillus salivarius
atgaaaaaactaaatgttaaaaataatgagactgctgtttttgcaatcggtggtcttggagaaattggaaagaatacttacggtatccaatttcaagatgaaatcatcgtagtggatgctggtatcaaatttccagaagatgatttgttaggtattgattatgttatacctgactactcatatttaattgcaaatcaacaaaaaattaaagctttagttatcacacatggacatgaggatcatattggcggtattccttatttactacaaaaaataaatgtacctgtctatgctggccctcttgcacttgcattgattaaaagcaaactagaagaacatggactacttcgcacaactgaacttcatgaaatagatgaagactctattctaaaatttagaaaaacgacagtatctttttttagaacaacacattctatccctgatactttaggtgtggctgtcaaaacaccttctggaacaattgtatgtacaggagattataagttcgatcttactcctgttacaaatcagccacctaatttacaaaaaatggcaaaattaggtgatgaaggtgtgctttgcctactttctgatagtactaatgctgaagttcctaactttactaagtcagaacgctgggttggccgttctattcgtcgtatatttgaaaaagtcgaaggccgtataatatttgctacttttgcctctaacatttcgcgtgtacagcaagctacatctgcagctattgctcgtggtcgtaaaatagctgtttttggacgtagtatggaagctgcaattgtaaatggtagagaacttggttatttagatatccctgacgatgctttagttgatgctagagaaataagtagtttacccgctaataaaattatgattctatgtacaggatctcaaggagaacctatggcagctttgagtcgtatagctaatggtactcaccgtcaagtatctattcaacccggtgatactgtagtattctctagttctcctattccaggaaatactaccagtgtaaataaagttattaatgagttagaagaagctggagctactgttattcatggtaaagttaataatattcacgcctctggacatggcggtcaagaagaacaaaaacttatgcttcgcttgatgaaacctaagtacttcatgcctgtccatggtgaatacagaatgttaaaaattcatactgagttagctgaaaagtgtgatgttcctaaagaaaattcatttattctaaaaaatggagatgttttagcacttacaaaggattcagcaagatatgcaggccactttaatgctggtgatgtctatgttgacggttctggcgttggagatattggaaatgttgtacttcgagatcgtcgtttactttcagaagaaggtctagtagttgttgtagcaaccatagatatgcaaaaacgccaaattattgccggcccggatttattatcacgaggttttatctacatgcgtgaatctggcgatttaattaatcaaggtcgtcgtcatctttatcgttctattaagagagaacttaaaaatgataaagtttctgaagctcaaattaaaaatactattatctctgatctgcaagaatttttatttgaacaaacagaaagacatcctatgattttaccaatgcttgttacaatataa

SEQ ID NO: 422 - DNA, 1422 bp, Lactobacillus salivarius
  isolated from gut, Lactobacillus salivarius
atgagcaaaccacaaattggtgttgttggtatggctgttatgggtaaaaacctagccttaaacattgaaagtcgtggatacagtgttgctatctataacagaacaggatcaaaaactgaaaaggtagttgctgatcatcctgataagaatttagtacctagttatacgattgaagattttgttaattctttagaaacacctcgtcgaataattttgatggttaaagcgggtgctccaacagatgcaacaattaagtcattattacctcatctagataaaggtgatgttttaattgacggtggaaatacattcttccaagaaactatgcgtcgcaatgaagaactagataattctggtattaactttatcggtatgggtgtatctgggggagaaaaaggtgcgttagaaggaccttctttaatgccaggtggacaaaaagaagcatatgatttagtagaaccaattttgaagaaaatagctgctaaggctgaagatggtgaagcctgtgtaacttacgttggacctaacggagcaggtcactatgttaagatggttcataacggtattgaatacggtgatatggaacttattgctgaaagctataacttgatgcgtaacttactaggtttatcaaatgatgaaatttctgacgtatttaatgaatggaaagatggcgagttgaagagttatttaattgatataactgctgatattttaactcgtaaagatgatttgggtacgggtaaaccaattgtagatgttattttagatcgtgctggcaacaagggtactggtaagtggagttctcaaagtgctttagaattaggagtaccacaatcattaattacagaatctgtatatgctcgttatatttcagcaatgaaagatgaacgtgtggctgctagtcaagttttacctaatccggaatttgatttaggtgacgtagataagaaagaattagtagaaaaaattcgtcgtgcattatactttagtaagattatgagttatgctcaaggttttgaacaattaagagtagcatctgaaaattatgactggaacctaaattatggcgatatggctaagatttggcgtgaaggttgcattattcgtgctcaattcttacaaaagattactgatgcatatgaaaagaatcctgaattaaagaatttgatgttagacgattacttcaaaaaaatcgttgaagaatatcaaaatgatgtccgcgatattgctgctttagcaattaaagcaggtgttgcttgcccaggattttctagtgctatcacatattatgatcaatatagatctgcacatcttcctgcaaatattattcaagcacaacgtgactactttggggcacatacttatgaacgtactgatcgtgaaggtatttaccattacgaatggtatcatgaagaataa

SEQ ID NO: 423 - DNA, 663 bp, Lactobacillus salivarius
  isolated from gut, Lactobacillus salivarius
atgcaaaagtttgagttacgcttagatgatattgattttcaaagtcaagaatcatttaaaactttaagattcaatgttgaattttctggagagaaaaatcaagtgttttatataaccagtacatatcccaatgaaggtaaaagtacagtttcattagagttagccttagctttctctgacaatggaaaaaaagcattattaatagatgcagatttaagaaagtcggtttcaagacagttaatacgtactggcagtattgagatgggactatcagattacttagtaggcagagcacaatttgatgatgtgatcgcgcaaagtaatatagaaaactttagcatgatattttctggaccaattccacctaacccgagtgaaatattggatggagaaagatttaagcatttaatagaaactgttaaagaaaaatttgatattgttattattgatacgccaccaatgggaagcgtcattgatgcagcagtgattgctaaaaactgtgacggtggcattattgtaattaatagtggacaagctagttatcgacaaattagaaaaactaaagaacaattggaacgtgccgatagtaaaatcatcggatgtgtcttaaataaagtagatgcttccaataatgattactactacggttactaccataaataa

SEQ ID NO: 424 - DNA, 1290 bp, Lactobacillus salivarius
  isolated from gut, Lactobacillus salivarius
atggcaacattaattaaaaatggaaatctttaccaagctggaagaatttatcaagctgatgtcttaattgaagatgggaaaattaaggcaattggtaagaatttatcagatgtagtaaaagaaaatttagtagaaattgacgcaactaataagctagttgcaccagggttagttgatgttcatgttcattatagagatccaggatttacatataaagaaactattcatactggaagtttagcagctgcacatggtggatatactacagtttgtgcaatgcctaatcttgatccagtacctgatacacctgaattggtagagaaaatgtgttcccgtaatcaagaagatggtgttgttaaagttaaacaatacggttcgataactcatggtctaaaaagtgaggagttagttgattttgttggaataaaaaaagctggtgcatttgcttttagtaatgatggatctggtgttcaaactgcaggaacaatgtatcaagcaatgaaatcagcagctgctttaaatatggcgattgtagcacatgtggaagataattcattattattcggtggtgttatgaatgcaggaaagagagctgacgaattaggattaccaggtatcctaggaattagcgaatcttcacaaattgctcgtgacttacttttagccaaagagactggagttcattaccatgtatgtcatgtgtctactaaagaaagtgttgaattagttagattggctaaacaacataaaattaatgtaacatgtgaagtatcgccacatcatttactactagcagatgtcgatattcctggaaatgatccttattataagatgaatccaccattaagaggtgtagaagatagacaagctttaattgatggtttgttagacggaacaattgatatgattgctacagatcatgctccacatagcattgacgaaaaaactggtgatatgcgagaggcatcatttggtattactggtagtgaaacagcatttgcaatgttgtataccaaatttgtcaagacaggaatcttcacactagaacaattattacaatggatgagtatcaatcctgctgaaaaatttggaatggaagatgccggagaattattaccaggaaagagtgcagacttagcaatctttgatttaaataaagaatatgtcataaaagaggaagattatttatctaagggaataaatacaccttttacaggtgaaaaagtgtatggtcaaacagttttaaccatggtagatgggcaaaaagtataccaaagggaggaaaaataa

SEQ ID NO: 425 - DNA, 2109 bp, Lactobacillus salivarius
  isolated from gut, Lactobacillus salivarius
atgaataacacaccttttgataactttaataatatggatgatatttttaatgaattgatgggaagtatgaatggtattaattctgaacgtcgttatttaattaatggtcgtgaagtgaccccagaagaatttgctcaatatcgtaagaccggaaaattaccaaataataatcaaatgaccagtcaaggcaaagctccaaataaagatggaattttagctaaattaggacgtaacttaactcaagaagctcgtgaaggcaagttagatccagttattggacgtaacaaagaaattcaagagactgctgaaattttagcacgtcgtacgaagaacaatcctgttctagtaggggatgctggtgttggtaagacagcagttgttgaaggcttggcacaagcaattgtgaatggcgatgtacctgcttcaattaagaataaagaaattatcagtattgatatctctggcttagaagctggtacacaatatcgtggtagctttgaagaaaatattcaaaacttaattaaggaagttaaagatagaggaaatgtgatcctattctttgatgaaatccatcaaatcttaggtgctggtggtatgggcggtgacaacggctctaaaggtttagctgatattttgaaaccagctttatctagaggtgaaatcacagttattggtgctacaactcaagatgaatatcgtaataccattatgaagaacgcagctttggcacgtcgattcaatcaagttacggtaaacgctccaagtccagaagatacatttaagattttacaaggtatcagaaacttgtatgaaaagcatcacaatgttgtattgccagataatgttttaaaggctgctgtggactactcaattcaatatataccacaaagaagtttgccagataaagctattgatttgatagatatgacggctgcacatcttgctgcaaagcatcctgttacagatgttaaagaattagaaaatcaaattaaagatgaaaaagaaaagcaacaagcagctgctgacaaggaagattatgaagcagctttaaatgctaagacaaagattgaagaattgcaaaagaagattgataaccattctgaatctcaaaaagtaacagccacagtcaatgatgttgctgaagccgtagaacgtttgacaggtattcctgtatccaagatgggtgctagtgatatcgaacgcttaaaggaaatcggcaagagattaaagggcaaagttattggtcaagatgaagctgtaaatgcagtagctcgtgctatccgtcgtaatcgtgctggttttgacgaaggaaatcgcccaatcggtagtttcttattcgttggaccaactggggtcggaaagacagaattagctaagcaattagctttggatatgtttggctctaaagatgcgattattcgtttggatatgtcagaatattctgatagaactgccgtatctaaattgattggtacaacagctggttatgtaggttatgacgacaatagtaacactttgactgaacgtgtacgtcgtaatccatattcaattatcttgctagatgaaattgaaaaagctgacccacaagtaatcacattattacttcaagtattagatgacggtcgtttaactgatggtcaaggtaatactattgacttcaagaatacagttattatcgcaacatctaacgctggttttggtaacgaagatttaatgggcaaagacgaaaaagaagacaaggacattatgaagaagattgctccttacttccgtccagaattcttgaatcgtttcaatgccgtaattgaattctcacatttgactaaggaagatttgaaagaaattgttgatttgatgttagacgaagtaaacaagactttggctaagaaaggtcttgacttggtagtaactgatgctgctaagaactatcttatcgaacaaggttacgatgaagcaatgggtgctcgtccattacgtcgtgtcattgaacaacaaattcgtgataaagtaacagacttctacttggataatgtagatgtaaaacatttattagctgatatgaaagatggcgaattagtaatcagtgaaagaaaggatgcagataaataa

SEQ ID NO: 426 - DNA, 1932 bp, Lactobacillus salivarius
  isolated from gut, Lactobacillus salivarius
atgagcttaataaaaagaatgtcaccagatgagaaaaaagaaagtggagtaattgcactttgcttaatgcttttgattctcgctcattttataccaaaaaatataacgatagttctgtacatagtaacttatattatttcagcttatccgattttaaaagaagcgatagaaaatatccttcatggtaagtggtttgacgagaattttttgatgtcagtagctacagttggagctttagcaattggacaattttctgaagctattgcagttatgttattttatcgtgtaggcgaaatattcgaagatttagcgatagaaaattctaaaaaatcaataactaacttactagatattcgacctgaatatgctaatttagaattgaatggtaaattacagcaagttaagccagaattgttaaacaagggtgatataatcgttgttaatccaggagagaaaatagcggttgatggagttgttgagtcaggagaggcatatttaaacactgcagctctaactggtgaaaccaagcctttgttagttactaaggatagtcaggttttaagtggaatgattgtcgaaaatagtgctcttaggataagagtaagtaaagagtataaagattctaccgtaacaaagattttagaattagtgcaaaatgctagtgaaaaaaagacaaagacagagaattttattactaaattttctcagatatatactccagtaatagtaatgtctgcgatcatgttagccagtgttccaccattatttttaggacaagaattccaagtatggctatatcgagctttgatttttctagttatttcctgtccatgtgccttagttatctcaataccgctgagttattttggtggaattggcgcaagttctagagctggtatcttagttaagggaagtaactacttagaggcgcttagtcaagctaaagctgttattttcgataagacaggtactttaactagaggtgaattttttgtaactcaaattatacctgcaaatggagtaagtaagaaagaaattgtaaaattagctgcagtcgctgaatcttcttctccacatccaattgctcgttcaattgttaaaaattacccgggaaatattgcgcgagtaagcaatattgaagaattagtaggcctaggcgttagagctgaatatcagggtgatactattagtgtgggtaatatgaagctgatgaataagcttaatattgatggagtatcgacaatagaagatactacaggaactgtcgtctatgtagctctaaataatgaatatcttggtgcaatagaagtctcagatatgataaaaatagatgctaaagtggctattcaaggtcttaagaatataggaatagacaatgttactatgcttacaggagataaaaagattgtcggagagagtgtagctgaaaaattatctatccctaatgtaaagacagaattattgccacaagataaagtaacagaagttgagaaaatcaaatctgagataggtgataaaggtaaagtaatctttgtaggtgatggcttaaatgatactccagttttagccagtgctgatgtaggcgttgcaatgggggctttaggttcagatgcagcagttgaagtagcagatgttgttttgatgaaggataatccaactgctgttaccaaagcaataaaaattgctagaaagacaaagataatcgtatgggaaaatattatctttgctttagtagtaaaagcaatcttccttttgataggtgcactaggaatagcgacaatgtgggaggctgtatttgctgatgtaggagtaaccttcatagcgattttaaatgctttgcgtctattaaaaataaaggaagacaacgaaaaaataaataagcatccacactctaaggcagaaaagtatgaagtagaagttaatgaagcataa

SEQ ID NO: 427 - DNA, 1230 bp, Lactobacillus salivarius
  isolated from gut, Lactobacillus salivarius
atgaaaagaggaatttacatggaaaaagaaaaagttgttttagcatattctggtggtttagatacatcagttgaaattgcttggttaaagaataaaggttatgacgttattgcatgttgtattgatgtcggtgaaggaaaagatttagaagctatcaaggaaaaaggcttgaaagtcggtgcagttgaatcaatcgttattgatgctaagcatgaatttgcagaagaatacgttcttccagcattacaaggtcatgcctactatgaaaacaaatatcctttagtatctgctttatctcgtcctttaattgtaaagaaacttgttgaagttgctaaagaacatggtgcaacagctattgcacatggatgtactggtaaaggaaatgaccaagttcgttttgaagttggaatccatgcattagtacctgaaatgaaaattgaagatcctattagagatttacattggtctagagaagaagaaattgaatacgctaaagaaaatggcattcctgttcctatctctaagaagagtccatactctatcgacgaaaacctttggggtagagcaaatgaatgtggtatcttagaagatccatggcaatccgcacctgctgatgcttatgacagaacagtcgctctagaagatactcctgacacacctgatgttattgaaattacttttgacaaaggtgttccaactaagctagatggtgaagaattaccacttgaagaacttatcatgaaacttgataaattagctggtaaacatggcattggtagaattgaccatgttgaaaatagacttgttggtattaaatcaagagaagtttatgaatgtccagcagcaactgtacttttagctgcacataaggatatggaagatttaactcacgaaagagatttagctcatttcaaaccaattatcgaacaaaaattaagcgaattaatttacaacggtctttggttctcacctttaatggacgctattcaagcattcttagcagaaactcaaaaagttgttaatggtgtagttagagttaaattattcaaaggcaatgttatttgcgaaggtagaaaatcccctaactctctatattctgaagaattggctacttatacttctgctgatcaattcgaccaagaagctgcagctggttttatcaaattatggggattaccaacacaagtttatgctgaagttatgcaacaaaatgagaaaaacaataagtaa

SEQ ID NO: 428 - DNA, 1356 bp, Lactobacillus salivarius
  isolated from gut, Lactobacillus salivarius
atgatgactaaagcccaaagaaaagcttttgtatttactttattgttaggaacttttaccatgtcgattagtcagtcttctttatcgacagcttatcctactttaatgaagtttttcaatgtagatgcaccaacgattcaatggctaacaaccggttttatgttgattatgtgtatcatgatgccagttagtccctggttgttgaataatctatcttttaagaaaatgtacttaacggtactagcaatcttcgagttaggaacactgatgattattttagctcctaattttccaatcgctctactaggaagaggcctagaagcagttgcggtaggtattttatttccatcttatcaatcagtcttaatgacaatcaccgctaaagaaggtcgcgctgaagtcatgggattggctggcttagttatgggatcagccttagcttgtggtccaattatttctggtattattttaaattatattagttggcaaggcttgttctggttcttcttgttagtaattgcgttaatctttgtcagtgcgatctttaatatgcgcgatgtaatggaacgtaaagaaagccagttagacttcatttccgttatctattcacttagctttatcggattattgtattttgtaaatgaattaggtattaagcagttaactttgccattatatttgattttaattgttagtgtaatcttgtttatagcctttattttgcgtcaatttagagttaaggatcccttgcttcaattgcgagttttgaaagtagctaactttgatattggcgttctattaacaggttttgcttacatttcattaattgtagtaacaatcgtatatccattgtattatcaaagaattttgcatgttaatccgttagtgtcaggtttagcattagttccaccagcagctttattgagtattttgaatctagtttccggtcgtttagctgacaaagtaggatttaaaattacactgttgataggtatggtaatgctagttgtaggttgggcaattctatttatcttcagctaccatctaaatgtactgggaatgatcctaattgcctgtatcattgaaggaggtaacgcctttgtcatgatgccagctacaactatgggagccaactcacttcctgaaaatatgattcctcatggaactgcgataactacgactgtacgtcagttgttaggtagtctaggggtagctttggcgatgattattatagtagctggcggacacacattgagtgaaataattggttatcactatgcctttggatttttctgcatcttggaaattgtaggattaattttggcaattatcttgcgtgatgacagtaaaaaataa

SEQ ID NO: 429 - DNA, 1236 bp, Lactobacillus salivarius
  isolated from gut, Lactobacillus salivarius
atgtggagagtagattgtatgggggataaaagatttaatttatttcagttactaaaagctggaacgacaacaatcattaatgcgttaggagcagcgatatttacttatgctttgtcattaaagctattagaaataacaggttcagctttaggttatggagtgaatatatttattggaccaatcattggcctaattctatcgccagttattagtaaagttgtggataaatatccacgcaaaaatgtcgcgattgtagcagagatagctttggtaatctgcttggcaattttcctaattatttacccactagcagtgaaaactaatctattggttgtatcagtagtatttgtaagtattagtaatatttgtgctagatttttctcaatttcatatctttcatcaactccagacatagtttctaaagattacttgcagaagctaaatgcgattcaaacgacaggggttgcgattgcaggtattgccgcactaccattagcaggatatatttatggaaaaatcgcatttgaatacataattttaattgaaattataactgaaattttgactatctttttgacagtaataactaaatttaaagctcatagaaatgaagaaaaagcacatgaaacgggtagaaagttaattgaaattttacaaggtaatatggaattaactagattaacaatgatagctatgcttttgaatttagcagtaacttctttaacgattggtgttccatatgttgttattcatgttttgaaatatagctcagtagttagtggagatattcaaagtttgtattctattggagtagttctaggaggaacagtaatagctgcaattgatataaagaatattactagatttatcataagactatattcttcttttgcggtagcgttattgatcttagggatctcattatcattctttaaacatgagactttgataatcttcatcgtatttgaactaattttaggaatttcaactgcattatccgatcctccattatttacctatgttcaagaagtagttcctaaagaaaatttaggaaaagttatgacattcttgtatacattagcacaacttctcacaccagttggagtgctgatttacagtactttattcgctaaaattgattatccaacagtctttctaattagtggaattgtagttaacatcatcgttatcgttgtactactttttttagggaaaaaatctaagaatttagcataa

SEQ ID NO: 430 - DNA, 1020 bp, Lactobacillus salivarius
  isolated from gut, Lactobacillus salivarius
atggcaaaagaaattattttaacaggtgatagacctactggaaaattacatgtgggacattatattggttcattgaaaaaacgtgtctctatgcaaaattcaggaaagtatgattcatacattatgattgctgatcaacaagctttgactgacaatgcacgtgatcctgaaaaaataaaaaattcattaatacaagtagcattagactatttggcagtaggactagatcctaaaaaatcaacaatctttgtgcaatcacaaattccagcattagcagaattgaatttgtattacttaaacttagtaactgtttcacgtcttgaacgtaatccaactgtaaaagctgaaattcaacaaaaacattttgaacgctcaattccagctggatttttcacttaccctgttagccaagctgctgatattacagcttttaaggctaatttagttccagttggtgatgatcaagaacctatgttggaacaaactcgtgaaattgtaagaaccttcaattcaatttatggtgaagtattagttgaacctcaaggtgtatttgcacctaagggatctggacgtttaccaggtttagatggaaatgcaaagatgagtaaatctttaaataatgctatttacttatctgatgatgctgatacattacgtaaaaaagtaatgtcaatgtacacagatcctaaccatattcacgtagaagatccaggaaaagtagaaggtaatatggtcttcacatatcttgatatttttgataaagacaaagacaaggttgcagaattaaaagaacaatatcgtgctggtggattaggtgacgttaagattaagcgttacttgaatgaagtcttagaagctgaattaggacctatctgtgctagacgtgaagaatttgcaaaagatattccagctgtatatgcaatgcttaaggaaggtagcgaaaaagcaaacgaagtcgctaataaaactttagaagaagtacgtagagcaatcggggtaaattacttcgaaaatatttaa

SEQ ID NO: 431 - DNA, 765 bp, Lactobacillus salivarius
  isolated from gut, Lactobacillus salivarius
gtgaacttaatggaaaaaataataacaactaaagatgtacatttatattatggaagtaaggaagctcttaaggggataactttggactttccagataaggggatacatgcattaattggaccatctggttgtgggaaatcaacgtacttaagaactttaaatcgaatgaatgacatgatagaaaatgtaaaaatagaaggcgaatttaaatttaagaatcaagatatatatgatgaaaaaatagatttggttgaattaagaaagaaaataggtatggttttccaacaacctaatccttttccgttttctatttacgataatgttacttatggattaaggatggctggtataaaagataagagaattttggatgaaaaagtagaaacaagtttgaaacaagctgcaatttgggaagaagtaaaggataatttaaataaaaatgccttggctttatccgggggacaacagcaaagaatctgtattgctagggtacttgctgtagctccagaggttattttactagatgagccaacaagtgcgcttgatccgatttcaacagaaaaaatagaagagatgttactaacccttagagataattatacatgtattatggtaacacataatatgcaacaagcttcaagaatatcagatacaacgtctttctttttaagtggtaatttagttgagagtaataaaactaaaaagatatttttaaatccagataaagaacaaacagctgactatttaagtggaaaatttggataa

SEQ ID NO: 432 - DNA, 1356 bp, Lactobacillus salivarius
  isolated from gut, Lactobacillus salivarius
caagctatatacgaactggttgaacctaattcacacaacttagaaaagaggataattatgacaattcaagatcaaacaaaagcaacagatagattcgaaactttacaagtacacgctggacaaacaattgatgaaacaggatcaagagcagtgcctatttaccaaacaacatcatatgtttttaagaatgcacaagaagcagcagatagatttgcattgagagatgcaggaaatatttacactaggttaacaaatcctaccactgatgtagttgataaaagagtagcagcgttggaaaaaggaagtgcaggtataacattagcaactggatcagcagctattacatatgcgatattgaatattgcaggacaaggcgatgaaattgttgctgctagcacactttatggtggtacttataacttatttagtattactttaaaacgattagggattaaaacaaatttcgtaaatcctgataatcctgcaaactttgaagcagcaattaatgataagactaaggcaatttatgtagagagtattggaaatcccggaattaatttagtcgattttgaagagattgggaaaattgctcataaatacggtattctctttattgttgataatacttttggaacaccatacttagtacgaccacttgaacatggagcagatattgtcgtacattctgctacaaaatttatcggcggtcatgggacaaccatgggtggagtaattgttgaaaagggagattttgattatgaagctagcggacgttatcctgatttcacagaacctaatcaacaatatgaaggattgaaatttgcagatattaaaggtgcagctttcactaccaaggtacgagctgaaattggtcgtgataccggtgcttcaattagtcctttcaactcatttttactattacaaggtttagaaacattatccttacgagtagagcgtcatgttgaaaatacaagaaaactaatttcattcttgaagtctcgtccagaagtagcatggatcaattatccagagttagaagacagtccatactatgatttggcacagaaatatttccctaagggtgtaagctcaatctttactttaggattaaaaggtggcaaagaagacggtaagaaattaattgaaaatttacgactattttctctattagcaaatgttgcggatgctaaatctttaattatccatccagcttcaacaacacatgcacaattaagcgacgaagaattgaaggcagctggagtaacgccagaattgttaagaatttcagttggaattgaaaatgcagatgatttaattgatgactttgctcaagctttggataaattgaaagattaa

SEQ ID NO: 433 - DNA, 1863 bp, Lactobacillus salivarius
  isolated from gut, Lactobacillus salivarius
atgtttataaataaaacttatttctttttagatatggggggatttattatgtctcgtctaagtcataaacaaaaattatatattattgttggtatcgctgcagtcgtagttgttttacagtacttattacatttaaaattatatgcacaaattctcgttactttagtcggagctatcattgctttatctatgtttaaggaaatggttcacacactccgttctggaaaatatggcgtcgacctattagccatcttagctgttgtcgccactttatccgtaggtgaatattgggcaagtatggttattcttatcatgctcactggtggtgatacattagaagattatgcctctcataaagcaaatacagaattaaaagcattactagataattcacctcaaattgcacataaaattatggatgatggtgacatagatgatgttagtgtcaatgatgttaaagttggagataaaattgtagttaaacctggggaaatcgttcctgtagacagttttatcattaaaggtagcggcttatttgatgaatcttctttaactggtgaatcaaaacctgttgaaaaaaatctccgtgacaacgtaatgtctggttctttgaatggggacaattccgttactttacaagtaagtaaacttgctaaagatagtcaatatcaacagttagttaagctagttaaggaagctgaaagtactcctgctcattttgttagaatggcagatagatacgctgttccatttactttggcagccattttaatttcacttgcagcttggttcttctcaggcgaccctcatcgccttgctgaagtattagttgtagcctcaccttgtcctttaatccttgcagcacctgttgctatggtttcaggtatgagccgtgcctcacgcaacggcattgtggtaaaaactggtgatgttttagaaaaacttgccactgctaaaactggtgcttttgataaaaccggtacaatcactagtgggcaattaactgtacaagatgttgttacaacctcttctatgaaagtagaagaattattacaactagctgctagtgctgaacaagaatcatcacatattttagctcgttcacttgttgcatatactgacaatcaaaatatcgatttagcacctgttagttctttagaggaaaaaacaggtaagggaattgaagctactattaatcataaaaatgttaaagtaggtaaacttaaatttgttgctccaaattcagaaatgaaacctttagcaactactactatttatgtcagtgttgatgatgaactttgtggttatgttacttttaccgatcatgttcgtcctgaagcaaaagaaactatgaatactttgaaagctttaggagtcaaaaagttaatgatgctaactggggatcaagaaaagattgctcaacgagtagctaaagaagtaggaattgatgaagtaaaagctgacttactacctcaagataagatcaccgctttacaaaatatccctaaatctggccaccctacttttatggttggtgacggtgtaaatgatgctccttcacttgcaactgttgatgttggtattgctatgggtgcacatggttctactgctgctagtgaatcagctgatgttgttattttaaaggatgatctatctcgtgtttctaaagctgttactatttcacgtgacaccattaaagttgctcgtcaatcagttttattagggattgcaatttgtactgcattaatgttaatcgcaagtactggtatcatccctgctttcatcggtgcgatgttccaagaagttgttgatactgtttcaattttatgggctttgaaggcacgttattctcacgaacaatag

SEQ ID NO: 434 - DNA, 294 bp, Lactobacillus oris
  isolated from gut, Lactobacillus oris
ttgcgcatagaaaacaaagaaggaggcaacagtatgagtaataaatctaggcatcgtcgacttttatttatgatgggactagtcttattttcgttattagggtcaatatggatatcatctaataatggtatgaccgtatatgctgatagcaagacaaatattactcagaacggtacggggtccgggactgttattaatcaacaggaagaaccgcagataagtaccgttaatagtaataccacagataatactagttcttcggacgatcagacgtctcagaaacaagtttactaa

SEQ ID NO: 435 - DNA, 1221 bp, Lactobacillus fermentum
  isolated from gut, Lactobacillus fermentum
atgccaaaagttgaattaaatttagaagatgacgaattaaaggaactattactaggtgatcgggataaggccatgcaatcaattatggccaagatccttgatgaaattcttaagtccgaagcgactgagcagattaaagctaaggcttatgaacgttcggatgagcgaaccaattcacggaatggttatcgggttcgtcagcttaccacacgagtaggaacacttgaactacacgttcctaaactccgtcatggcaatttttcaacacagctgttcaaacgctaccagcgtagtgagcaggcctttgatttggcattaatggaaatggtaatccaaggtgtttcaacacgtaaagtagctgagattactaagaagttatgtgggacaaccttttctaaaagtacggtctcggctttatgcaataatttggacgaccaagtgctggattttaaccgacgtccccttacgcaaaagtatgcttttgtgtatgccgatgcaattttatttaaggtacaccgtggtcacgttgtgacaagtaatagcttactcgttgcgattggaatcgaccctagcggtcgtcgagaagtgctcggttttgatatcggtgatagtgaatcaaaagctgcatggatggacttctttagtgaacttaaacagcggggccttaccaacgttgatatgtttgtttcagacgctcattgtggcttaaaggatgcaatcactacgcaatttcagggtagcctttggcagagatgtcaatttcattttagtaatgactgtacaagtattctggcactcaaggatcgtaaagaagttgctaaccgactcaaagatttatttaatgctccaacgtacgaccaagcggttgaacggcgtgaccaattggttaaagattggcagaccgagttccctaaggtggtgaagaaattagaaaatagttttgacgaattaatggtgatttaccagctcccagaggagctaaggaagcgtctccggacgaataatacaattgagcgggttaatcaagaaatccgtcgtcgtgaccgtgtaatccggatattcccgaatgatctaagcgtcttgcgactaatgggagcactactgattgaacagaatgaaaaatgggctgctggtccacggtacttaaacatgaccgtttaccacgggattgaaaaagatgacaattcagaagaagccggtatgcttaagcttgtgaaatga

SEQ ID NO: 436 - DNA, 585 bp, Lactobacillus gasseri
  isolated from gut, Lactobacillus gasseri
atggctaaaatcggttatgcgcgtgtgagttccaaggagcaacatttagatcgacagttagcggctttaaaagacgttgataaattatttgcggataaattaagtggggctaacactaatcggccagaactgcaaaaaatgctggcctatattcgtgagggtgatattgtcctggtcactgaattagatcgcttaggcagaaacaaccaggatttaactaagatcatgaacaccattcaaaataagggggccaccttagatgtgttaaatttgccatccatgacagggattgctgacccaaatttacgtcaactgatgaccaacttgattattgaactctataagtatcaggccgaaagtgaacgtaagcgaatcattgagcgccagcagcaaggaattgccttagctaagcggcagggtaaatatcatggacgcaaaccccaatacacccaagacgatccccgcttgcaacatgcttttaaactttatcaggcaggcatgagtaacattgatgtggctcgaaatacaggaattaaacggacaacctttatcagatatcgcaaaaagtttaatataaaaagatga

SEQ ID NO: 437 - DNA, 1173 bp, Lactobacillus salivarius
  isolated from gut, Lactobacillus salivarius
atgaagaataataaaatgtgtgcaatcttaggaaatgaacatgaatatacagaattactaccattgaccaaaagaagagcattagctactctttactttgactgcaaataccgtatcatggattttgctttatcaagtattgtaaatgctaatattcgtaacattttcttagtggtaaaccaagctaaattaaaatcctactttgaccatttaggtggcggtagagaatggggattagatagcattggtagttatcgctatattaacttttctcaagatttagttcgtcaaaaagtagaaggtcaaaaatattttgatgatgtaattgattacttagaaaaatcacgttcaacatatactgcttttgttggtaataagatgttaaacagtgttgatttgaaagctgttttgaagattcataaggcacaaaagaatgacatgacagttgtattcaaacgtatgccaaaagataagattgcttctgatgatcaaattctagaaattgatgatcaaacaaatcgtgtaaagggcaatcataactttagtgaatatccacataattctgatatttacaacttatcaatgaatatcttcatcattgaaactcaaaacttaattaaccaacttcgtaaaggtcaaagaataggtgcatctgctaacttagaagacttcttcttaagtttgattagtcgtttaaactgtggtacatacgaatacacaggatacatgtgcaatatctttgatgtgaagagttactatgatgctaacatggatatgttgaatgtcgatcatatgaattcattgttatacagtagccaacacattattactagaacaaagaatgaagtagctactcactttactaagacttccgatgttaagaatagtcaatttgcaacaggatgcgttgttgaaggatatgtaagaaacagtttagtatcacgtagaacatttatctctgaaaactctaaagtagaagactcaataatcatgtctaatgctcgtattggaaaagatgtagaaattaaatatgcaatcttagacaaagatgttgtagttaaatctggtgtaaagattatcggaactccagaaaaccctgtagttattgaaaagaagatgaaagtaacaagtgatgttattcaagatacacctagggaggatgttgaagactaa

SEQ ID NO: 438 - DNA, 1422 bp, Lactobacillus salivarius
  isolated from gut, Lactobacillus salivarius
atgaaatcattggaaaaagttgattataaaaagtttatagtcccagttatagtgggcttaattatctggtttgcaactccacttagaccagtagcgatttcagttgctggttggcatatgtttgctttgtttgttgctactattattgcatgtattacacaacctctaccaattggtgctgtttcgattatcgcttttgctttggtagttttaacaagaactgtaccaatggaaaaggcaatcgtaggatttggtaatgcaagtatttggttgattgcaatggcattctttatcgcccgtggctttattaaaacaggattgggtagaagaattgccttgatatttgttaagttattcggtaaacgtactttaggattggcttattcattaatcggggtagatttgattttagcaccagcaatgccttctaacacagcacgtgcaggtggtatcatgtacccaattattgaatcattagccaaagaatttgactcagatcctaagaagaaaacagaaagaaaaatcggttcatttctaatttttgctgaataccatggtaatatgattacttcagcaatgtttatgacagcgatggccggaaatcctttagttcaaactttagctaagagtaatggtgtgcatcttcaatggatggattggttcttagctggattagttccaggtttattgtcattaattatcattccatttattatttacaagctttatccacctgaaataaaagagactccaaatgctaaggaatgggcagattcagaattagaaaaaatgggtaaaataacagttcctgaaaaagtaatgatcggaatctttattttcgcattattattgtgggtcttaggtagtacattaaagattgatgctactttaacagctttcatggcactttccttattgttgattacaggtgtcttaacttggaaagatattttaaatgaaagtggtgcttggaacacattgacatggttctcagttttagtaatgatggctagccaattaaatgaattaggttttattccttggttgagtaagacaattgctggttcattacatggtattagctggttctttatcttgttgattttagttctagcattcttctatagccattacttatttgcatcttcaacagcacatatcagtgcgatgtacggagctttgttaggtgtagctgtatctgctggtgttccaggaatgttagcagctttgatgttgggattctttggtaatctttgtgcatctacaacacactatgcttcaggtcctgcaccagtgttatttggctctggttatgtaacacaatctaaatggtggcaaatgaatgctttcttaggaattatctacatcgttttgtggatggttgtaggaacactttggatgaaagttataggcatgtggtaa

SEQ ID NO: 439 - DNA, 1140 bp, Lactobacillus salivarius
  isolated from gut, Lactobacillus salivarius
atgaaattttcaattcaacgagcatcattcatcaagtatttaaacgatgttcaacgagcaatatcatccaaaacgacaattgatattttaacgggattaaaaatggatttatcaaaagatgcattaactttaactggtagcaattcagatatatccattgaaacaatcatttcaattgcagatgataatgctgcattacaaattgaacaagaaggtgcagttgttttacctgctcgtttcttcagtgaaattgtaaagaaattaccagaacaaacaatgacaattgaaattaacgaaagatttcaagcaacaattacttctggatcagcagaatttacaattaatgggttaaatgctgaagaatatcctcatcttccagaaattgattcaaaagatcaattaactgttcccggcgatatactaaaacaagttattagtcaaacagttattgctgtttctaatcaagaaagtcgccctattttaactggtattcatttggtaataaagaatggagaattacttgcagtagcaactgactctcatcgtttaagtcaacgtattatcaaattgtcaggtgctgacgatgcagtttatgatgttattattccaggaaaatctttaagtgaattatctaaaatgatttctgatagtgacgaaaacattgaaattcagatctcagaaaatcaagcattattcattctaggcaatacttctttctacactcgtttactagaaggaaaatatcctgatactgaaagattaattccaaaagtttcagaaattacagttgattttaatgcagtagaattacttcaatcaattgaacgtgcttctcttctatctcatgaaggtcgcaataatgtagttaaattagcaattaatccaagtgcacaaagtgttattctttcaggtaatactcctgaagtcggaaatgttgaagaagaactacatttcaaaaatttagaaggttcagagttagaaatttcatttaatccagattatatgaaagacgccctacgttcatttggtcaatcagaaattacaattgcgtttacacaaccattacgtccgttcacaattgtaccaacagaagataaagataattttgttcagttgattacacctgtgagaacattctaa

SEQ ID NO: 440 - DNA, 729 bp, Lactobacillus salivarius
  isolated from gut, Lactobacillus salivarius
atggctgaacgattacaaaaagttatggctaatgctggtgtagcttcacgtcgtgcaagtgaaaagcttatccaagaaggtcgtgtaatggttaatggtgttgtagtaactgaattgggaactaaggttgaaagtgacgactcaatttcagtagatggtaagcttttaaagaaagacgaaaagaaagtttactacttactttataaaccacgtggagttatttcagcagctaaagataacaagggacgtgaagttgtaacagactacctaaaagatgttcctgaacgtttgtatccagtaggaagattagattatgatacttctggattactaatcttaactaatgacggtgattttgctaatcaaatgatgcatcctcgttataaggtagataagacttatgttgctaaagttgaaggactgattgcacctgatagcattaaaaaattgcgtaatggagtagttatagacggaaaacctacaagtcgcgctagagctaaaattctctcaagagatgctaaaaagaatacttcaatagtttcattgacaattcatgaaggacgttatcatcaagttaagaaaatgtttgatgcagtaggacataaagttcaaaaactttcacgaacaacttatggtacattgacacttgatggtttaacttcaggtgaatatcgtgaactttcacataatgaagtacgtgaacttttgaaacttataaataataagtaa

SEQ ID NO: 441 - DNA, 810 bp, Lactobacillus salivarius
  isolated from gut, Lactobacillus salivarius
atgagtacgattcaaattattttagtcgttatcgtagcctttatcgtaggatgtagttctgttaacgaccaaatcgaaacttatcaaccagttgtagcttgttctttaatcggacttgttacaggtcaactagaacttggcgttatgctaggtggtagtttgcaattaatcacaatgggttgggctaacgttggtgctgctatggctcctgacgcagctttggccggtgtagcttctgcaattattcttattgaaggtaaccaaggtgcacaaggtattggacctgctatcgctttggctgttcctttggctgtagctggtttaggtttgactatgattgttagaacagcaacagtatttatcgcacacattatggataaacgtgctgaaaaagctgatatcaatggtattcaagcatggcattttatcggtatgactttacaaggtctacgtgttgctattcctgctttacttttgatgttaatccctgtaagtcttgtacgccaaggattggaagcaatgccagaatggttaacagctggtatgacaatcggtggtggtatggttgttgccgtaggttatgccatggttatcaatatgatgtccagtcgtgaagtatggccattcttcttcctaggttttgctcttgctgctattaagcaactaactttgatcagtttaggtatcatcggtgtatgtttagccatattattccttgctcttgaaggtagtggtggtagctcaaatggctcatcaaatggctctggcgattcagatgatccacttggagatattttggaagacatctaa

SEQ ID NO: 442 - DNA, 2616 bp, Lactobacillus salivarius
  isolated from gut, Lactobacillus salivarius
atgaatgatgttgaaaaaatgatagcagttcgcgatgttgatggattaaatgatgcgattagttttttaagaaaagatggtaggctagtggaagcttaccgtgtatgtaaattggcacaacaaaacaacctagatgtaactgcatctgcagtatgggtattgtatgattttttaaaagctgatagtgaatttacgaaatacatgagacttgttcaagaaaactacgagattcaaaagactatattctctgatgattatgaaattggatatttctcattgtatataaaactcacacaagcacaaataataagaaaagcttgggaacttagtaagcaagaaaaatgggatgaattacataagttagtgacaacttcgtttacattttttgtaaatcaagaatttaatttatctgattgggatagcgaattaacaagtaccgataactattattccggaaaaaatcaaatgttagggataagtggctttttaggcgatttaataagctgttatgtaagaagtgagtattttttacatactgatatccaaactattatgaatgaagttctaaatttctattcaaagtataaagacaattatatttatatgggtaaaattctaggaataatgttgacagcggtcatttgggaaaaatataaatccaaagattatgcagcaattgatagatgttgtaagttggttgttagagaaatagatagagaacatttttctggaacaccatttgagttgattctggtcttatcacagattaaatactatcaattgggtaataataaagttgagattactaaaagagaaaatggatatatttatctagtagaaaaagtattagattttagcaaaatacctgatgattatttgtcgcctactaaaaatgtgatggaagacaaagagtatgctagtaaaattatccagattatgcaaggttacgcaaaatcgctatgtaatagagcagatagtatagaaagatacttaaaggtagtgcttgaaatctttgctttggaaaaaacgaagagattacgcgaatacagaggacattatggtaagaacttgattaatgattttattcgagtttatggatatgtggaatatgagcaagataagaaacatttaattcaagaatatggtagctttttgaagaaaaaggaacagttatcatataacgatgacttgatacgtgaaagtattggtgaaaatataatctatctcgtgtataaaactactcctaaggaattcgagaatttaacagatacattgatagctgaattgccagtaacaatctttgaaaataaagtcacagaatttaataaggctttattaattactaagtttaatatcagcaatcctaaagaatacctcagattaatgacttgggtactatcgaatgacaagtcatttgtagttgagaattttaaagaagtagagaatcctgacgatccatctcgtccttatccaagtgacttttcaaaattattgagtagttattatacggcggtatcaagaacaaattcggatattttagcaagcttggatttgtggctagataaactttctgaagtaaagaaattttatactagtaataaaactgttgtagagttcttaagaatattcttgaaattagctaaagaaaaatccgattctctaactcaacaacaggtacaagttattattgataaattaggtagtgtagtttttgaaaattataagggaaataaatggattggatactattattgcaagattttattggatcatgactttgatgaagaagttggtaaagcatttgataaattcttggtaactgatagaggtaatagttggctctggaaagcttatgcagattttgtaaaagatgatagtgagcttagaatagcagctttatttgaattcttaaagactaaaggtgatagtgatgaagttagaaaagaaatcatagaatatttggttgcagctaaaaatccagaatactatggtccaattaagtttgaattatctaagattaaggacaaagaatataaggctaagtttgaaaatcttccttggtatgtagaaactcaattgcctgaaaataaccaggaaatttatcgtaaatttactaagatgattgagcagaaattcaatgaaaaaatagaaaagagtaatttttatgttgttggttcagatggaaagaaattcattgatattgtcgttttagataaaaatggcgaaaaagttgaaggaattattattgacgaagaattgttgaaaaaaataaacttatatgaatgttattttgctagattggtacctaagaaagtgaaaaaagctggaatgaagccacgctttgaattggtgggcgatgtagaagaaactacagattatacatttaaagtgaggtttatccaaaattatgagggtgtttataaacgaggtttggatccttgggataatagagatctcattgtgacagattatgaaaataaacgtattccagcatggatggttgaagaatatcatttacaaaatgatgataaagtgaaggtaacccaaaaaattaagcaaaagaaaaataaactactgtggcagattgttgatattaaaaaattagagactgagtaa

SEQ ID NO: 443 - DNA, 756 bp, Lactobacillus salivarius
  isolated from gut, Lactobacillus salivarius
atgaattatgataaatattgggaggaattttacatgtctgacatcaagtataaacgtgtattactaaagttgagtggtgaagcacttgctggtgatcaaggaaaaggaattaatccgcccgaaattttgaaagttgcagaagaaataaaagaagttcatgatttaggtgtacaaattgctatcgtcgtaggtggcggaaatatgtggcgtggtgaagctggtgctgaaataggaatggagagagcacaagctgattacataggcatgttgggaactgttatgaacgctttagcacttcaagatagtctagagtcagttggagttcctacaagagttcaaacagctattgaaatgagacaagtagcagaaccatatattcgtagaaaagcaattcgtcatctagaaaaaggaagaattgttatttttgcagcaggtacaggctcaccatatttctcaacagatactacagctgcattaagagcatccgagcttaatgcagaagtaatcttaatggctaaaaatggagtagatggaatctacaatgcggatcctaaagttgatcctacagctaaaaagtatactaagttaacacatatggatattattaataagggattacgtgttatggatactacagcttcatcattatcaatggataacaatattgctttagtggtcttcaacatgaataaccgaggaaacattaagaaggttgttgaaggcgaagaaattggtacaacagtggaaggaaaataa

SEQ ID NO: 444 - DNA, 1221 bp, Lactobacillus salivarius
  isolated from gut, Lactobacillus salivarius
gtgcaggtgaaagttaatgaataccctaaaacttggaaaagaacatttatatcattatggttaggctgttttattactggactaggattttctatgaccatgccatttatgccactgttcatggaaactttaggtaatttttcgacttggcaactaaatttatattctggtttagctttttcgatgacatatttatcgcaagcaattgtatcaccatattggggaagtttggcagatcgtaagggtcgtaaattaatgtgtatgcgtgcttcaggtgttatggcttttacgattttcttaacaggattagcccaaggtgtttgggtgattattttccttcgtttcttacaaggagcattttctggttatataaataatgcgactgcatttattgctggggaaactccacgtgctaaaacgggatccgcaatggcaaatatgatgacggctagtgtttctggaaatctactagggcctatttttggtggtgcaattgctggatcatttggctatcgagtgccattctttattacaggttttatgatgttagttgcatttttcttaacctgggtaaacaccaaagaacactttaagccagtagctaagcgtgaaatgaagcctatgaaggaaattttttctcaaatttcaaatactaaattgataatttcaatgtttataacaactttgattatcaatgcttctttgatgtcaatctcaccaattattagtttgttggttaaaagattgatgcatggacaaggtaatatttctctagttagtgggattgttgcggcagctccaggctttggaacattattagtcgcaaataaattaggacataagatggacgaaatagggccagaaaaagtattgataacgggattagttgtagaagtactactatttatcccaatgtctttggtaacatcgccatggctactagctgtattacgtttcttcataggaattgcggatgcagctttattaccagctgtacaaacgatcttatcagtagacgtaccaccagcagcatttggtagaatcttcagttataatcaatctttccaagctagtggtggggtaattggaccattactaggatcatttgtatctagtttgtttggttatcaagcagtctttttatttacagctttgatgttaggatttaactttatcttagtaatctggtcacaacatagacaagttttagtaaaaaaatag

SEQ ID NO: 445 - DNA, 840 bp, Lactobacillus salivarius
  isolated from gut, Lactobacillus salivarius
atgacaagaaatatacgtagatatcgctggggacgttggctagtatttttagttgctctagaaattattactttaagtattaacttcttttatgctccaattgatatcgcagccggaggaacgactggaattgccatcttagtagaggctgtttggcatgtagaacgacctttaacagttttaatctgtaatctagctatgattggcttagcttggatttttttagaaagaaaagttgttaaaaatattactttaggtagtttattgttacctgtatttatgcaattaactcctagtttccaggttactgataatgaattattagctgttattattggtggtggcttgatgggcttcggagtttcacttctttatcgaatcaatgcttcaagtggagggacaactgttccaccaatgattttgaagaaatacttttatctggattcagccctaacattaatgtttatcgacttacttattatttttatgaatatatttgttgctggacccaatgctttctttttagcagccttttctcaagttataactgccttagttatgcgttattccgaggcaggctttgacttaaaataccaagttcaaattttaagtaacgatttgcttgatgaaattaaagaaacccttctaaaagataatagtagtttgactctttatgatgtagttggtggttatagtcaaacacaaaagcaacaaattttattaatcgtagatcgccaagattacggtcatttaattgctaaaattcatgaaattgatccagaagcctttattgttacatctaatgtaactaaagttcatggtggtaaatggggattatag

SEQ ID NO: 446 - DNA, 975 bp, Lactobacillus salivarius
  isolated from gut, Lactobacillus salivarius
atgacagtagaaaaagaaataatccaaaaaatagaagagtacgatacgattattattcatcgccaccaacatccagatccagatgcttatggatcacaaggtggattggcaacagctattatgcaaagctttcccgcaaagaaggtatatcaagtagggaaaaacattcctggattaaattggattacagttgaaaatgaagatttaccagatgaaacttacaagaatgctttagtaattgttactgatacagctaatacaccaagagtggatgatgatagatataataaaggtgattttttgattaagattgaccatcatcctaatgatgaccagtatggtgacttgagcttagttaataccaatgcttcaagttgctcagaaattatccatgatttaattctagcttcaaaaggaaaattagaattgactgctgaagttgctgaaaaactatatgctggtatttccagtgatactggaagatttatgtatgacgcaacaactgcacatacaatggaagtagtagcttctctaatgagaactggtattgatactagcaagataaatcgtcgtttagatagtataactttacccgtagctcgtttatctgcgtatgtatatgaaaatatgaaaattactaagaataatgcagcttacatcatattaaatcatgataagattgaagaatttgatttgggcgatgcaggaacatctgcggtagtaccacttctaggtaaaattaatactacaatttgctggacagtatttgtacaacaaaaagatggtacatatcgtttacgagtacgctcaaagggccctgtgatcaacgaattagctaaagaatatcaaggtggcggtcatccattagcaagtggtgcaagaatagatgatgctaacgaaattccagcttatattgaaaaattagacggattagcaaagaaatttgctgaagaacatgacatgacagactggtaa

SEQ ID NO: 447 - DNA, 336 bp, Lactobacillus oris
  isolated from gut, Lactobacillus oris
atggttgaatttgtacgccagataacgtacaatattgctgaggtgatgagaatggcaagaattgaagctcgaattgacggaactattaaaagtaaagccaaagacgtattggctaatcatggtctaacaatttctgattttatgcgcatgacattaacaacagttgctcatgatggtttacctaaatattattcaatccctaatcggcagttaaaaaattcgattcaagaagttattgatgatctatctggaaaagaaaaactagccgaagcccgtaaccttaaagaattagatcaattgtttagctccgataacgcattggagtcttcaaaataa

SEQ ID NO: 448 - DNA, 840 bp, Lactobacillus salivarius
  isolated from gut, Lactobacillus salivarius
atgaaaattgcaatttctagtgataaccatttagatgtaaatcgacaagatcctgatgaaattgtgtccttacaagctaattatttaaataaacagaatgtggaatattatctttttgctggagatatgtttaatgattttcaaaagacaaagaattatcttgaaaaactaaataccttaattactgggaaagtttattttattgctggtaatcatgatatgctgaaaaacataacttttacagaactagaaaataataatatctctgatttttatctgcataatgcttacattgacattcctaatactgattggcgtatcattggaaacaatggatggtatgattatagtttctcccctactttgactgaggatgagattaagcgttggaaaaatacttattggattgatgctggtataaaacaaccaatgtcggataatgaacgtgagcaattagctttacagcaatccaagcaacaatttgatttagcaaaacaagctaaaaagaaagtgatatttgtaacgcattttgtacctaatagtaaagctttatggtcaaaacctgctactttaaagagtgacaaagaaattcgtatttttgaaatggtaaatgctcttttaggtagtcgacatttaggcaagttaattcaagattatcctgaaattaaatatgtattttatggacatgtacacggttggcatgaacctttccaaatagcaggtacgtcttatcttaaccaagctgttggtgtaagaaagaaaaaacgcaaatatcatgaatggcaaaaagatacttttatggatcaatggaagtatcggatgaacattattaatatctaa

SEQ ID NO: 449 - DNA, 726 bp, Lactobacillus salivarius
  isolated from gut, Lactobacillus salivarius
ttggatatattacaacaattatatggcccattttttgatgctaataactggcgaacagtagtcacttctggtgaagattggatgatcatcctatcactagtattgattgaatgtttattgtctgttgataatgcgattgttttggctgcacagacacaggtattaccagataaaaaacaacaagaaaaatctcttttttatggactttggggagcttatatattccgcttcatcttgattggtttgggagcctatctaattcatttctgggaaataaaagtggcaggggcagcatatttaatgtatcttgctgttagtcatttctatcgtaagaagaatcctaaaccaaagaaggacgggaagaaagctaaaaagcgtatattaccattattctggtcggtagttgtatccattgaaatgatggatattgtattctcggttgactcagttttagcttcattggcgatttcacctaatcctgtgattgttttaatcggtggattaataggtattctagcaatgcgaggaattgctgaaattatcatgaggttaatggaaattgtaccagaattagaaacgacagcatatggtttgattgcattaattgcaattaagctattcctaacaattcctatgattgatattgaaatccctaatctattatttgggataattgtactaggttcgattgtcgcaacctttattattcatagaattaagaattaa

SEQ ID NO: 450 - DNA, 1044 bp, Lactobacillus salivarius
  isolated from gut, Lactobacillus salivarius
atggcagaaagaattttagatgttaaaaatttaaaagtggatttccacacctatgccggcgaagttaaagccatccgcgatgtgagtttccacttagataaaggtgaaaccctagcaattgtaggggaatcaggttcaggtaagtctgttacaactaaagcaataattggtcttttagcaaataatgctaaggttgttggtggtgaaattaacttcaacggacaagacattttgaaaaaatcagaaaaagaaatgcaatccgttcgaggaaaagagatttccatgattttccaagatccaatgacttctttagacccaacaatgaaaattggacaacaaattgctgaacctctaatgaaacataaaggcatgaataagaaggatgcttgggcaaaagctcttgatatgttaaaggctgttggaattacaaatgctgaaaaacgtatcaatgactatccacaccaattttcaggtggtatgcgtcaacgtatcgtaattgcgattgcattggtatgtgatcctgaaattttgattgctgatgaaccaacaactgcgttagacgttactgttcaagcacaaatcttggatttaatgaaagaaatgcaagctaaagtaaaaacatctattatcttcatcactcacgatttaggtgttgtagctggtatggctgatagagtagctgttatgtatgctggagaacttttagaatatggtacagttgatgaagtattttataacccacaacatccatatacttggggacttttgaattccatgccaactttagcaagtgataagttagaatctattccaggaacaccaccagatttacttgatccaccaaaaggcgatccttttgctccaagaaatccatatgcgatgaagattgatgctgaacaaaagccaccattcttcaaggtgtcagatacacattatgctgctacatggttgttacatccagatgctcctaaagtaacaccacctgaagaaattgttagacgtcaggaaaagtatgcagaattaatggctaaaaagaaagattaa

SEQ ID NO: 451 - DNA, 567 bp, Lactobacillus salivarius
  isolated from gut, Lactobacillus salivarius
atgtttgattttatttggatttgtttagatgaggtgccaaatatgagctatatattacaaaagaaaattgctaatacttttcgcgaacagataatgaaaaaaggttttaatcatgtttcagtaagttctctaatgagaatattagatatcaggcgccaaactttttatgatagctttcaagataaatatgatctgctagagtggcaattaaatgacatcttggaagaaacaattgataataatattgactaccttcattggaaagaaattttaaagttgttcatttacgaaatagatgctcataaacgctactattatgaatgcttgacggtacaaaccgaggttaatgtagcagatatttttgcgacacatttggtagtattattagctcatgtactagaaagacaggaacttatctcaaataaaaaagcacaggataatatgtggatcctatgcttaggtatatctacaactataattcataatgttacgacacccaatccagtagattatgagttaattgtaaaacaagcaattaatgcaattgaatattcttttgagagttaa

SEQ ID NO: 452 - DNA, 801 bp, Lactobacillus salivarius
  isolated from gut, Lactobacillus salivarius
atgccacattttttacaagatattttagtaatattaatcgcagcatacatggcttgggataatggaacaggaaaccaaataacaggtaactggccagtaacaataggattacttgtagggttagtaatgggaaatgtaagtgttggtttagtgataggaggaacacttcaattaatgtcattgggtgtagcaggtattggaggctcttcagttcctgaatatggagtcgctacgattgttagcatttatttagcaattaggactggggcaagtacaggaacggccattgcagtaggattacccgtaggaatgttaacgcttcaattagatgtagttttaaagattattaataacttctatgcacattgggctcaaagattattacatgagaaaaagttcaaaaaaattgatgcagtattttatttaacagttgtaacatggatgcttaaatatgtaattcctgtaactttagtggtactctttggaacaccaattgtaaaacttatattaaatgtaattccaacttggtttactaatggtttgcaaatagctggtggtatgttacctgttgtaggtattggaatgttgttgagatacatgccagtaaaaaaatatttaacatatttaatcattggatttgttgctgctgcataccttaaagttccagtactaggaattgccttattgggtggagctgcagcttatgctgtatatatgaaaaatattcaaaagacaaatagtacggtagctacagcagagcaagatattgttaatgatgaaggagatgattttgatgagtaa

SEQ ID NO: 453 - DNA, 3024 bp, Lactobacillus salivarius
  isolated from gut, Lactobacillus salivarius
atggaaaatacaaaagcgaaattaagttggctagagaaacccgatgtttttgcaataaatcgtttggaggcttattcaagtcataaattttatgctagtcacgaagaatatcaaaataaggaaacaagtttaaaacaaagtttaaatggattatggaaattttcttatgcacaaaatccagatttaagagtaaaaaaattctataaagaagattttaacgatagtggatttgatacgataaaagttccaggtcacattcaaatccagggatatgatcatttgcagtatatcaatacacaatatccatgggatggattagatgaattacgaccaccatatatttcaagaaaatataatccagttggaagctatgttaagacatttacagtagataaatctttaaaaaacaagcgtatctttatctcgtttcagggtgttgaaacagcgatgtatctttggctaaatggaaaatttattggttatagtgaagattcatttacacctcatgattttgaactgacagacttcattagggaagattcagaaaataggttagcagttgaagtatataaacgttcatcagcaagttggatagaagatcaagatatgttcagattttctggaattttccgtgatgtatttctttatgcaattccagaagttcacgtgcgtgatatatttgcaaaaactactttagatgatagctataaggatggaattttgctattagatactaagttagaaggaaatctagaaaatacagaaattaatgtagagttatatgatgaagatcaagtagtctggtctcaaaaagaaaaagcacgcgggaaaacatttatagatataaaactggaaaatataaaaaaatggagtgctgaaacgccttatctctacgatttgaagattacattggtaaagaatggagaagtaattgaagtagcaactcaaaaaataggtttccgtagatttgaaatgaaagatggaatcatgctaatcaatgggaagcgaattatttttaaaggggttaaccgtcatgaatttgactatctccatggcagagcaatttctgaagatgtaatgctacatgatattaagtttttcaaacaaaataatatcaacgctgtaagaacttcgcattatcctaatcaaacacgatggtatgaactgtgtgacgaatatggtatttatgttattgatgaaactaacttagaaagtcacggttcatggcaaaaattgggtgaatgtgaaccatcttggaatgtgcctggaagcaaagaagaatggttagataatgtcttagatagggcaaattcaatgtttcagcgtgataagaatcatgcatctgtaattatatggtcatgtggtaatgaatcctatgctggtgatgatatcgtaaaaatgcatgatttcttccataaagtagatgattcacgtttagtacattatgaaggtgtaacttggaatcgtgattttgaggaagcaactgacatggaaagtagaatgtacgctaaacctcaagaaattgaaaagtatttgcaaggaaatccttcaaaaccatatatatcttgtgaatatatgcattcaatgggaaattccacaggtggtatgaagttatatacagatttagaagataaatatccacaatatcaaggtggtttcatatgggactatgttgaccaagcaatgttaaaaactgatgactttggcgaaaaagttttaggttatggtggagattttgatgagagggcaactgattatgaattttctggagacggtattgtttttgcagatcgtacaccgtcacctaaagctgctgaagttaagcaattatacgctaatgtcaaagcgaaagttactgaagaaggagtaattataaagaatgacaatctcttcattgacacaggtgcgtatatttttgaagctattgtaaagcgtgatggtcaaaaaatatggcagaaagattattcatttaacgttttaccacagacaaaacaagaagaagttattgattggccaaacattgaaaaaatcccaggagaatatatttttgaagtaaatgtttgtctaaaagagagtgttgcttgggcaaatgaaagacatgaattatcattcggacagttagtaactaaagtatcgactaaggataatgaaatagtatctggaaaattaaatgttgtgcatggtgatgtcaatattggtataaatggtgatgggtttagtgtactactttctagagctgaaggtggaatagtatctttggcttataatggtaaagagtatattacacgtacacctaaaacaacattttggagagcgatgactgataatgatcgtggtgttaagcatggtttcgatcgtggggtatggttgcaagcaggtttatatcaaaaattagttgatgttaatgtgaaggaagaattaagtgagataactgtttcatttaaatggaaattgccattagctaaagaagtatataacgtaataagttatacagttacaccagatggaaaagtaaaagtaactgctaaatattttggagttgacggactaccatcattacctgcatatggttatgagttaaaattaaaacgtaaatacaatcagtataaattctatggcttaggtccagatgaaaactatatcgatcgagataatggagtaaaactaggcatatacgaaggtgatgctgatactaatttagctccatatttagtaccacaagaaacggggaatcatcgtggtactagatggttggaagtaactgatgtatatggagaagggttaagatttgtggcaaacggtgatactttcgaaagttcagtacttccatatagcgaatatgaaatagaacaagcgatgcatcaagaagaattgagtaatcctcattatacttgggtaagattattagctgctcaaatgggtgtaggtggagatgattcttggggtgcacctgtacaaaaacaattttggattccatcaaacaaagatttgacagtatcatttacaattgaaccaacaatttaa

SEQ ID NO: 454 - DNA, 930 bp, Lactobacillus salivarius
  isolated from gut, Lactobacillus salivarius
atgccagcttctctacaagaagttaaacgtcgaattgaatcgactaaaaaaactagtcaaattaccagtgcgatgcagatggtttcaactgctaagcttagtcaaattcaaaagcatgcgactagttatcaagtttatgccaccaaaattcgcagtgttataacacatctttctaaatcacatttactagattcagtaaatactactagtaaaaatagtgatggaaaggtaaacactctaggaatgttaaggcagcgtccagtaaaaactacagggattgttgtcattacttctgaccgtggtttagttggaagttacaatagtaatgttattaaagaaactctcgaacttatagaaaataatcatcatagtaccgaagatgtagctattatagctattggaggtactggagcagatttctttaagaagagaggttataacgttgcttatgagtaccgaggaataagtgatattcctacttacaaggatgctagacctttagtagaggcaattgtaagtatgtatgataaagaagtatatgatgaattattcgtttgttacagtcattttgtaaatacattaacatcagaatttagagctgaaaaaatgttaccagtttcagctgaaaacatggggcatgatgacttaacaagtaatgatgaaggctacagtatcgaatatgaaactgaaccttcagaagatgcaatattagaagtagttttgccacaatatgctgaatctttggtatatggtgcaattcttgatgctaaaacatctgaacatgcatcaagttctactgcgatgaaatctgcatctgataatgctaaggatattatttcttcattagaattgcagtataatcgtgctcgtcaaagtgctattactactgaaatcacagaaattacaggtgctcaggctgccttagaatag

SEQ ID NO: 455 - DNA, 1044 bp, Lactobacillus salivarius
  isolated from gut, Lactobacillus salivarius
atgtcagagaaacatttaacaacagaagattttgattatgatttaccagaaagtttgattgcacaaacaccgcttgaagaaagagatcaatcaagaatgttgattctagatagtaagactggtgaatatcaagatgattatttttataatgtaattgatcaattaaatcctggtgacgcattggttatgaacgattctcgtgttatgccagcaagaatatatggtgtaaaaccggaaactggtggtcatgtggaagttttattactaaataatacacatggtgatgaatgggaaactttagttaaacctgcgcgtcgtgctaaagttggtacaaagatttcctttggtgatggagctttaaaagcaacagttactaaagaattggaacatggtggtcgtttaattgaatttgaatatgatggaatcttcatggaaattctagataaattaggagaaatgccattaccaccttatatcaaggaaaaattagaaaatccagaaatgtatcaaacagtttattcacgtgaagtaggatctgcagctgctccaactgctggattacactttactaaagaattgctacacaaaattgaagaaaaagatgtaaaactagtttacttgactttacacgtaggactaggaacattccgtccagttagtgaaaaaaatattgaagatcacaagatgcatagtgaattctatcgtttaactgaagaagcagctgcaactttaaacgaagttagaaaaaatggtggacgtattgttgcaacgggtacaacaagcattagaactcttgaaactattggtactaaatatgatggtgaaattaaagcggacagtggttggacagatatctttatcaaaccaggttatgaatggaaagtagtacaagctttcattactaacttccatttacctaagtccactttagtaatgttagttgcttcatttactggaagagaaaacattttgaatgcttataagcatgctgttgaagaaaaatatcgtttctttagttttggcgatgcaatgtttattaaatag

SEQ ID NO: 456 - DNA, 942 bp, Lactobacillus salivarius
  isolated from gut, Lactobacillus salivarius
atggagagagtatcaatgactgatattggaaaaactttacaaaatgctagaaatgaaaagcattatactttagatgatcttcaacaaattacaaaaatccaaaaaagatatttgatagcgattgaagaaaataactttgatgcacttccgggagatttctatgttcgtgcttttatcagacaatatgctgatacagttggtataaaagcagataaattattatcagaacttgatgaacaagccggtaagaagaaagtcgaagaaactgaagaagagccaacagaggctaaaacaagaacagaagcagttagaagacaacaacaatcaagtactccaagtcaagttagtcaaagctttgataagtttatgcattatttaccaacaatcattattgttggggttgtggttatcattataggttccatatactttgtagttgctggaaataaaaaggaagctaaccaagctgcttcaagtacaaatgtgtctatttcatcagatgtatcctcatcaaagaaatcttctaagaaagagtcttcttctgaagaagtaagcagtagttcaagcaagaaagaaagtagttctagcagtgaatcttctaagagcagtaagggacaaaagattactaatacagctgttagtggttcaagatttacttactcattaacaagccctgctaagaagaataagattaagtttacttctaaaggtggttctgcatggagcagcatctcagttaacggtacagcaaattggcaaggtacattacaaaacggtgcttctcatacagtaacattgccagaaggtactacaagttttaatattagtttaggtaattcaaatgtaactaatattacaatcaatggtaaaaagtttgatttcttaaaagaaaacagcacattaactgttcgtcaaattacagttaacgttgctaatgaataa

SEQ ID NO: 457 - DNA, 3525 bp, Lactobacillus salivarius
  isolated from gut, Lactobacillus salivarius
atggaattaatagatacttttttgaatgtctcggaattgaaagagtggaaaaagaatttaactactgatggacgacatatgttgacaggattggtaggctcttctaagacattgatgatagctaaactattaaaagataagaaagtaccacaattaattgtggaaagtgatttataccatgcacaacaattgcaaagtgatttagagaatataatagaagatacaagaattgaattatttccagtagaagatatgttagttgcagaaatggcaactagttctccagaatacagagctcaaagagtaagcgccttaactgcattaacttcagaaaatccagtaattgtaattactacagtagctgggataagacgttttttacctagtgtggagtactggaaacaacatgaaattcaattggagattggtaaagaagttgatccagccgaactagagaagaaattatttgaaatgggatatattaggtccaatatggtaaatgcacctggagactttgcgattcgtggatctattgtcgatatttttcctttagatgcagataatccgtatagaatagatttctttgatattgaaattgattcaatgaggacttttgatattgcaaatcaaagaagtattgaaaatgtggatcaagtaactatcatcccagctactgactttattgctagtaaagaagttctagagttggctagtgaaagaataaaaaaagaatataataagcaattttcaaaattaaagaatataaaagaagaaaagctaactgaaaatattcaaaaaatgttagctgattttaaagatggttttttaaaggctgaatacctaccatatgcggaatatatttatccacaaagtacaaatttaattgattacttgagtgatgaagggttagtaatctttgatgactattctcgtttgactgagaagcaaaagaacctagaatattctgaagctgattgggtaacggatagactacgtactaacagtttatttgataatttaaagctgggacatgattttagaagtgtagaaaagaaaattaaacaacctagaattttcttatcgttatttcaaaaaggactaggcagaatgaagtttgcccaacttgtagatataaagacacgtgctgttcaaaagttctttggacagatgccacttttgaagactgaagtttcacgttgggaaaaacaaaaacaaacagttgtatttttgattaatgatagagaaagactggaaaaggtctctcaaacattagatgattttgaaattaagtcgattataacagataagaacgcaattcaagttggagttacacaagtagtccaaggtttcttaaatgaaggatttgaaattcctaaggataagctcgttgttttaaccgaaaatgaattattttctaacgtgaagaaaaaacaacctagacgtttaactatgaataacgcagaacgactaaaaagttatactgagttgaaaaagggtgactatgtcgttcatgtcaatcatgggattggacgctatatggggatgcaaactttagaagttggtggacatcatcatgattatatgaccattctctatcaagatgatgcgaaactttttatcccggtatctcaattagataagatacaaaaatatgtgtcttcagaatcaaaaacccctagagttaataaattaggtggctctgagtgggctaaaactaaacgccgtgttgctaataaaattgaagatattgctgatgagttagttgatctttatgctaaacgtgaagctgaaaagggatacgcatttactcctgatgatagctatcaaaaagagttcgaagatgcattcccatatacagaaacaccagatcaactgcgaagtgctaaagaaattaaacaagatatggaaaagactaagccaatggatcgattgttaattggtgatgttggttatggtaagacagaagtggcattaagagcggcttttaaagcggttcaagatggtaaacaagttgctttcttagcgccaacaacagttttagctcagcaacattatgaaacaatggaacaacgttttgaaaatttccctgttgagattggtattttatctagatttaatacagccaaggaaattaaagagactattgaaaatttagaaacaggtaagttggatattgttgttggaacacatagattattgtcaaaagatgtaaaatttgcagatttagggttattaattattgatgaggaacaacgttttggagttaaacataaggaacgattaaaagaattgaagacaagtgtagatgttttaacattaacagctacacctattccaagaacgttaaacatgtctatgttaggtgtacgtgatttatcagttattgaaacagcacccatgaatcgttatccaatacaaacttacgttattgaaaaaaattatggagtaattgtagatggaattaagcgtgaaatagagcgtgggggacaggttttctatctgcataatcgagttgatgatattgaaaaagttgctagtgaattagaaagtttagtacctgaagctaaagtagcttatattcacggaagaatgaccgaaacgcaactagaaaatattttgatagattttatcgatggtgagtatgatgttttagtcacaacaacaattattgaaactggtgttgatattcctaacgtgaatacattatttgttgataatgcggatagaatgggattatcacagttgtatcaattaagaggacgcgttggacgatcaaatcgcattgcatatgcttactttatgtatcaacctaacaaagtgttaacagaggttgctgaaaaacgtctggaagctattaaagatttcacagagttaggttcaggatttaaaattgcgatgagagacttatcaattcgtggagctggaaatttattaggtaagcaacaacatggtttcattgattctgttggatatgatttgtatacacagatgttaaatgatgctgtagctaagaaacgtggtaaagagattaaagttaaaacggatgctgaacttaatcttgatttagaagcttatttgccagcggactatattactgatcctaaacaaaaggttgagatttataaacgaatccatcaatttgaaaatgaggatcaatatatagaagttcaagatgatttaattgatagatttggggaatatccaatagaagtacacaatttattagaagttggcctattaaaaatgtatgctgatgcagctttagtagatagtgttagccagaataaaaaaacaattgaaattgagttatcagataagttaaatgggaaattagacattaaggatgtttttaaagtattatcggtaactaaatttagtacgactctgggaaataaaaatcaaaaaattcaaattaagttaaacatccaacctggcatggaaagtaatcaaattttggaagaattaaaaaaattactcaaagaattagctaaaatggtggatgtcactatggataaatcagcatag

SEQ ID NO: 458 - DNA, 1620 bp, Lactobacillus salivarius
  isolated from gut, Lactobacillus salivarius
gtggaaattttaatggataacttaagcagtaaaaattatatttcctggcctattctaactctaatggcctttgttactgttatcggttttgatgatattatgtataattttcaaaaccaaggaatgactgttattacttcctgggttttgatgctatttttatatgttattccttattctttaatcgttggacaacttggtggtatttttaataaagaaggtggcggtcttagttcatggattcgtggaactaacggagaatttctcggttacttcactgcttggacttattgggctgcttccgtaccttacgtagttgattctgcaaattctgttgtagttggttttggctgggcatttactggatcaaataaatttcaagatacaatgtctaatgccgaatttacattttggacttttttaattttcatcgtatttatttttattcaacgtcacttgaaaaattcaatggaactcctttctacaatcggtggcggtatgatgttcatcatgacaattttatttgttgttttagccttttttggtttagctaagaatggcggtcatatggcaactcagcctatgacttggaaaacaattatccctaaatttgatctaaaatactggtcaactgttggtatgttaatctatgcagttaatggttgtgaactcattgctccttatgttactaagatgaaacaacctaagcgtgattttcctaaggcaatgatcgctttatcaatcatgacagctttcttaactatttttggttcatttgcattaggtatctattttaatgcttatcacttaccaaatgatttaaagatgaatggttcttactatgcttttcaagctttaggacaacaacttggtgtgggtaaattgttcatgtacatctacgcttggacttctgttctttatatgtgtgctttactagcggttctattagatgctatgacacgtatgttaatctcagacactggtgataaattcatgcctaaattcttacgtaaaactaatagcgatggcttacctattaatggctatattttaactagctcattatcagctttcatcatgctattaggggtattcttaccagaaatgaatgatgtatttaattggcttttgaatttaaacggtattatttctcctggcgttacctgctggattttctatgccttcatgcgtgttcgtaaaaattcagctaaatatccatcagaatatgtttacataaaaaatgacaaactggcttatattgttggtttcttgttacttgctgtaactgctattgctactattttgggaattacacctcaagatgttaagcaattcagtcatacatggtggtatgaattaattattaatattgttgcaattgtagttttaattggtttaggtgctatcttaccttctatccgtcgacgcgaagaaaaatatggtatcgcctttaataaaggtcagtggattgctattttaggcattgtcattgtatctattatttttaatctctggcttggtggtactcatctagcttggcgcggattatatattgcaattgaatcaattattgccttgattgtaattactatgataggtcgtaagaatccaaatatttaa

SEQ ID NO: 459 - DNA, 2979 bp, Lactobacillus salivarius
  isolated from gut, Lactobacillus salivarius
gtgaataaagagagaaaaaatataggattagctatattgcttatattcagttctttattagtatgtttagatcgaatattttggcaatctagtccagatattttaataaacgataaagttaatatacaacaatctttaatgcagatatatcatgcatctaccttgataggaatcgatatttttgccataggcctaggatttttactacaaagtagtgaagataaatcttggagtagtgctataaagtattggatatatactatttttgtcggtacattaggattgctaatattaacgttatttagtagagaattttcaatagtagacttatacaatatgttatttccatttgttcgcaatacttatgggatattatcaggtatagtactaggaatgttgacgttacctttatttaataaaggagttaagaagtatgaaaatataataaagttaagtttactattggtaataatagctcctactattttcaataaagatatttttggatttgctaatggaacagtttttggatacatcctggttaatttgggattttatggaaattatatcaggtcaaaactaagtgtaaaaaaagtagtaacaaggataattttattacttttgacaaatattattgtagtatcccttatgcctgaatttagtaaagcggtacataatgatctgtcaactgctggacgttttactaattcagcttcagcgttattaattctattagctttttatattgttctgttagtgtcgaagataaaagtaaatgtaaaaaatggttatgtagatttcataatctatacagcatgggctttactagtaattagtaataatcaaactcttttgaataagttaatcgaatataatcgcaaaactgcacaaagcgtaactagatggattttggccaaagatattaaagagatactatggctgatgttaattgtaatcctttctgactttataatattaggaatttgtaagttaattgggatatcacaaaagatttcaaatttttatgacatcagagcagatgaggaactctctcaattcttttatagaattactaatggaataaaaagttggataaaagcacatcgagtgtacctagcaacaattgcttggggatatttcttagcaatcttttcatttttaatgatgaatacaaaatggactgtagcacctaatgttgacgtaaaatataacatcttcacatatacaattggtgtaagacaggcaatggttcttgtaaatgcaataatatttttgctatttttgaaatttattttcagtctgacaaatagatattggttttcaacaattgtggctagtttactgtggataatatgggtagtagctaatcgaatcaaaataggcattcgtaatgaacctattttgccatctgaattatcaatgattaaagcttggagaagcttattagggatggtagatggttggatattacttttagttgtttcagtaattgttataacgattccaataatctacttcttagaaaagaaatataggctgcctaagcaaaaatggtatagtcgagtagcttggttaataataattccagtaattttcagtagcgttactttcctaaatcatgaaaaatctgtaatccacataatttctggtggaataggtaatgatcctactttttataatcaattagctggtgcacaaaagaatgggcctactcaacaatttttaaataacatagatgttgaggttatgaaaaagcctagtggatattctaaagaaagaatgcagcaattaaaggataagtatagaaaagttgcaacagatatcaacaaaaatagagtaaataatttcaaagatcaagttgttatctttaatttaagtgaaagtttttctgatcctaaccgagttccaggaatacaattaagtaatgatccaatcccatatattcgtcaattaaaacaaaagacgacttcaggcactatgataagtgcaggttatggtggtggaacagccaatatggaatatatgtcattgacggggcttgatttgagcaacttttcgcctacattaccaacaccgtatacacagttggtaacacatagaaaatataatcctaatattgcacaatccttcccagaagtagtcgctatccatccttaccaaggcgtttattatagtagaacagaagtgtataaacgttttggattcgatagattctattatctagggagcaaatacaaaataaaatacaagaagaagatagatagaagtccatatttatcagatgaaactgcatataagaatgcattggatcaggtgaaaaaagccaataatggtgaatttataaatttagtaactatgcaaaatcatttcccttatgatcgtaattactataataattcagataagtatacgccagtaggtgaaggaattgatgattatactagaaatgcggtccaagatttttctacaggattaagttatacagacacagctgtgaaagactttatcagtgaaattgataatttagataagcctgtaactcttgtgttttacggagatcatcttccaggaatttatggcggagtagatatgaccaaatatggaatccaattgcattcaacggattactttatttattcaaataagtatgcacgagaacatggtgctagaaatttagtcagcaagactgaatatgtaggaccaaatgactttattgcattaatggcaaaacaaactaactcaaaagtaaatgcttatcaagctttattaacggaagttcaagaaaaactgccagtagcaacgcttaatacgcaaaagtcgactgttaatagttataatacacatacagaatttgtagataataatggaaaaattgtaaaatataaatcattatcgaagaaacaaaaacaattgtgggaagactacaagctattgcaatacgatataactgctggaaaaaattattggaagaataattaa

SEQ ID NO: 460 - DNA, 864 bp, Lactobacillus salivarius
  isolated from gut, Lactobacillus salivarius
atgaaaaaatattatttaggttttgatgtaggtggtactaccattaaatatggcttgattgatcctgaattaaacattatcgaaagtagtagttgtccaactttagaaaataaagatggtcatattttaaaaagcctaaagaaaattactgaagaaatgatgaattcttacactttgctaggaattggtgttagtacagctggcattgttggtaaaaatggtgaaattcaatatgctggtccaacaatcccaggatatataggaacacctataaagaaggagttagaagaattatctggattaccagtatcagtagttaatgatgtagatgctgctttattaggagaacgtttagctggtggtgcgaaaggcagtgacaatgtttattgtatagcgttaggtactggtataggtggtgcatatttttatgaagggaaattattttctggtgctcatgctggtgctaattctattggttatgctctttatgataaaaatactaaaacagactatcagaaaagagcagctactttaagtttagaagcttacttgaaaagatttgatacatctgtaattgatgcttttgaaaaagctaaagctggtgatgaaagatttaaaaagattattgaagattggggagatgaagtagcacgaggtgtagcagaaattattttgttatttgatcctgaacttatcttattaggtggtgcagttgctaaacaaggagaatatctagttgatttagtagaaagacatcttgaagaatatgttcctaaaggattgatacagacacaaattaaggttagtcatttagcaaataaagcacaacttttaggtggaattgctgagctagtaaatatataa

SEQ ID NO: 461 - DNA, 510 bp, Lactobacillus salivarius
  isolated from gut, Lactobacillus salivarius
gtgattttcttgccattgactgatgaacaaaaagtgaaatttatgaaagaagctttatttgaagcaaaattagcagctaagattggagaggtgccaattggctgtgtaattgtaaaagatggaaaaatcattgggagagggcataacttaagggaacatagtcagaatgctacactacatgcagaaatgttagccattgaggaagcaaatgaaacagttaatagttggaggttagtcgatactcaactttttgtaacattagaaccttgtccaatgtgcagtggagcgattattaattcaagaattcctgaagtatattatggtgcatctgatcctaaagcaggaactgtaggaacattgatgaatttacttgaagatagcagatttaatcatcaatcatttgtagaaaaaggaattttagaaaatgaatgtgcttctattctgaaagatttttttaaatcgattaggaaaaaaatgaagaaaaaaagaaaaaatcgagtgaaagactag

SEQ ID NO: 462 - DNA, 963 bp, Lactobacillus salivarius
  isolated from gut, Lactobacillus salivarius
atgaataagaagttaattggtgttgatttaggcggtacaacaattaaatttgctatcttgacactagatggtgaaattcaacaaaaatggagtgttgaaactaatattttagacgatggtaaacatattgttcctgatattgttgaatcaattaatcatcatttagatttatatgatatgaagccagaacaatttgttggaattggaatgggtacaccgggaacagtagatattgaaaatggtacagttgaagcagcatttaacttgaactggaaagaaaagcaaaatctaaaagaagaaattgaaaagggcactggtatgaagtttgctgtagataatgatgccaatgtagcagcattgggtgaacgctggaaaggtgccggagaaaatgatgatgaagtaacatttgttacattaggtacaggtgttggtggtggtgtcatcactaatggtgaaatggttcacggagctggagctggtggtgaaattggtcatataaatgtacaaccaaatggctatttgtgtacttgtggaaatcatggctgtttagaaacttatgcttctgcaacaggtgttgtacgtgttgcacgtgatatggctgaagaatttgctggaaagtctgatttaaagaaaatgttagatgatgggcaagatattagttctaagatagtatttgatttagcaaaagatggcgatgttttagctgaacgtgttgtggatcgtgtttgctactatttaggatttgcttgtgctaatattggtagtcttatcaatccatcatatattgtaattggtggtggcgtttctgcagcgggtaagttcttattagatcaggttgatagttactttaaggaatttgctttcccttcagttaaaaaatcaactactttaaaacttgctgaattaggaaatgaagctggagttataggtgcagcttcactagctttaaaatttaataagtag

SEQ ID NO: 463 - DNA, 3000 bp, Unknownn
  isolated from gut, unidentified
atgtataaagcaggtaaaaattgggtctttgcgatgttatcaactatagctttaacaggcgtaatggcgatgagtgttaatactgctaaagctgatacagttgctcaaagttcaactgaacaaattgccaaggtagatacaacaagttcaactacaacttctacacaagctacaacgcaattagaaaaagcaacaaatactacaaatgaaagtaacgctactcaaacagcagcaactactacaacagaacaaagtagttcaaatgctagtgctacaagtagtagccaaaacaataagcaagcaaccacaacatcagtatctactcttcaaagtacttcagtagctaataaggatcaagctagttctactcaaagttcaactacacaaaagagtgaagaacctaaagtagaaacaccagtaaatactgctgataatgctagtcaaaagaatgttaacggaaattggtatttagtagataataacactggtaagaacttgactggattccaagaaatcaaggatcaaaataaagtagtttactatgcaccaagtaatgcacaaatgcaatatggttggcaaaatatcaatagtaataaatattattttgataaatttagtggtgcaatgactacaggtcaaagaaatattgatggtagttggtacttgtttgataaccaaggtgtaatgcagactgggttccaaagaattgaaaatcaaaataagacagtatattacaataagaacggtcaaatgcaatatggccaacaagtagtaggaaaccattggtatttatttgatagatatagtggagcaatgttgacaggtttccaaaacttagcactatacggacaaaataagacagtatactataataaagatggacaattgcaatatgggttaaataaaatagatggatatacttacttattcgataaaagtagtggcgcagtacaaacagggttccaaagtttagcgccatatggccaaaataaaacagtatattttgcgtcaaatggccaaatgcaatatggacagaagcaaataaatggtcactggtacttatttaataaagatgatggagcaatgcagacaggtcttcaaaacttagcaccatatggccaaaataaggtagtatattatgcttcgaatggacaaatgcaatacggtcaacaagtagtgggaaaccattggtatttatttgatagatatagtggagcgatgttgacaggtttccaaaatttggcaccatatggacagaataaagtagtttattatgacgaaaaaggtagaatgcaatatggactaactcaagtaaatcaaaaggtatattacttagacagagttagtggtgaagttcgtaaaggccaacaggtagtaggaaatcattggtatttattcgataaaaatagtggagcgatgcaaacaggtttccaaaatctagcaccgtacggacaaaataagacagtatactataataaagatggacaattacaatatggattaaataaaatagatggacatacttacttattcgataaaagtagtggagcaatgcaaacaggtttccaaaatttagcaccatatggtcaaaataagacagtatattttgcatcaaatggccaaatgcaatatggacagaaacaaataaatggtcactggtacttatttaataaagatgatggagcaatgcaaacaggtttccaagacttaacaccctatggtcagaataaagtggtatattatgcttcgaatggccaaatgcaatacggtcaacaagtagtaggaaaccattggtatttatttgatagatatagtggagcaatgttgacaggtttccaaaacttagccccatatggtcaagataagactgtatactataacaaagatggacaattacaatatggtagtcaagttattaacggtaaaaaatactactttgataaatcttctggcaagatgtatataggtgtagcatataatgctgatacaagaacaattcaatattatgcatcaaatggtcagatgcagtttggcaaggtaaatatatctggtaaaacatatgattttgatgataagactggcaatcttttgatgcaagggttagtaacattaggtggtaagaattatttattagattccaactataaggcaataactggtcaacaagttatcggcaatcattggtatttatttagtaaatacgatggatctatgcaaacaggtttccaagatttaaccccatatggtcaaaacaagacggtatactatgcaacaaatggtcaaatgcaatatggtaagcaaaacattggtggacattggtatctatttgatcaatatagtggtgcaatgtacaaaggttggttaatatcaggtaatgactggtattactacaaccaacaaaatggacagttacaaacaggtagtgctgtaattaacggtgttggttataactttgatggcaacggtaaacaaattttgaactactccatcgactatagatatgcattgccagcaggtaagggcgatgatgaaacagctgctaacaactacattattttgcatgacgttggtgtagagtcaggtgctgctgctaatgccagatacttccatgatacagtagatacaaataaggcatatgtaacatttgttgttggtgatggtggtaaagtttaccaagttggtagaccaggacaagtatcttggggtgctggtagagttgctaaccacaatgccccagttcaaattgaacttggcagaacatataattctggtcaattctggcaagactatgtaacatatgtcagagtagctcgtgatatggctggtaagtacggcatacctttgacattagatgcaggtggtgctggaactagaggtatcaagagtcactactgggtaacaaagaatatctggggagaccatgttgatccatacggatatctaagtcgctttggtgttacacaagctaagttagcacatgatttattgtatggtgtgtaa

SEQ ID NO: 464 - DNA, 1608 bp, Lactobacillus salivarius
  isolated from gut, Lactobacillus salivarius
atggaaaaaatgacggaaaaacaaagaatgttctgcagtatatatccatatacgacaaaatatatagaggcttttaataatgaatattccgataataatttgagagacgaagttattgattatttaaataaggtaattcataagtttagcaatagtagtgtttctcaaagtatagatataaatatttgtttagtttctaatggaaaagaacaatcagaagtctttttagacatcttatataaactcattaaggtactcaaccctagttttggggataaaacttatattatgcctgatcagtatgaatatctggaaagtgtagaaaataatgcatttataataattcaagatgctaagtctgcctttggtggagatttacctgaagatagacgtggatataagatcgattataaaaactatataatggagatacttgaaaggtctgacagtcaaaaaataatcttgttagaagatacagaagaaaatattagctatataaattctttagaagaagtgagaaacaatcttactaattatttcgtaattagagatttgacaattgaagaagctatcaattatggcaagagtctcctatataatcaaggtctaagtttagaagatgatattttatatggaaatgtattaaagtcatatgtgcaaaaaagcaagcatttgaccaagcgtgttgttgaacgttttaataaaaagatattaaatagttttgctaaaaacagtagaatgtcgaatgtaattgataaaaaatccatcttagatgccacaagtgtatataatcctaagctagttaagcaaatcttggatgaattagatagtctacaaggattggataatgtgaagcaacaaattcatgagatttgtgaggcagtggaagtttcacaggcaaatattggaaatatggaattatccagaagacatcatatgatttttgaaggaccacctggaactggtaaaacgacggttgctagaatagttgcacgtttattctatgcactaggtattttagagaatacaacggtaattgaaactaaacgtaatgaattagaaggtaaatgggttggtgatttaagtggaaaaatcaatgaaaaggtagattctgctttaggtggagtacttttcattgatgaagctcatcaactttataataaagaggatccttatgacaaaggaaaacaagttattcaggcttttgtacctcgactagaaaatgacggagaaaagtttatcgcaattattgcaggatatactaaagaaatggaagaatttttgaaatttgatccaggattggcttccagattccaacataaaataatttttgaatcatataagccccaggttgtagctcaaatagtggttaacattttaaagaagaacaaaatagagtttaatgaaaaatatgtaaaagcagtggcgattaatctttatgatcaaattccagatgataaaaaatctaatgcacgttgggcaagaaattatgctcaaaaattgatagaaaagcaattgagttattgtgctaagcatccacaatttcctagaaatagattgtttaatgaagttctaagagatagcgttaattggcaaatagggggttag

SEQ ID NO: 465 - DNA, 2193 bp, Lactobacillus salivarius
  isolated from gut, Lactobacillus salivarius
atgttatgccaaaattgtcataaaaatcctgcgacaattcacttaacaactaatttaaacggtcgccaaacctctattgatctttgtcaaaattgttaccaagaaatcaaaaatgaagctaacggctttaataatattggacaagatccatttggttttggtagtttagatgatattttcaaagctatatccaatcctaatttttctaaccaacaaaacatgtctcaagagccacctacacaaaatgatcgcataggtggaaataatggtaatcgcaacggtggttcatctattctgggacaatatggattagatttaacagaagaagcaaaaaatggtcaaatcgatccagttattggacgtgataaagaaatagccagagtaattgaaattctaaatagacgtactaaaaataatcctgttttaattggtgaagctggtgttggtaaaactgctgttgttgaaggactcgcccaaaaaattgttaatggcgatgttcctcaaaaactaatcgggaaaaaagttattcgtctagatgttgtttctttagtacaaggaactggtatccgtggacaatttgagcaaagaatgcaacaactaatgaaagaattgaaacaacaaaaagatgtaatcttatttattgatgaaattcatgaaattgttggtgctggtaatgctgaaggtggaatggatgctggtaatgtgctcaagccatctcttgctcgtggagaattccaattagtcggtgctactaccctaaatgaattcagaacaattgaaaaggatgcagcacttgctcgtcgtcttcaaccagtccaagttgatgaacctagtgtagaagaaactattaaaattctaaatggtattcgtaataaatatgaagcttatcatcatgtaaaatatactgatgaagctttaaaggctgctgtaactttatctaatagatatattcaagatagattcttacctgataaagcaattgatttattagatgaatctgggtctcgtaagaatttaacgattcatgcaactgatccaaaaattattgaagaacgcattaagaatgccgaaaatcaaaaacaagctgcactaaaagaagaaaattatgaaaaagctgcttactatcgtgatcaagtatcacgttttgaaaagatgaaagacaatgtttcagatgaagatactccggttgttaccgaaaaagatatggaacatattatagaagaaaaaactaacattcctgttggtgaattaaaagctaaggaaaaggaacaacttcgtgatttaggctcttcacttgaaaaacatgttattggtcaagatgaagctgtagataaggttgctcgttcaattcgaagaaatcgtataggtttcaacaaatcaggacgtccaattggttcattcttattcgttggtcctactggtgtaggtaaaactgaaacagctaagcaattagcccgcgagttatttggtactgaagactcaatgattcgatttgacatgagtgaatacatggagaaattctcagtttctaaattaatcggttctcctcctggatatgttggctatgaagaagctggtcaattaactgaacaagttcgccgtcatccttatagcttaattttacttgatgaagttgaaaaagctcatcctgacgtaatgcatatgttcttacaaatccttgatgatggtcgtctaaccgattcccaaggaagaacagtttcatttaaagatactatcattattatgacaagtaatgctggtagtggtgattctgtagtatcagttggttttggagctgaagcaaatggttcatctcattcagttattgataaattaaccaagtactttaagcctgaattcttaaatcgttttgacgatatcattgaatttaatccattgtctaaagataatttagtcaaaatcgtccgattaatgctagatgatgttaataaaatgatggctgatcaaaatatgcacattgatgttagtgataaagtcgcagataaacttgcagaattaggttatgatcctaagatgggtgctagaccacttcgtcgtgtaattcaagaacaaattgaggataaaattgctgatttttatcttgataatccaaatgttaaaaattttgttgctgatctagatgaaaatggtgatatcgtaattaaatctaagtctgaaaaaaatgaagactaa

SEQ ID NO: 466 - DNA, 1500 bp, Lactobacillus salivarius
  isolated from gut, Lactobacillus salivarius
ttgtttttaggaggaagaattttgaaatttggcgaattaggattagataaaagtttgttaaaggctgtaaagagaagtggttttgaagaagctactcctattcaagcagaaacaataccacttgttttagctggtaatgatgtaattggacaagcacagacaggtaccggtaaaactgcagcctttggtttgccagtattacaacaattagatttggatttgagacaaattcaagcagtaataatctcaccaactcgtgaattagcaattcaaacacaagaagaactttttcatttaggaaaagaaaaaagagctaaggtccaagttgtgtatggcggagctgatattagacgtcaaattaagcaacttgaacaacacacaccacatattttagtaggaacaccaggacgattacttgatcatattcaaagaggaacaattaacttggctcatgttaaacatttgattttagatgaagctgatgaaatgctagacatgggattcttggatgatattgaaaagattatccaagcagtaccagctgaacgtcaaactttattattctcagcaactatgcctaaagaaatcttgaagattggcgaaaaatttatggttaatccacaaattgtaaaaatcaaagctaaagagttaacaacagatttagttgatcaatattttgtgaagacaaaagaatttgaaaaattcgatattatgactagattaattgatgttcaagctcctgaattaacaatcgtttttggtagaactaagcgtcgtgttgatgaactttctcgaggtttagaagcacgtggttacaatgcagctggcattcatggtgatttgactcaacaacgtcgtatgaacgtattacgtaagtttaaaaatggagatttggatatcttagtagcaactgatgtcgcagcccgtggtttagatatctcaggagttactcatgtttacaactatgatattccacaagatccggaaagttatgttcaccgtattggtagaactggtcgtgcaggacaccatggaacttccgtaacatttgttacacctaacgaaatggattacctacgtgttatcgagaaattaactaagaaacgcatggatccattgaaaccaccaactcaagatgaagcatttattggacaagtttcaagtgctttagatgatattaaagatttaatagctgatacagatacagaacgctatgaagcacaagcacaagcactattggaacaatatgatgctgttgaagtagtagcagcctttttgaataatatgactaagaaggatgcttctgatgttcctgtaaagattacaccagaaaaaccattacctcgtcgtaagaaaggtcgtcgcaatggtaattatcgtcgtggtaatgataactttaagcgtagtaagagatttaataagcacgatagaaataatcgtgataataagcgcagaagtggcaaaaaaaatagatttactattagaacaaagaaagcttaa

SEQ ID NO: 467 - DNA, 1686 bp, Lactobacillus salivarius
  isolated from gut, Lactobacillus salivarius
atgactgaagataaaggaaaacgttatggtgcagatgccattattgatagtttggtaaaccatgatgttaaatatgtttttggggtacctggtgctaagattgatagggtatttgaaagattggaacatccaacaaatgaaaaagcacctcaattgattattactcgtcatgaacaaaatgctgcatttatggctcaaggtattggtagaattactggtaagccaggtgttgtattaactacatctggtcctggggtgtcaaacttagcaactggattagttactgcaactgctgaaggggatccagtgttggcaatttctggacaagttcaacgtacagacttattaagattgactcaccaaagtatggacaacgttgcattattagctcctgtaactaaatatgctgctgaagttcaagaaccagaaaatatttctgaagtaattgctaatgcttatcaagaagcagaagctgcaaagcaaggtgcaagttttgtatcagtaccacaagacgttactgattcagaagttaaaactgctccaattgctccaatgccagcacctgttttaggaccagctagtcctgtagaatcaacattattagcccaacgtatcaaaactgcaaaactacctgttcttcttttaggtatgagagcatctgatccagaaacaactaaatctatcagaaacttagttgaagaaactcatttaccagttgttgaaacattccaaggagcaggaatcattcctcgagaattagaagatgatttctttggtcgtgtaggattatttagaaaccaacctggtgaccaattattgaaacatgctgacttagttatcgctgttggatacgatccaattgaatatgaaccacgtaactggaataacgaaggtgacgcaaatatcatcgtaattgattctatgcgtgcagaagtagataagaacttccaaccagaacgtgaattggtaggtgatatttctcaaactcttgacttcttattaccatacatgaaaggtttcaagttgcctgaaagttcacgcgaatatttagatggactacaagaaaaattaaaattaagagatgaaccaccagcagttactgaaaatcaagttacttcccatcctttaagcattattcaagctttacaagatagagttactgatgatatgacagttagtgttgatgttggtagtttctacatttggatggctcgtcactttagaagctataatccacgccacttactatttagtaatggtatgcaaacattaggtgtggcattaccatgggctatttccgctgctttagtaagacctaatacacaaattgtttctgtttctggtgatggtggtttcttattctccagtcaagatttagaaacagctgtacgtttgggcttaaacatcgtacacattatttggaatgatggacactatgatatggttaagttccaagaagaattgaagtacggaaagagtgcaggggtaaactttggtagtgtagactttgttaagtatgcagaaagttttggtgctactggtttacgtgtagaaaaagctcaagacttagaaaaagtattagaccaagcttttgcaactgaagggcccgtagttgttgacattccggttgactacagcgacaacaaagaattaggtaagcaaattcttgaagatcaacttcactaa

SEQ ID NO: 468 - DNA, 591 bp, Lactobacillus salivarius
  isolated from gut, Lactobacillus salivarius
atgacaacattttatattatccgtcacggacaaagtgaagctaatgctaagggaattcttcaaggtagccaaattgacactccactaactgaacttggacgctctcaagctcaagttacactttcaaaacttggaactgacaattttgacgctatctatgctagtccgcttttacgagctgctcaaactgccactattatcggtggtagtgataaaactattacttttgatcctcgcctaaaagaatatgattatggcacttgggacggagaaatcgaagctgatatttggcaaaagtatccccaatatttcgatgaacatcacaatttacttcctaattcttgggtggattcaaaaggtaatacatatttagaagtaaaatcacgtttagaatctttcttcgatgaagttattgctcgacatccagacgactctgtgttagttgttagtcatggtttcaccatcaaattaatcttagattatattctcaatatcggtaatctagttaatattagtgaacctacaaatgctggtattactaaggttaaaatgactaaagatactaaaactgttatttacttcaatcgctaa

SEQ ID NO: 469 - DNA, 2010 bp, Lactobacillus salivarius
  isolated from gut, Lactobacillus salivarius
ttggtatatgcagataatataaaagttaacggagatttactgacattaacaggaagatggttagaaggaaaacaacagatatgtacttattattatttaaaatctaaagcagagcaaaattattttaaaaaacaaataaatagtgatgtatatactgtaacaggaaaaattaaaggaatttctcctcctactaatgaaaatgaatttgattataaaaaattttgtcaaagtaaaaagatatataatgggttaactgttaaacatataagtttagaaaataataaagttccctctaaatataaacttttatgtaaattacatgatttaagaaaaagtataatatgttatctacaattatttcctaagtatttacgaggatattcaacagccttaatagtagggtatagggatgatgtatttgatgatgtaaatagtagtatcaaagaattaggcttattatatctttttagtttatcaggaatgcatgttttttatttagtgaaaattctgcaaaaattagcacaaatactacggataacagcagagacggtagatatgtggttgatcatttgtcttcccatatacatgattttagcaggttcttcatcaagtattatacgtgcagtatttatggtatggatacctatatttagtagatattttttatcaataaagatagataaattaacttcatggtcattgacgataattataaacctattatattcaccaatgatattatttactatggggatgcagttaagctatttgttgacgttagttttaattctaaatgaggaagaaaatagcataaagattggtataaagatgagtggatatagtataccattaatgttatggcatacatatcaatggaatgtactaactacttttctatctatatgcattattccaatttttgaatatataattctaccatttacaataataggagtactattaaatgtcttctcaaaaattagtaatactattttgtttttaatttcgatcttctttgagaaattagcagatagttcacctatgataatttttgggaaaccgtatctaacggtagttatactattgctatcacttatgatctgtttagaagttagcaggagaaaaaatgtaattatttatctacaagtattggtatatattttttcatatagtcaaatacatcgaaataaagacgaattagtttactttgacatcgggcaaggtgatgctactctaatcagagaaaaaaataataatcaagtaattttagtagatacaggtggaaaagttagttttaagcatgaaaaatggagaagtaggacaagccagactagtggcgaaaggattatagtcaattatctgttaagtaaagggattaattcgatagataagctttatttaacacatcaagatgcagatcatgttggtaattttccaagtattagtcaaaaaataaagatcaaaaaaattttggttcctttaggaatggagaaattatcaagttttaataaaagattgaatgaatcgaatatctgtaatgataaagtggtagagcctattactgatactagtgatttttctaaagaaagaatagatattttacatccatttgttgaaggaaaagggaaaaatgaagattctatagttctaaaatatactatgggcaggctaatttttttaattacgggtgatttagatcaagaaaatgaaataaaagtaatagaaaagtaccctgacttacggtgtgatattttaaaagtaggacaccacgggagtaaaacatcaactgcagatcaatttgtaaaaattttaaaacctcaatatgctattatttcggtaggtcttaataataggtatggacatcctaatattgaaacattgaggacattaaatgcaaatggtattccatatttaatgacttccgataagggaatgataaaagtagtaaatgtgtctaaagacaaattttttatgagtactaaatatggaaaaatattaattagaaagtga

SEQ ID NO: 470 - DNA, 303 bp, Lactobacillus salivarius
  isolated from gut, Lactobacillus salivarius
atgacaatggcaaaacagaatcaagatgaaaacttaattacattagttgacgaacaaggaaatgaaactttataccaagaattgttcaatttccattcagatgactatgacaaatcatatattttattgattccagcaggttctgaacctgaagaacaagtagatgtgttggcattcgcattcaatccagatgaaaatgatgatagccaggattatgaattgtttgatattgaaagtgatgaagaatgggaaatggtagaaggtgtcctagatacgttcttgaacgatgaaaatatgagataa

SEQ ID NO: 471 - DNA, 780 bp, Lactobacillus salivarius
  isolated from gut, Lactobacillus salivarius
atggaacatagaatgttagaattagaagaaggtataaattttagagaattgggcggttatttaaccgaggatggtagaaaaattaaatggcacaaactattacgttgtggaagtatggcacaactaaccaagaatgatgtagattatctagatcaatatggagttcgctatattattgatttgcgctcacccgaagaatctaattattcgccagataagtatccagataaagcacaatatttccaagatactgtgtacccattttcttttagcttgtttaaaaatttaggaatcatcaacaatatgcgattaggagctagcaatatggattttggaagacaaacttatcttcaaatgttgttagatcctcatgcacaagctgcttatcgtaaaatgttcaacgtcttattggaaaatgataaagagggagaaagtgtggttttccattgcacagctggaaaggatagaacaggagtagctgcatttttaattttgaatgcattaggtgtgagtgaaaaacaaattgtggaagattacttatataccaatctattttttgataattattcttctgaaacaataaatgatgcgttagaaaatgaatcgcaaacagaaatagcacagagattaaatagtaaaacagcagttattgctgaaacaattgaagttttacctaaagcatgtcgagtagtaagtggatctgttgcaaagtttttagaagaaaaattgggaatgacgagagctaaaattgaaagattacaagaattatatttagagtaa

SEQ ID NO: 472 - DNA, 708 bp, Lactobacillus salivarius
  isolated from gut, Lactobacillus salivarius
atgtggatagttggtggaaaaagaggattagcctctttttccagcgtagcattaaacttcatacttttatttctaactgtaatttttatttcaattggggtaccagctttgtggacaactatttttgcaggaattgcgattttagctgctacgatttatatgggaaatagcgatgaaaaaacaactaatattgcttttgaagctactttgatttcattagcgatagttgttgtagttatggttcctttcattaaactagttggaattcaaggctttagtccggaacaatctgaagaaatagaagcttttaatttattaatcggagtaaattttgaaagtatcgtaatttcaactatgatcttgagtactttaggagcaattgcagaagctgcgattgctattgcaagtggtttagatgaaataattgaacaacaaccagacataacgttgccggctttatacacaagtggacgaaatataggattacaaattatgggtatgacatttaacactttattttttggaatgtttggtggagatttagcattgttcatcttgctatataaattagatgcgacatttggatattacttaaattccaaaatatttgtagcagaatcaatggaagttttattctcatcaatttcaataatcttagtaatttggataacaacttatatgatgggaaagaaagtcagacggacataa

SEQ ID NO: 473 - DNA, 1041 bp, Lactobacillus salivarius
  isolated from gut, Lactobacillus salivarius
atgaaaagtgcagtttttgaaaataagggaaaagtcagtctagaagaaattagtaaacctacaattcaagatagtggtgatgctattatccgcgttattcgtgcatgtgtttgtggctctgatttatgggcttattctgggttggatagtaaagaaacgcattccgttaatagtggccatgaagcattaggcattattgaagaagttggctctgatgtaacaactataaaacctggagattttgtgattgttccatttacacatgggtgcggtcattgtgcagcttgtttagcaggtttcgatggtgtatgtcaagatcatgaagataattttagcattggtttccaatctcaatatattcgttttgcgtatgctcaatgggctttagttaaagttcctggtaaacctgaagattatagtgaaggaatgttgaaatcactacttaccctatctgacgttatggctactggctatcatgctgctcgcacagctcatgttaagcctggagataaagtagttgttgtcggtgatggagctgttggtcaatgtgctgttattgcagctaaaatgttagatgcctctcaaattattatgatgagtcgccataaagatcgccaagatttagctttagaattcggtgctactgatattgttgctgaacgtggagcagaaggtatttctaaagttattgctctaactggtggaacaggtgctgatgccgttctcgaatgtgtaggcgctcaagcatctactgaacaagctatgggtgttgtccgtcctggtggttttattggtagagttggtctacctcacggaaaagatatgaaccctgctgctacattctatcgtaacgttactctagctggtggtcctgcttctgttacaacttatgataaaaaagttttacttaaggctgtacttgatggacaaatcaatcctggaaaagtttttactcatagttatagtcttgatgaaattaatcaagcttataaagatatggcagatcgtaagactataaaatcactgttagttatcaattaa

SEQ ID NO: 474 - DNA, 1038 bp, Lactobacillus salivarius
  isolated from gut, Lactobacillus salivarius
atgttttgtggttatttcttaattaataccgtaaattatttaatagagcgaggttttattatgccagtttttgattatgaagatatccaattagttccaaataaatgtattgttaagagtagatctgaagtaaatacaaaagttaaatttggacctatgacttttaaaatacctgtagtccctgctaatatgcagactattattgatgaaaatcttgctgtttggttagctaagaacggttatttctatattatgcaccgtttttatgaaaatgaacgtgttgattttgttaaaaatatgcacgacaaaggtctttttgcttcaatttctgttggagtaaaacctgctgaatatgatttaatcgatgaattatctcaaaagaatttagttcctgaatatattactattgatattgctcatggacattcagataccgtcattaatatgattaagcatattaagcataaattacctggtgttttcgttatcgctggaaatgttggtactcctgaagctgttcgtgaattagaaaatgctggagctgatgctactaaagttggaattggaccaggtaaagcttgcatcactaaattaaaaactggctttggaactggtggatggcaattagctgctattcgtgcatgtgctaaggctgctagcaaaccaatcgttgctgacggtggtattagaaataatggtgatattgccaaatcaattcgctttggtgcttcaatgtgtatgattggctccctttttgccggacatgatgaaactcctggtgatattattgaaaaagatggcaagaagttcaaaacttattttggatctgcttctcaatatcaaaaaggcgaatataaaaatgtcgaaggtaaaaaattacttctaccatataaaggaaaaatagccgatacacttcgtgaaatgcaagaggatttacaatctgctatttcttatgctggtggtaaagaattattagctcttagaaaagttgactatgtaattgttaaaaattctatctacaacggtgatatgttgtaa

SEQ ID NO: 475 - DNA, 1773 bp, Lactobacillus salivarius
  isolated from gut, Lactobacillus salivarius
atgagaagaacaacttatgcaggattagttgatgaaaaatatcttgatcaagaagtttgcctaaaaggttgggtacaaaagcgtagaaatttaggtaacttaatttttattgacttacgtgatattgaagggattgttcaattggtatttagccaagaattcaatcctgaagctttaaaggttgctgaacaattacgtagtgaatatgtcattgaagttaagggtaaagtagtggctagaggagaaaaagctattaaccctaacatgagaacaggtaaagttgaagttgaagtttcagatattgaaattttaaacaaagctaagaccacaccttttgatattgcagatgacattaatgcatcagatgatttacgtttacaatatcgttatcttgatttacgtcgtccagaaatgcaaaaagctttgatgatacgtaatcgtattactcaaactgttcatagctacttggataaaaatcactttttagatattgaaacaccatatttgacacgttcaactccagaaggtgcacgtgattaccttgtaccttcacgtgtatatccaggtcatttctatgctttaccacaatcaccacaattgtttaagcaattattaatgggtgcaggttatgatcgttattaccaaattgcacgttgcttccgcgatgaagatttacgtggtgaccgtcaacctgaatttacacaaattgatattgaaacttcctttatgtctgctgaagaaattcaagaaatgacagaagggttattgaagcgtgttatgaaagaaactttagatgttgatatcaagacaccaattcaaagaattacttggaatgaagcaatggacagatttggttctgacaagccagatattagatttggcatggaattaaaagatatgtctagtgcagttcaaaatgccggtttcaaagtcttcgacatgacacttgaaaatggtggtcaagtaaaagctatcactgttccaggtggtgctgacaagtattcacgtaaacaaattgaagaaaagcaagaatacatcaagcgttttggtgctaaaggattagcttgggtaaaagttacagatgatggattaactggaccaattgctaaattctttactgaaagagctgaagatattaaagcagcagcagaagctaagagtggagacttgatcttattcgtagcatctaatcgtaaagtagtagctgattctttaggttacttgcgtgtagcaattgctaaagaaatggatatgattaataaagatgaatttgcatttatctgggttgtagactggccattatttgaatatagtgaagagtttgatagatatattgctgcacaccatccatttacaatgcctaatgaagaagatttagatttattagaaactgatcctcacaaatgccatgctcaaagttatgatattgtacttaatggttatgaattgggtggtggatcaatccgtatccacagacgtgacattcaagaagcaatgtttaaggctttaggattcacaaaagaaaaagcagaagaacaatttggttggttcatggatgcattagactttggtttccctccacatggtggtttggctttaggtttagatagatttgcgatgttacttgcaggtaaagataatattcgtgaagttatcgcattccctaagaattccaaagcttctgaaccattgacacatgccccaagtactgtagctccaaaacaattggatgaactatacttgaagacagatgtccctgaagaagatgaataa

SEQ ID NO: 476 - DNA, 1296 bp, Lactobacillus salivarius
  isolated from gut, Lactobacillus salivarius
atgaaaaaaagatatattattctatcggtattattaatgattctagtaataataagtgggatttttatttatcagaaaaagcaaaaagttattactatcggcatttacagtgatagtagttgggacgttcctaatgataatgaatacaaattcattgactatgtcgtgaagaaattcgagaaagaaaatccaaatgttaaggttaaatatgaaagtggcattaataagaatgattacttagaatggttgtcacaaaagattgttgataataaagcaccagatgtttttatcgttccttctgagcaatttggctttttatcttctctaggaactatgcgaaatttaaattatttcatggatttatctggattaaataccgatgattattaccctactaatttaaaagctggaatgtccgcaggtaagcaatatgcactcccactcgaaagtaatccgatgatgatgtgcgttaatactgatttactcaaaaaagagcacattactattccaaaatcgggatggacactaaatgacttctatcgaatttgtcgtcaagttacaaaagatactaatcatgatggtgtagtggatcaatttggctatgcagattattcttggaaagatgcagcccaagcctataatgctaaattattcaatagtcaaggcacagctagctattttaattcagataaagtacgccaagctttaaccatgatggaaaaattatataatttacaaaaagattataaagtaaccgcagatgactttgataagggaaaagttgcttttcttcctatgacactagctcaatatcgcacttatgaatcatacccttatcgcgtttcgcgctattcatcattttcttggacgtgcattagaatgcctggagctactccagatattaactcaacctatgtgaatacttccatggtggcaatgtcttctcaaagtacacatccacttttatcatggaaacttgttaaatttttgtctaataatggcgatgttcaacagaaactctttacctactctcaaggagcttccgttcttaagagtgttatgaagagtaaagatattaccgagaatttacaaaaggaaaataatgctgacaatgctttaaccgaggaaaaattcgcaagtattatggcaaaatcacaaaaatatcctgaattcaaaaattataataatgtcatgcagacagctgattatttaattaataatgcccttgaaaatggtaacgttgaagttcaattatcaaatattcaaaatcagatccaagaagaattagcgaaatag

SEQ ID NO: 477 - DNA, 606 bp, Lactobacillus salivarius
  isolated from gut, Lactobacillus salivarius
atgaacacagaaataacaaagtatctacaagaattaaaaaaatatttaagacgtttagatgatagtgagatcaaagatattgaggatttctacacagaatatttagaagatgcaggagtacaaacacgtgcagaaattgaagaaaaagttggaacacctagacaattaagtctacgaatactagcagattattcattgaaggatgatggtaaggaaagtggtggcattttacctaagacaaatatcaagactgcttggttaatcattttggcattacttgcgacaccagcaactttaattataggggtagccttactaggagttttagtagcagcgattggtgtagcttttgcagtagcagtaacaattattgctttagctggagcagctatctttataactctaactagcttatatgtgggaatattcctattgtttacaaaattaggagtgggactattttatcttggaataggaattattggtatcggagcattaatggttattctaccaataatttacttaataatagtaacagttgtaaaaatggtagcgaacttcattcgatatatttacagatgtttcaacaaaaagggggttagatag

SEQ ID NO: 478 - DNA, 1830 bp, Lactobacillus salivarius
  isolated from gut, Lactobacillus salivarius
atgtggcgttacttaaaaagattacttattggggagccgcttaagacaacagaagagggcggccaagcgttaacaaaatttaaagctctagcattactttcatcagatgctttatcctcagttgcttatggtacagaacaaattacaacagctttatttgttttatctgcagcggctacatggtatgcagttccagcagcagggatagtattgattttactttttgcaataactatgtcatatcgacaaattatccatgcgtatccttctggtggtggtgcttatgttgttgctacgcagaactggggaacaggtgcaggattagtagctggaggttctttattagttgactatatgcttacggtagctgtatctgtaacatctggtacagaagcaattacttctgcgataccttctttgagggctcatagtgtaggtatatctattttaattgtcctgttcattatgactttgaatttaagaggattgcgtgaatctgcttcatttttgacggttccagtatatttctttgtaattatgattgtagctttggtgggttggggattatttaatatcttcacaggtaatatccactatgctgcagcagcacatgtcggtcaagcagttcctggaatgtcagtgcttttattcttaaaagctttttctgcaggttcttcctcattaactggggttgaagctattagtaatgcagttccaaattttaagaaacctaaacgtaaaaatgctgctaatacattaggaattatggcattgattttgggtatcttctttgctggaattacattcttaagttactacttaggtattttacctaattccaagcaaacagttttatcacaaataggtattgctgtatttgggcatggagtgctattttatctattacaattggcaactgcgatgattttagctgttgctgctaatacaggtttttcagcatttccaatccttgcatataatcttgccaaggataaatttatgccacatatgtttatggacaagggtgatcgcctaggatactctaatggtattattgcattggcaattggtgcgattactttgattttaattttccatggacaaactaatctattgatacctttatatgcagtaggtgtgtttgtgccatttactttatctcagtctggaatgatcattcattggtttagagaacgaggtaaacattggattttaaactcaatgtttaatttggtaggtgctctaatttcattggctctagttattttcttgttctggttacattttgcaaatgtatggccatatttgattatcatgccagcattgatttttggattctataagatacacgatcactatgtgaagattgccgctcaattaagattaagcaatgatgctcaattgcatgattatgacggttcaactgttattgtattagttagttctgtaactcatgtaactactggtgctattaactatgctcgttcaattggtgactatgtaattgctatgcatgtttcgtttgatactaaccctaaaaaagaacacgaaactgctaaggaatttaaggaatcatttggtgatgtgagatttgttgatttacattcatcttatcgttcggttcaaacacctgttattagattctgtgatgttattgctaagaaagctgctgaaagaaattattcagttacagtcttagtacctcaatttgtacctaagaaaccttggcaaaatatcttgcataaccaaacagcattacgtttaagaacagctttgaattctcgagaaaatatcattgtttcaacttataattatcatttgaaaaaataa

SEQ ID NO: 479 - DNA, 1533 bp, Lactobacillus salivarius
  isolated from gut, Lactobacillus salivarius
atggcattagaaataaccccagctttatctttattggatgaacaccacctcttaaaagaagtggttaacgaacaaaaattgacttttgaaaatgtaacttatgattcaagaaaagtgtcagataatactttgtttttctgtaaaggtaattttaaacctagttatttaacttcagctttggaaaaaggtgcaacagcctatgtttctgaacaaaagtatgctgaaggaatggatgcgacaggtattattgtaactaacgtacaaaaagcgatggcactattaggtgcagcattctatggttttcctcaaaatgagttatttattattgcttatacaggaacaaaaggaaagactacttcagcttattttgcggagcatattctagcaaaagcaacagataaaaaagtagctcttttttcaaccattgatagagtgctgggaaatgaacctgatcaaagatttaaatcagatttaacgactccagaatcacttgatttattccatgatatgagagcggcagttaataatggcatgactcatctagtaatggaagtttcatcacaggcatacaagaagaatcgtgtgtatggacttaaatttgatgtgggggtattcttaaatatctcaccagatcatattggtagaaatgaacatccaacatttgatgattatcttcattgtaaagaacaactcttagtaaattctaagcgttgtgtgattaatggagaaacagcttatttgagagatgtttactatactgcaaaagcaacaacagaaccagaagatatatatgtttttgcacgcaagggtgctcaaatttctgacaatattccagtagatattgaatatcaaaatgattttgaagatttgcataaaagcgtaattgaggttaagggacttagtgataaggctcaaaccttacatgttgatggaaagtatgaattaagtgtgccaggcgattataacgaaggaaatgctactagtgcgattatcgctactttacttgcaggtgctaagagtgaagatgcacgcaagacacttgatagagtacatattcctggtagaatggaaattattaaaacaaaaaataatggtacaatctatgttgattatgctcataattatgctagtttgaaagctttatttgcctttttaaaacaacaaactcatgcaggtagagtaattgctgttttgggttctcctggagataaggggatttctcgtcgtccaggtttcggaaaagcagttagtgaagaagttgatcatgtaattttgacaacggatgatccaggctttgaagatccaatgaagattgctcaagaaattgatagttatatcaaccatgataatgtaaaagtagagtttgaactagacagagaaatggcaattgagaaagctattaaaatgagtacgaataacgatatagtagtattagcgggtaaaggagaagatccttatcaaaagataaagggtgtcgatgtaccttatccatcagatgttaatgtggcaaagaaaattgtggaggaattataa

SEQ ID NO: 480 - DNA, 2226 bp, Lactobacillus salivarius
  isolated from gut, Lactobacillus salivarius
atgaataaggaattaacacctgaacaaataaaagaacaaaaggtttatctagaatggggcttaacacaaaaagaatacgaatatatttgtgataaattattaggtcgcttacctaattatacagaaactggtcttttctctgtaatgtggtcagaacattgctcatataagaaatctaaaccagtgcttaaactatttccaaataaaaatgaatgtgttttgcaaggccctggtgaaggtgctggtatcgtagatattggtgataatcaagcagtagttttcaaggctgaaagtcataatcatccctcagctgtagagccttatgaaggtgcagcaacaggtgttgggggaattttacgtgatattttcagtatgggagctagaccaatagcatctttagattcattgcattttggtgaaattgataatgctagaactaagtatcttatcaatgaagttgtagctgggatcggtggttatggtaactgtatgggtattccaactgttgctggagaaataacttttgatggttgctatgctggaaatcctttagtaaatgcaatgagtgttggtattttagaccaaagtcatattcaaaaaggacaagctaaaggtattggtaatgcagttatgtatgtgggggctaaaactggtcgtgatggtattcatggtgcaacatttgcctctgcagattttgctgatgataaggaaactcaacgttcagctgttcaggtaggtgatccatttatggaaaaactacttatggaagcatgtattgaattaacaaataatcaccaagactggttagttggtattcaagatatgggagctgcaggtattgtttcatctagttgtgaaatggcttcaaaagctaacagtggtatggaattaaacttagatatggttccacaacgtgaagaaggaatgtctgcttatgaaatcatgttgagtgagtcccaggaaagaatgttattatgtgtcaaaaaaggccatgaaaatgatgttaaaaagttatttgaagactacaatttagaagctgtagttataggtagagtaacagaaggacatgattacatattacatcataaaggtgaagtagttacaaatataccagtatctactctaacggatgatgttttagaagaacctagtgaagaaagagttcctcaacgtattttagataataaaaataaagatgcttgggtaccacagttatctaatgcaaaagaaacattaaaagctttattgcaacaaccaacaattgcttcaaagaagatgtttacagaaacttatgattcacaagtacgaacaagtacagttgtaggaccaggaagcgatgctggtgtaattcgtattcgtggaactaaaaaagctttagcaatgacaactgatggaaatggtcgcttcatttatttaaatccagaagttggtggaaaaatagctgttttagaagctgcaacaaatattatttcaagtggtgctttgccattagctataactgactgtttgaattatggtgatcctaatgatcctgaaatctactgggaactacatcagtctattaatgggatggctgaagcttgcagaactttggatacaccagttatttccggtaacgtttctttgtataacgaaaataacggagaagccatttatcctactgctatgattggtatggttggattaattaaagatgtttatcgcacagtaccatcttttgttcaaaatgtaggtgataaactttacttggtaggtaaaacaggtaatgattttaatggttccgaattgcaaaaattattaaataataagatctctggtgatctaaatgattttgatttagaaaaagttaactcatatttgaagaaccttttagcagctatggaacaaggtttagtttcatcttctcatgacttgagtgaaggtggcttgggtgttagcttagctgaaatggtttttggaactgataaggggatcaaagttagtttagatatgaaaaaagaactattattcagtgaaactcctggacgattagttgttagtgtttcaaagggtaatgtagcagcttttgaagaaattatgggtgaagatattacagaaattggtgaagttcaagctgatcatcaattagatataactttaaaagatgaaaactttgttgcagaagtatcagaattagaaaaactatgggaggaggcaatcccatgtcttatgaaatcaaaggattaa

SEQ ID NO: 481 - DNA, 987 bp, Lactobacillus salivarius
  isolated from gut, Lactobacillus salivarius
atggcattcaatttatggttacagtaccctgaattggcaaaagatatcgaaaaagttaaacataatcttcaagataaaatctctgtcgactatcctgatttacaaactgctctatcaaaaatggcaagcaatggcggtaaatttttacgtccagcctttttcttactatttaccaaattaacagcagactcacaaaatcgtgtagacgataaaaaactcattgatatagctacttcacttgaagttttacatatgtccacacttattcatgatgatattattgatgattctcctaaacggcgtggtgaagttagtgtccaaagccaatttggtaaggatattgcagtctatgctggtgattatttatttacagtcttctttgatttaatcactgataatgttttagacacaccattttttaagatcaattcaagaactatgaagaaaattttattaggcgaattaaatcagatgaaacatcgctacaatacccaacaaactttcttgaattatttgcgtaatgtaaatggtaagaccgcctatctttttcgcttagcaagtgctgaaggagcatattttggtggagcttcttcacaaaccgttagcttagctactagaatcggacaaaatatcggaattagtttccagattttagatgatattcttgattattctgacgcatcaagacttaataaaccaactctcgaagatttggcaactggggtttattctttaccattattgctagttcttagtgaagattcagatgaattacatactttattagctaaaaagcaagacctaactttacctgaaattcaacgtatccaagctttagtcgttgaattaggtggtgtagaaaaagctaaagatttagctgctaaatttactaataaagcacttattgatatcgataaattacctgattctacagctaaaaagaaacttgctaaacttactaaagtcttattaaaacgtacaaattaa

SEQ ID NO: 482 - DNA, 357 bp, Unknownn
  isolated from gut, unidentified
atgttagttaattatcactctcctaaacatgtatatattgtttgtggcaacactgatttacgtaaaggaatcgatacactggcaattttaattgccgataattttggtatgaatctttataatgattcaatcttcttgttctgtggtcgaagaaacgacagatttaaagctctttattgggatggtgaaggttttatactactctataaacgtttcgaaaatggtaatttaacttggccgaaaactagtgaagaagttaaagaattagataaccaacaaattgacttacttttaagtggacttaatcctttaccacaacccaaagtacatttagcaccaaaaggtgcattttattaa

SEQ ID NO: 483 - DNA, 987 bp, Lactobacillus salivarius
  isolated from gut, Lactobacillus salivarius
atgttaattttaaaaaaagatgatataaaaaagtgttttacaatgagagatgcgattgaagcagataaagaagctttagagatatattctgaaggaaaagctaaggtgccattaagaactaatattgatatagatgaaaaaaatggacaaaatctttatatgccagcttatgttggaggaaaccaagctgctgctggattaaaaatcgtttctgtttatcctgataatatttctaagggtttaccaagtgtgccagcgacagtaataactttagatgctgatactggagaattaggtgcggtaattgaaggtacttatttgacacagttaagaacgggtgctgttcaaggtgcagccacagagttattagctagaaaagatgctaaagttggagctttgatagggactggtggacaagcagcaacacaactagaagcaatgatagaagttagagatttagaagaaattagaatttttgatatagattttagcagggctaaaaaatttgctgaattaatggcagataaattcaataaaaatatttatccatgtcaaactgctaaagaatgtgttgaaaatgccgatattattacaacagttactacttcaaaacgtgcaactttcaatgatgaatgggttaaaccaggagcacatattaatgggattggagcatatacgccagaaatgtgtgaaataccatgtgaaacaataaaaagagctaaaaccattgtttttgatacccttgatggagtttggcaagaagctggtgattttattcaaccattaaataaaggtgaaattagtaaagatatgattactggtgagttaggacaattagtggcaggaaaaataaaaggtagaactagtgatgatgaaataactatttttaaaacagttggaacagctgttttagatgtttatattgcagataagattgtaaaaaaagcacaagctaatggatatggacacgagtttgaattaaattaa

SEQ ID NO: 484 - DNA, 921 bp, Lactobacillus salivarius
  isolated from gut, Lactobacillus salivarius
atggctgaaaagaaagttacattaagtaaaaaagatcgtatggctgtttgttggcgttcaacattccttcaaggatcatggaactacgaacgtatgcaaaatggtggctgggcttactcgatgattccagctttaaagaaattatacactactaaagaagatcgtgctgcagctttaaagcgtcacttggaattctttaatactcatccatatttagcagctcctattttaggtgttacattagctcttgaagaagatcgtgctaatggtgctccagttgatgatgttgctattaacggtgttaaagttggtatgatgggaccattggctggtgttggtgatccagtattctggtttacagctcgtcctattattggtgcattaggtgcctccttagctatttcaggaaacattgttggacctatcttattcttcgtactttggaatgttctacgtattgcattcttatggtatacacaagaatttggttaccgtgcaggttctaagatcacagacgatctttctggtggattattgcaaaaagttactcgtggtgctgccatgatgggtatgtttgttctaggtgctttaattgaacgttgggtaagtattaaatttacaccagttgtttcaaagactcctgtgcaaaaaggtggttacattgactgggatcacattcctagtggtgctaaaggaatcaaggaagttctaactcaatggaatatgggtaagggcatgtccttagataagattaaagttacaacattgcaagataacttggatcaattaattcctggtttagcagctttacttctaacattcttatgtatgtggttattgaagaagaaagtttctccaattgttatcatcttgggaattttcattgtaggtattattgcacacgttattggtttaatgtaa

SEQ ID NO: 485 - DNA, 654 bp, Lactobacillus salivarius
  isolated from gut, Lactobacillus salivarius
gtgaagactatttttcgactaatagtaaggctaggaattatagcagtaattctagtaggaatacaaaaagtcttaacaacaccacgatatttacaggcaataatgccatatgtaaatcaagtagaagaattattaggaaaaaagaccaattatacacttgaaagtggagaacagaagaataaagtacaaacagataatgttaaatatgacaataaccgttggcctaacaatacagccacagtctatatagatattgatgatagtactttatacaatgcctttgtgtcagcgataaagcagtggaataatactggtgcatttacatttaagattgtgaatgataagaaagacgcagacatagtaggtaagttaatggaaaatgatgatggaactgcaggaacgacagatactacaactgacgagcaaactaagcgaattattaaagctacagtttacttaaatcgttattatctagaaagtgccacatatggttacagtgaacaacgaatagttaatactgctgaacatgaattgggacatgcgataggactagatcatacggatgaagtatcagttatgcagccagcaggatcttattatacgattcagccacgcgatgtagatgtcgttaagaaactatatcaggaaaattag

SEQ ID NO: 486 - DNA, 900 bp, Lactobacillus salivarius
  isolated from gut, Lactobacillus salivarius
atgacaacaaatgatttaagagaattgtttttggatttaaatgttaaatttgatgaagaattaaagaaatatacaaatacaaaaacaggaggaaaagctgacgtattagcttttcctgacagtattgaagaaactgaaaaattaattaaaattgctaaaaaaaataatgtacctttgacaattttaggaaatgcaagcaatttaattgttaaagatggtggaattagaggtctagtcgtaattttgcaacatctaaatcagataaccgttgatggaacaaaagtcacagcacaagcaggagcttctttgataggaacaacccgtgtagcagctaagcacagtctaaccggaatggagtttgcgtcaggaattcctggtagtattggtggagcaatatttatgaacgctggagcttacggtggggaaataaaaaacattgttgaatctgttaagttattaactcgtaatggtgaatacaaaacttatactgtagatgagttagactttggttatcgccatagtcgtttacaaagtgaagatgatattgtggttgctgcaacctttaaactagaacatggtgatataaagaaaattagggagagaatggaagaacttagctttttaagagcttcaaaacaacctctagagtatccatcttgtggtagtgtatttaaacgtccagcagggcattttacaggtaaattagtacatgactcaggattgcaaggatatacagtaggcggtgttcaagtatctaaaaagcatgctgggtttattgtgaatattggtaatggtactggtaaagattatttagatgttattcatcatgtccaagcagttgtgaaggaaaaatttgatgttgaattagaaacagaagttaggataattggtgaagattaa

SEQ ID NO: 487 - DNA, 1188 bp, Lactobacillus salivarius
  isolated from gut, Lactobacillus salivarius
atggaaaaagaagaatttatcaagaaatacgcagttgaacgtcgtaacactaactcatctaaatgggatggcttagaaactcaattcggcgaaactgatcttttacctttatgggtagcagatacagaatttaaggttcctgaagcagcacgaaaagcattggttgaacgtgttgaacatggtgcttttggatattctttagtgccagatagctattatgaagcatactttaactggcaaaaggaacgttatgggattgaattgcataaagattggatgagatttggtacaggggtagtgcaatcattaagtactttgattgaaaccttgacagttccagatgaagcaatcatggttttacaacctgtatattatccattcatgcgagtaattgaaaacaacaatcgtaaattagtaatttctgaattggtaaatcatgatggacattacgaaatggattacgaagatatccaaaagaagatgcaagaaaacaatgttaagttactaattttctgcagcccacataatccagttggtagagtttggtctgaagatgaattggaaaaattactagcaatctgtcacgatgaaaaagtaagagttattgctgatgaaatccaccatgacttaattattggggataagaagttcacatctatgttatcaattaaagatggtttttatcgtgataacttagtaatggtagatgcaccttctaagacatttaatatggcatcattattaaacagtcatgtagttattcctaatcctcaaattcgcgatttatatgatgaagtagtgggtcgtttaagtgctcctcaaggaagtctattaggtcgtgtagctgcagaagctgcatatcgcgaaggtgcagaatggctagacgacatgatagaagtaattagagataacttcgtttatgtgcgcgatgaattaactaaagcattccctgaaattaaagttagtgatctagaaggaacatatctcatgtggattgatttatcagcacttgttccagctgataaagttgaaaagctagttaagaaacaagctaaattagcggttgattttggtgattggttcggtgaaagtggtaaaggccatatccgagtaaaccttgctactacaccagaaaacatcaaaaaagcagtatctgcattagtaaatgctttaaaatcagaaaattaa

SEQ ID NO: 488 - DNA, 1566 bp, Lactobacillus salivarius
  isolated from gut, Lactobacillus salivarius
gtgaaagacttggctaatgttgatatgcaaacatttgataaaattatcgttttagactttggtagtcaatataaccaattgattacacgtcgtattcgtgaattcggtgtttactctgaattactatcacataagcttacagccgctcaaattaaagaaatgaatccaaaaggaattattttctctggcggtcctaacagtgtttatgatgatggtgctttccaaattgatcctgaaatttttgaattaggtattcctattttaggtatctgttatggtatgcaattaatggcacacaacttaccaggtggtaaggtagaaagtgctgataacaaggaatatggtaaggctgttattacagttaagaaccaagaaaatgtaatgttcaaagacttaccagaaactcaaacagtatggatgagtcacggtgacttagtaacacaagttccagaaggatttgaagttacagcaactagtgataactgcccaatttctgcaatggctaacgatgctaagaaattctacggcttacaattccatacagaagtacgtaacacagaatatggtaacgatattttacgtcattttgctttcgacgtttgtcaagctcgtagcaactggtctatggacgactttatcgacatgcaaattcaaaagattcgtgaaactgttggcgataagaaagtcttacttggattatctggcggggtagattcatctgttgtaggtgtattactacacaaggctatcggtaatcaattaacaagtatctttattgaccatggtttgttacgtaaaggcgaagctgaacaagttatggatagcttgggtggcaagtttggcttgaacattattaaagttgatgctaaagaacgtttcttgaacaagttagcaggtgtatctgatcctgaaaagaagcgtaagattatcggtaacgaatttattcgtgtctttgatgatgaatctgctaaattggaaggaattgaattcttagcacaaggtactttgtatacagatattatcgaatctggtacagatactgctcaaacaattaagtctcaccataacgttgggggattaccagaagatgttcaatttaaattaatcgaaccattgaatactttatttaaagacgaagttcgtgaacttggtgaaaagcttggaatgccacacgaattagtatggcgtcaaccattcccaggtccaggtttaggtattcgtgtaattggtgaaattacagaagaaaaacttgaaattgtacgtgactctgatcttatcttacgtgaagaaatcgcaaaacatggtttagataaggaaatttggcaatactttacagtattaccaggtattcgttctgttggtgttatgggtgatggtcgtacttatgactacacagttggtattcgtgcagtaacttctatcgacggtatgaccgctgactttgcacaaattccatgggatgtattgcaagaaatttcagtacgcatcgtaaacgaagtagatcacgttaaccgcgtagtgtatgacattacttctaagccacctgcaactattgaatgggaataa

SEQ ID NO: 489 - DNA, 1437 bp, Lactobacillus salivarius
  isolated from gut, Lactobacillus salivarius
atggattttatgaaaccgtttactttaacggagaaagaaggtttttgtatgtttaagaagttacttgcgccacctggcaaaaagccacgtctttcagatgccgaggtcgctcgtaaatacccacgttatcgtactcaagttattatttccattttcgtaggctacatgggatactatttcgttcgtaatactacttccattctttccggaattttgaagatgtcagccaccgaaattggtattatcacttgtgccagctatattgcttatggggtttctaaatttgtttcaggtcttatttccgatgaatctaattctaaaattttcttgccactcgggctattattatcaggtattattaacattttcatcggcgttattccatcagtaatcacaagtgtttggctatttaccatcttctatctaattaatggctggctacaaggtatgggttggccacctggtgccagaactctagtatactggtttggtaataaggaacgtatcacttacggtaccatttggaacttatcacataacttcggtggagcaatcgcacctttacttgctggagctggtttagcacttgcaggaaatgatccattagcacaagcacgtgcagcatattggttcccaggtatcgttgtttgtatcatggccgttattatttactttattcaagaagatacaccagaatcagttggacttcctccaattgaagaatacaaatccgaagaataccgtgaaagcgacaacgctaaactcgaagaagatgctgccgctgttgaaatgagcatgggtgaaattgttaagaagtacatccttccaaataccaaattaatgtggtcttcactttatgccgctctcgtttacatcttacgttacggtattgtttcctggacacctaagttcctagcaacaagcattcaagatggaggaaaaggaattactgccgctgctggtatgggtggtttctccttcttcgaacttggcggaattgctggtatgttaattgctggttgggtatctgctaaattattcaagaattctaaaccattaaccaacgttgcatgtttaattctcaccctcgtattactcgttgcttattggtttatcccagctggtcctgaatatatgatttgggatttcgcaattcttatcggtttaggtgcttccatttatggaccagttatgatggttggtttgtatgcgatggaacttgttcctaaagctgctgcaggtgctgccgctggcttgtctggtactttcagttatgttggtggcgctactgttgctactttggttatcggtatcatcgttgaccatttaggctggggtgttgcatttatcgtattcggtatctctggcatcgccgctatcatttgtaccctactttctcgtgataaatcacttgagtactgggatgaagaaaaataa

SEQ ID NO: 490 - DNA, 1311 bp, Lactobacillus salivarius
  isolated from gut, Lactobacillus salivarius
atgtctataaagtgggaaaagaaaaacggaacaaacgaaggtaaattaacttttgaaattgctccagaaaaaattaaagaaggcttgaattctgctttcaatcgtgtaaagaaatctttaaatgtacctggatttagaaagggtaaagttcctcgccaaatcttcaacaagatgtatggtgaagaagcattatatcaagaagctttaaatgatttattacctgaagcatattcaaatgctgttaaagaagcagatatcaatccagttgatcaaccacaaattgatgttgaatcaatggaatcagatgctgcatgggtattaactgcaaaagttactgttgaacctgaagttgaattaggtcaatataaagatttagaagttacaaagcacccaacacgtgttttgaaagctgatattgaaaatgaattgaatagattacaacaacaagaagcagaattagttcttaaagaagatgaaccagcagaacaaggtgacactgttgttattgattttgaaggtaagatcgatggagaagcttttgatggtggaaaaggtgaaaaccattctcttgaattaggttctggtcaatttattccaggttttgaagatcaattagtaggtcacaaagctggtgaagaagttgctgtaactgtaacattcccagaagattatcaagcaaaagatctagctggtaaagaagctgtttttgatacaaagattcatgaagtaaagacaaaagaattaccagaactagatgatgaatttgcaaaagatgttgatgaagatgttgcaactcttgaagaattaaaggcaaaaattaaagatcgtttgaaagatcaaaaagttgctgaagctaaagctgcaattcaagaagaagcacttgatattgctgtagaaaatgcaacaattggtgaaattccagctgttatgattgaagacgacgtacatcgtcaaatggataacttcttagcaggtatgcaaaatcaaggtatcagtgctgatatgtattaccaattaacaggtacatcagcagatgatttgcacaaacaatttgaagaaggtgctgaaaagcgagttaagacaaatcttgttcttgaagcaattgttaaggctgaaaagattgaaccatctgaagatgaaatcaatgctgaaattaagagtttagctgaacaatatcaaatggatgaagcagcagttcgttctgctttatctgatgatatgttgaaacatgatattgcagttagaaaagtagttgatgaaattgctgattctgcaaagcaaactcgtgatgctaaaaaggatgaagaataa

SEQ ID NO: 491 - DNA, 810 bp, Lactobacillus salivarius
  isolated from gut, Lactobacillus salivarius
atgaattttttaggagtaattaatccggttgccttacaattaggtccatttcaaattagatggtatggaataattattgctagtgcagttattctggcagtatatttatctgttttagagggaaggaaacaaaatatcttagatgatgatatctatgatttattgttgtattctctgccagtagcaattatctgtgcccgaatttactatgtagtttttgaatggtcatattattctcatcatttaagtgagacttatcgtatttgggacggtggaattgctatttatggtgcactaataggtgcagttatagttatcttgatcttttgtcgtcgtcgcaatattccaacttggactttacttgatgtgatttccccaacagttatattggcacaaggcataggacgttggggaaatttcatgaatcaagaagctcatggtgttgcaacgacattaggttttttaaaatcgttacatctacctaagtttataattaaccagatgtatatagatggaacatattatcaacctacgtttctttatgagtctctatgggatattagtggattcgttgttttaattattttaagaagacagaagaaattattaaaaagcggagaagttgttctgtcttacataatttggtattcatttggtcgtttctttattgaaggaatgagaactgatagcttaatgttggggagtttaagagtatcacaatggttatctttaattctatttattagtgccatcgcagcaatcttttacagaagatataatgatccgttgttgaaatggtatacagaataa

SEQ ID NO: 492 - DNA, 1065 bp, Lactobacillus salivarius
  isolated from gut, Lactobacillus salivarius
atggcaatggaagattatcgtataaataaagaaaatggattagaatttggcttatattcactaggggatcacatgcctaacgctcttacaggcaaacgtgtttcagctaaagaaagaattgatcaaattgttgctgaagcaaaattagctgaagaagcaggattagatttcttcagtgtaggtgaaagtcaccaaaaatactttgttggacaagctcatgctgttattttaggagcagttgctcaagctactgaaaaaatcaagattggttcatctgcaacaattatttcaacatctgatcctgtcagaatttatgaaaattttgcgacattagatttattatccaatggacgtgctgaaattattggtggacgtgcttcacgtttaggtttattcgatttattaggctacaatgtgaatgattatgaagaattatttgaagaaaagtttgaattactactcaaaattaacgaaaatcatcgcgttaactgggaaggtaatttccgagcaccattaaaagatgcagaagttttaccaagaccattaaatgataagttgccaatttggcgtgcggtaggtggaccagctgaaagtgcaattaaagctggattacaaggtgtgccaatgacaatcactttattaggcggtccattatcaatttttaagcgttcaatcgatgcttatcgtcaaagtttgaaaatgaagagctataatccaagtgattttccagtagcgacaacaggatttttctatgcagctgatgatacaaagactgctttaagagagctttatccttatgtagatcaaggaatgaagttggcaaatggtacaggttatcataagcgtttattcgctaatggcgcagacatgaatgatgtaatgttagtgggaagtccacaacaaattatcgaaaaaatgatttatcaatatgaagaactaggccatcaaagatatttagcacaaattgattttggtggaatgccatttgaaaaagttatgaagaatatcgaaattatcggaacaaagattttaccagaagttaaaaaatatacaaagggaaaataa

SEQ ID NO: 493 - DNA, 747 bp, Lactobacillus salivarius
  isolated from gut, Lactobacillus salivarius
atgttacgtttagaaaatgtgaataaaacttttggtggtaacttgactttaaaagatattacgacaacatttgaaaataatcagactacagttttagtaggtccatctggttcagggaagtcaacaatgttacgctcattgaatttacttgagatgcctgaaagtgggaaatattattttgatgatttagagttggattttaagaaaggaatctctaaaaaagagattttagaagttcgtcgtgaaacagaaatggtttttcaaaattacaacctttttccacatttaacagttttgaagaacattattgaaggaccagttcacgtgttaaaggaagataaggaatcagcaactaaaagagcttatgaattactcaaaaaagttggtttagcagataaagcagatgcctatccacaacagttatcaggtggacaagctcaacgtgtggcgattgctagatcattagcgatgaatccaagatatatcctattagatgaaccaactagtgcgttggatccggagttagaattagaagttttaaaagtattgttacagttagctaaagaaaaacaatcgttgataatagttacacataatttggctttcgcacagaaagttgcggataaaatcttgtttgttgaagatggacaaatattgttccaaggtcctaaggatgactttttcaattcagataatcaaagaataaagaactttttatccgcgatgactttaagtaacttagattaa

SEQ ID NO: 494 - DNA, 1689 bp, Lactobacillus salivarius
  isolated from gut, Lactobacillus salivarius
ttgacttttgatggtttattcactcatgcaatgattcatgaattaaatcaaactttacaaaatggtagagttactaaaatatctcaaccttatccaaatgaggtaattttaacaattagagctaataggactaattatcctgtgctactatctgctaatcctcgttatgctagatttcaaattacacaaatcccttatactaatccagcagttccaactaattttactatgatgttaagaaaatacttggaaagtgcaaaattgctagaaattaagcaattagataatgatagagttgtatattttgaatttctaactcgtaatgaattaggagataaacttcctttattattaagtgctgaaatcatgggaagatatagcaatgtcattttaatcaatcaatcaacaaacaagattattgatactatcaaacatgttggaatggatcaaaatagatatcgaactttattaccaggtgctacttatcgtcagccgcctacccaagataaagagaatccttttgaacaagaatcaaatacatttgaagaactcatacaaaaataccctaatcgtgaagttttagctgacagcttattaaaacaatatcaaggtatttctagagataatgcacttgctttagcagataaattgcattcctcaaataattatgtccaagctttcaatgattttcttgcaatgacagaaaatcctattcctacaatgaatagtaataacttctcaattttcactgataatcctaacgataaaaaattttctactttaagtgaaatgttggatgttttctatcatactaaagctaatagagatagagtacagcaacaaggtggacaattactacacgttattagaaaaaatctgcagcgaaacaagaaaaagttaaagaaactctctaatgaattaaaagctacagaaaacgctgatgagtatcgtattaaaggagaagttttaacaacgtatctgtatcaaattaaacgtggtatgactaaaataactcttcctaatttttatgataataataaagaaattacaatctcgttatctaaccaactgtccccttctcaaaatgcacaaaagtacttcaaaaagtatcaaaaacttaagaatgctgttacttttgttaatgagcaaatagaacttactaaaaaagaagtcgcttatctagaagaaatacaaactcaaatagaattagcaactcctgctgatttagatgatattaaaacagagttacaacaagaaggttatattaagaaaaagcaacaaaaaaataagcgtagtagtagagtaaaaattaacaagcctgaaacttttgtagcaagcgatggaactgagattctagttggtaaaaataatttacaaaacgaaaaactcactttgcatactgccaaaaaaactgatatttggttacatgcaaaaaatattcctggctctcatgttattataaaatctaataatcctagcgatgaaactttatttgaggcagcgatgttagcagcgtatttttctaaatttagaagttctgctaatgttcctatcgactatattcaagttaaaaatattcgcaagcctaatggaagtaaacctgggttcgttatttatgaaggtcaaaaaacattgactgttacgccaactgaagactttgtattggaacttagacaaaataaaaagtag

SEQ ID NO: 495 - DNA, 963 bp, Lactobacillus salivarius
  isolated from gut, Lactobacillus salivarius
atggctgaatataaaatgattttagatttagataccggtattgatgatgcactagcaattgcatatgctttagcaacacctgaaagtgacttgattggtattgttggatcatacggaaatatcttagttgaacaaggtgtacaaaatagtttggatttacttgaaatgctgggacatactgaagttcctgtttatcaaggactatctcattcatcaactactgatcatttcgatgttatgccaattagtgctcaaattcacggtaaaaatggtattggagaagttgaaatccctactgctaaaagaaaagttgaaactatgagtggccctgacttctttattgaagcagctcacaaatatggtaaaaaacttttaattgttccaactggtccattaactaatctagcagcagctatcaaaaaggatcctgaaattgttaatttagttggccgcgtaacactcatgggtggtgctttaacagttcctggtaatgttaaccctgttactgaagctaacattaatcaagatcctgcagcagcagattttgtatttagaagtggtattcctcttactatggttggtttagacgttacaactcgtaccttgttaactacaaaagaaactcaaaaatggcgtgatttaggtacatttgctggtcaaaaatatgctgatatcgttgactactacattgatgcatataaagtaacaagtccacaccttggtggttgtgctcttcatgatcctttggctgtaggtgtagctgtcgaaccatctttagttacaacacttgctttagatatgaaggttgatactgaaggcccttatgctggaagaactattggggatgaaactaaagtaaacaacccaaatcctataagtaaagccgcaattggtgttaataaagataagtttttagatgaattcatggaaaaattaactaaattatttgcagaagctaattaa

SEQ ID NO: 496 - DNA, 1227 bp, Lactobacillus salivarius
  isolated from gut, Lactobacillus salivarius
atgtttgaaaatgaagataataagactcctgcgacatgttctttttgtggaaaaacagaagatcaagttaaaagtatgatttctggaccaggagtgtatatatgtaatgaatgtgtagaattagcacaatcaattattgatacagaaacaaaagcagaagcacaaaaagattttactaatgttcctactcctcatgaaattgttgatactttaaatcaatacgttgttggacaggaagaagctaagaaaacattagcagttgctgtatataatcactacaaacgtgttaatgcttcattgtcagatgatgatggaacagaattacaaaagagtaatatttgtcttgttggaccaacaggttctggtaaaacattcttagctcagaatttagctagaattttgaacgtaccatttgcaattgcagatgcaacaactttaacagaagcaggttatgttggtgaagacgttgaaaatattttattgaaacttttacaaaatgctgattatgatgtagaaagagctcaaagaggcattatttatatagatgaaattgataaaattgctaagaaatctgaaaatgtatcaattacgcgtgatgtttctggtgaaggtgtacaacaagcgttacttaagattcttgaaggtacaatagctaatgttcctcctcaaggtggccgtaagcacccacaacaagaatttatacaaattgataccacaaatattttatttattgttggtggagcttttgatggtattgaaacaatggtaaaaaatcgtttgggagacaaaacaataggttttggtgtagattctaagcaggaatatgatcctgataagagtttaatgcaacaaatcattcctgaagacctattaaagtttggattaatccctgaatttattggtcgtttgccaattcttacagcacttgaaaaacttactgaagaagatttagtaagaattttaacagaacctaagaatgcgttaattaagcaatatcaaaaattagtatcgtttgatgatgtatcattaaaatttgaagatgatgctgttaaggaaattgcgcatctagctattgaaagaaacacaggtgccagaggtttgagatccattgttgaagctactatgagagatattatgtttgacattcctagcgaagataatattaaagaggtagttattacaaaagatactgttgatggtaagagtaaacctgaaatagtaaaataa

SEQ ID NO: 497 - DNA, 1350 bp, Lactobacillus antri
  isolated from gut, Lactobacillus antri
atggataaatttaaaaatattattattggatttggtaaggcgggtaagacattagctaagtacttggcgcagcatgatgagaccgtgcttctgatcgaacggtcaaaacaaatgtatggagggacttgcatcaatgttggctgcctaccatctaaaaatttaattttaaatggtcaacgtggcttagactttactacggcagtaaataagcgtggtgagatgactagacagttgcgagacaaaaactatcacatggtggctgatgagccactagcaacggtttggaatggttcagcacggtttatcgacaattatgttttggcagtcgtaatgagtgatggaacaactaagaaggtgagaggtgaacgcatcttcattaatactggagcggttccaaattggccatcaatcccagggctagaatttggtcagcggatttttacgtctaaagaagctatggaattgaagaaacaaccgaaacgactagcaattattggcggcggttatattggccttgaatttgctggaatgtttaattcatttggtacgcatgtaacgattttcgaccaacataccagattgttagagcgcgaagatcctgatattgcgaccgaggttgtaacagatctgactgacgcagggatcgagattaaatcggagactcaactaactcaagtaaaagataatggtgagaaggttacgttatattatcagcaaggtgatcaaactaacactgcggaatttgatgcggtattagttgcagtcggtcggcgacctaatataagtagtttaggactagaaaatactgatattgctttaaccaatcgcggtgctattcaggtcgatgatcatttaagaactacagtacaaaacatttgggctttaggtgacgttaatggtggccctatgttcacttatgtctcattggatgattttcgtattatcatagatcaattgtttggtaaggggaatcgctcaacggctgatcgatcggtaataccaactgcttcattcctaaatccaccgctggccaacgttggcttaaatgaacgtcaggccaagagtgcaggttataactttcaaactttcaagctatcagttaaggcgattccaaaggcccgtgttttagaagatcaacgtggactctataaggtaatcattgatcaaaatacacattgtattttaggggcaactttgtatgccgctgaggctcatgaaactattaatctaattgcattagcgataaaggccaaattaccctatgaaaaattacgcgacatgatctatactcacccaacaatgtctgaagccttgaatgacctttttaagactctggttgtgaaaaactag

SEQ ID NO: 498 - DNA, 2631 bp, Lactobacillus salivarius
  isolated from gut, Lactobacillus salivarius
atgcctcagaaaacaaagcaaacaccaatgatggaacaatatatgcagataaaaaagcaatatccggatgcctttttgttctatcgtttgggtgacttttatgaaatgttttatgatgatgcaattaaaggatctcaaattttagaattgacattgacacaacgtaataaaaaagcagttgatccaattccaatgtgtggtgtacctcatcatgctgcacaaaattatatagatattttagtagataaaggttataaagttgccatttgtgaacaagttgaagatcctaagcaagctaaagggatggtgaagcgtgaggtcattcagctggtaacaccggggacaataattgatgagtccgcaggtgaagctaaggaaaataattatttaacagctttacattttgaaaataatcaatatggttttgcatatgttgatttatcaactggtgaacttaaagtatctgtgttaaatacaattgacacaatattaaatgagttaatcagtcttagaacgaaagaaattgtggttgactcaagtgtaaacgatgaagttttaaatcaaattaagaatcttaagattttaatttctgaacaaaatgatacagaagatagttcagaagtaagttttgctagtcaagatgttgagaatagtgtcgaagttgaagtaattaaacatttaattacctatctgaaaattactcaaaaacgtgctttatcacatttacagcgagcagtacattatgagccatcacaatatttaaagatggattatcatgcaaaaagaaatttagaattattaagaaatcttcgtactcagaaaaaatcaggaacgctattgtggttgctggattcaactaaaactgcaatgggcggtcgtctattaaagcaatggattgacagacctttgattaatttaaaagaaatagaagctagacaatcaatggttgagaatttattaacccactattttgaaagaagtggacttcaggaagaattagttaatgtctatgacttagaaagattagcgggaaaagttgcatttggtagtgttaacggtcgggatttaatccaacttagaacatcattggaacatattccacaaattagatatattattcaagaattaaataatgatagtacatttgatgaaatttttgacaaattggatccaattgaagatattgcagatttgattgaacaagcaattgaagacgaaccaccaatttctgtgactgatggtaatttgataaagcctggatatagccaagagttagatgaatacgtagatgctatgaaaaatggcaaagcatggttagcagaactagaagctaaagaacgtcaagcaactggaataaataatttaaagataggattcaacagagtttttggatactacattgaagtttctaagggaaatttgagtaaattgcctgaagatagatatcaacgtaagcaaacattaactaatgctgaaagatttatcactcctgaattgaaagaaaaagaatcactaattttaggagcagaaagtaaagctaaagagctagaatacaagatttttgctggtattcgtgatcaaataaaagatgagattcagcgtatccaggaattagcaggtgctgtagctgcattagatgttttgcaaagttttgctactgtaagtgagcagggacattttgtaaaaccagaattaactactgacaatcatagtttagatattaaggatggttggcatccagtggttgagaaagttatgggtaagcagagttatattccaaatgacattaaaatggatgatgatttagatgtacttttgataacagggcctaatatgtctggtaaaagtacgtatatgcgacaattagctttaactgtagttatcgcacagattggatgttttgtacctgctaaatctgctaagatgccaatatttgaccaaatttttacacgtattggagcggcagatgatttaatttctggtgaatcaacatttatggtagaaatgaaagaaacaaatgttgctttaatgaatgcaactagaaatagtttgctattgtttgatgaaattggtcgaggaactgctacttatgatggcatggctttagctcaagcaataattgagtatgtacacaataatatccatgctaaaaccttattctctactcactaccatgaattaacaatcctggatgaaagtttggataaattacaaaatgtccatgtaggtgcaatagaaaaaaatggtgagttgattttcttgcataaaatgcaggaaggtccagctgataaatcatatgggattcatgttgctaagctagctggtatgccagataaacttttaaagcgtgctgacagcattttaaataagttagagagtgagaatgattttactgtagaatcaacagaaagttacactgaagaaaagcatattgaagaaaaaaatgaaaatgaaacttcggagattcaagaagaacagttgtcgttgttccaacccgaagcagtaagtttagattctaatcaaagtaaaatacttaaagagattaagaatgctaatttaatgggaatgacaccaatggatgtaatgaatattgttttcaaatggcaaaaagaactcaataagaaaggttag

SEQ ID NO: 499 - DNA, 1224 bp, Lactobacillus salivarius
  isolated from gut, Lactobacillus salivarius
atggacgaagcacaacgagaaaaaagcccatggaaacgtaatttatacattctatgggtttgtacttttatcgctggcattgcttttagtgagcttatgccatttatgtctttatatgtcagtcaactaggacatttttctaaggcacaagtttccttttatagcggtttggtctatgctgctacttttctagtcactgccatcgtttctccattatggggaatgctagctgatattaaaggacgcaaaatcatgttaattcgcgcctcttttggtatggcttttgctatgtttttaatgggacttgtcactaacgtttgggagttaatcgccttacgtgcccttcaaggtttattttcaggctttatttcaaatgctcaagctttaatagcatcgcaaacacctagaaaacatagtgggaaagctctagggactctagttactggctcaacttccggaatgttaatgggacctatcatcggtggtgtattggcccaatttttctctattagagacactttttttatcactgcttccttactagccctagcagggattttatctgccactttagttaaagaatactttgtacctattaaacgagaaaaaaattctaaagaacatcgtggtttattatcacaatttcaaaaccctcgtctaatcattgttctgcttatttctactatgatggttcaattggggaatatttcaatcgcacctattatcagtttatacatcaaagaacttatgcataatcaaggcccaattgccctagtagctggtattattgctgctttaccaggtatttccaatatcatttcagccccacgtttaggagcttatggtgatgctcatggatcaaataaagttctaatggcaggttatctttttgctgttatcatgtactttccacaaggatttgtttcaagcatttggttactaggaattctgcgtttctttattggtatttctgatggtgcgctattccctaccatccaaactttactaacaaagaattctcctgcatcagctacatctgctgttttttcttggaatcaatctttccaagctttaggcaatatgttcggctcacttttaggcggttctttagctggtctttttgattacaatgttgttttcatttctaccgctactctactactacttaatttcctaattttatggtttactgaaccaagcttacgtttgaaatttaatagataa

SEQ ID NO: 500 - DNA, 249 bp, Lactobacillus antri
  isolated from gut, Lactobacillus antri
atgagtttagattcattcaaccataaaaaagacgaagaaatgagagaaagttacgaaactacattgaaagataacaagaacaatgcagtagcatttttaaaaaatatcagtcgaaaagaagtagagcgtaagcgatcagtaaccttctcaattactgaaagtcaattaaaaaaaatggacacagctgcccgaaaaaacggatttaaaaatcggtcagaattcttagcttcaatcatagatgcaatttaa

SEQ ID NO: 501 - DNA, 1443 bp, Lactobacillus salivarius
  isolated from gut, Lactobacillus salivarius
atggaaaagataagtataaagtatttaactaaaaaaagtccgcttttaagcgataagaataaaaaatcagaaaataatttttggtctttacgagggatcacttttagcgtaactgaaggcgaagctataggtttgattgggaggaatggttctggaaaagccttgttactaaaaatattagcagggctagaagaacctactacaggatttatatcaacaaagtcccatatatatttagcatcaatgacaaattctattaattttcagttaacaggacttgaaaatataaaaaaacaagtagaccaagcatacgatgatgaaattgaagctgatcatgtagttaaggcgattattgattttactgaaatcgggcaatgggtatatcgaccagtatcagaatactcaacaggaatgttgtctagactagcattatcgatagctttatttaacaaacctgaagtagttttgttggatgaagtatttgcatcgttagaaagagcattctttgaaaaagttattcgaaaaattcaagatttaaaagatcatggagtatcttttattattacagctacgactggtttagtattagaaactctatgtgaacgttcgatgtggttagactttggtgaagtaaaagaattaggtcctactcaaattgtaatgagtaaattccagtatcaaaatgattggtataatggtctaacattacctgaaaaaaataaatacttaaaagaaaagcaaatagaacaagaaaattttgatattactaaagtgtataatgagttcaaagttgaacaatttgagcatggatatactagacgcgatgaacctagaatgaaaaaagcattttatcacaatcatcgccaagacccagtaatatctgaagcagagaaagaagtaaaaaataacaatctgaataagaatgttaaaggacataaaaagaaaaaaggtaataagggattagttagagttgtaggtgttgtactagttctaatcttattattaggtgcaggtaaggtgctgcattcacatcatgaaacaaagaacagacaagtggaatctagtaaaaaagttgaagctaagaaacgctatagcaaatcagtatccatctctaaagctgaggaagcaagtaagcagagtaagattgagagttcaaagaaagagcaaagtttagcagaaagtaaacgtgcaagtgaagcagcagcctcaagtgctgccgctgcaagtgaaagtgctagaaaagctagtgagagtgctgccagtgaaagtaaagcttctatgttatcaaactcacaggaagtgacagttaatgatggtgatactttagcaacattagctagtcaatatggaacgacagcacaagctattcaagatttgaatgatatggggacaagtaactcattaacggctgggcaaactattagagttccaaatagtaattag

SEQ ID NO: 502 - DNA, 2079 bp, Lactobacillus salivarius
  isolated from gut, Lactobacillus salivarius
atgaataacaacaggaatggtaacggacttcttagaaatagtttcttttatatcgtagtattcttgggtattatgggtgtcttgtattatatgtttggtagtcgccaaagtatgcagacacaacaaattcaatctagtcaatttataacagaattgaagaagaataatattaaagattttacgatgcaaccttctggaagtacgtacaaaataacgggtacttatcgtcatgctaagaaatcatctggttcgagtggtattgccggaattgcttccagtggtgcggatgaatcaactggttttacaactaatgtattgacgaatgactcgactgtaaaacaaattcaagagtatgcacaaaaaaataaaataaaaaatagtgctaaagaagaagaatctagtagtatttggattcaacttttaatttcagtagttccaattctattcttcattttcttcttctacatgatgatgggtcaagctggccaaggtggcggcggtggccgtgttatgaactttggaaaatccaaagctaagcctattgacaaaaagaacaataaagttcgtttttcagatgtagctggtgctgaagaagaaaaacaagaattagttgaagttgtagaatttttgcgtgatccacgtaagttcttagctttaggtgctagaattccatctggtgtgctattggagggacctccaggaactggtaaaactttacttgctaaagctgttgctggtgaagctggtgtaccattcttctcaatttctggttctgacttcgttgaaatgttcgtcggtgttggtgctagtcgtgtgcgtgacttatttgaaaatgctaaaaagaacgcaccatctattatctttatcgatgaaattgatgcggtaggtcgtcgtcgtggtgccggaatgggcggtggacatgatgaacgtgaacaaacacttaaccaaatgttagttgaaatggatggtttcgaaggtgatgaaggtgtcatcgttatggcagctactaaccgttctgatgtattagaccctgctttgctacgtccaggtcgttttgaccgaaagattttagtaggtcgtcctgatgttaagggtcgtgaggctattttgaaggttcacgctaagaacaagcctttagcaaaagatgtcgatttgaagatgattgctaagcaaacacctggttttgttggtgctgacttagaaaacttattgaatgaagctgcattacaagctgctcgtcgtgataagaaagaaattgatgcatctgatatcgatgaagcagaagatagagttattgcaggacctgctaagcgtgatcgtgtaattagtaagcatgaacgtgaaacagtggcatatcacgaagctggacatacaattgtaggtttagtattaaatgaagcacgtgtagttcataaggttacaatcgtacctcgtggacgtgctggcggatatgctatcatgttaccaaaagaagatcaaatgttgatgtccaagaagaaccttaaggaacaaattgctggtttgatgggtggacgtgcagccgaagaaattatctttggtcaacaatcttcaggtgcttctaatgacttccaacaagctactcaattagctagagcaatggttacagaatttggtatgagtgacaagttaggccctgttcaatatgaaggtcaagctaatatgcaacctggtgaattcaatggtcaacatagttactctggacaaacagctaatatcattgacgaagaagttaaacgtattgccaatgaaggtatgcaacaagctaaggaaattatcgaagctcatagagaacaacataaagtaatcgctgaagcattacttgaacatgaaactctagatgaaaaacaaatcttgagtttgtataagacaggtaagatgccagcagaaaacgaagatgaatttcctagtgaaaaggcagcaacttttgaagaagcaaaacaagctgttgaacgtagagaagctaaaaaacaattagctgaaaaagatgaggaacataaagaaacagaagtgttctatcctcatgaatcagatgaagattctgataagaaagatgaataa

SEQ ID NO: 503 - DNA, 1149 bp, Lactobacillus salivarius
  isolated from gut, Lactobacillus salivarius
atgattatgaagaaatttgtgttagcaccagattcttttaaagaaagcatgacggctaaagaagtatgcgttgctatggaaaaaggtataaaaaaggtttttagcgatgcagaaattatacatgtaccaatggcagatggtggagaaggtacagtggaatctttagttgatgctacaaatggtcataaagagtatcttgaagttcaaggacctttacctgaacagaaagtaaaggcgtactatggaattttaggtgatgagaagacagctgtaattgagatggctcaagcaagtggattaatgttagtagaacctagagatagaaatcctctgacaactactacttatggtactggagaattaataaaagcagcactagataagggagtatcaactgttattataggaattggtggaagtgcaaccgttgatggcggtataggtatggcccaagccttaggggtaaaatttactgataaatacggaattaatgttgagccaactggtagaggtcttactaagattgataaaatttcaacggaaaacatggataaacgaatcaaaaatgtaaacttcattattgctagcgatgtagaaaatacattaactggtaaaaatggtgctgcagcagtatttggaccacaaaaaagggcaactcaggatgaagttgaattattggataaaggattatcacattatgccgagatattaagaaaggatctagataaagatgtaaaagacattgcaggcagtggtgctgcaggaggcttaggagctggtttaatagcattcttggatgctaagttacaatctggtgtggaagtagtagctaatacagttaatttagcagaaaaaatatctaacgcagactacgtatttactggtgaaggtggaatggatttccagactaaatatggaaaaacaccatttggagtcgcacaagttgctaaaaagtatcataaaccagtttttgctgaagcaggatatttaggagaaagaattgaagacctatacgatataggaatatctgcaatttttggaattgtagataaagctgaaagtatagaagaatctttagaaaaaggtccacaaaacgtagaaagaacaactgaaaatattacccgattaatatcgagtatcatagattaa

SEQ ID NO: 504 - DNA, 993 bp, Lactobacillus salivarius
  isolated from gut, Lactobacillus salivarius
atggaggaaagtagaatggaaatgcttaaagtacatggttctggtaatgattttttcattcttgatgaagataatcttgaagagcctttaacagaagaagaacttatccaattagcacaaaaggtttgtgatcgcgatacaggattacatggtggtgctgacggtgtcttatatgtccaagctggtcatgaaggcacagatggcagaatgcgtgttataaatgctgatggtagtgaagcaagtatgtgtggaaatggtattagaactgttgctcgctacttaagcgaaaagaaaaatttagcagaatttaaaatccaaacgatgcatgctgatcttgaagtgaagaaagctgataaactagcagaaaaggttccagcatttgatgcagaaatttcaccagttagttttgatgcacaagatttactaatgcatgtaggtaaagaaaaattaattgatgattatattccagagctatcagaaacaattaaattttctgcagtagcagttcctaatccacatttgattgcatttgttgatcatgaaacattgatgggtgaagaattaggaagaattgctagttatttaaataacggaaataatccaattttccctgatggtgtaaatgtaagttttgttgaaattctagaaccaggcaagatctttgttcgtacatttgaacgtggggtaggttttacaaatgcgtgtggtacagcgatgtcagcttcaagtttgatgtatgtcctactacattctgaccaaattgactttgaaaagttgattacagttattaatcctggtggtatggtaagaacaatggttcataaacgcgaaaatggtgactattggatgtcattgattggtaatgcgacagaagtggctaaggttaatatttctcaagcagatgcaatcaatggtaactttgataatttcacatggaatgaaactggtgagcaagcagcttatgaagcatttattgctcaacttcacagatag

SEQ ID NO: 505 - DNA, 894 bp, Lactobacillus salivarius
  isolated from gut, Lactobacillus salivarius
atgatggcaaacgaattacctgaaattgctaatccaacacgtacaagagcaattatggaaacatatggattgacgtttaaaaagagtttaggtcagaactttctaacagatattaatattttaaagaatattgtagctgcggcagaagtcagtgaagaagataatgtaattgaaattggaccaggaattggggctttaacagagcaattagcaaaaagagctaacaaagttatggcattggaaattgatgatagattactatcagttttggcagatactttatcaccatatgaaaatgttgaagtgatccatcaagatattctaaaagcagacttggaggctttgatagctgaacattttgaacctggtcataagttaaaattggttgctaatttaccatattacattactacacctattttgatgcacttattagattcggaaattgaatttgaaacaattgtagtaatgatgcaaaaagaagtagctgaaagattagctgcaaatcctgggacaaaggcatacggttctttatctgttgcggttcaatatgaaatggattcagaaattgcatttattgttcctaagacagtttttgtaccacaaccaaatgtggattctgcaattattgttttgaataaaaagaaagttaagcctaaagaaccacaggatgaaaaacattttaagaaattagttaagggcagctttatgcatagaagaaagagcttatggaataatcttcaaagcctttacggaaaagatcctgaaactaaagaaaaaatgttacaagctttggaagttgcagatattaagcaatctataagagctgaaaaattaacagtagctgactttataaatttatcagatgctctagaaaaaatggggattaattaa

SEQ ID NO: 506 - DNA, 1518 bp, Lactobacillus salivarius
  isolated from gut, Lactobacillus salivarius
atgggaatttcaactagcgataagccatatttagaaagaattgaagatgcaaaaagcgatcattttatgcaagctgccgtcgctaaggcccaagacgctcaatttattaaacgaacaaaagcaagacgtgaaatggaaaactggaatgaatggcgtgatttggctgaacaaattagacagcatgttttaaaatatcttcctgattatttagaagaattttcgcaaaatgttgaaaaacaaggtggacatgtattttttgctcaaaccgaggaagaagcacgtaattttattaaagaattagtaattgagaaaaaagcaaaaaatgtggttaaatccaagtcgatggttactactgaaattgacttagacaagactttattagatatagatggggttaatcttttagaaagtgacctagcagaatttattttgcaagaagataactgggatgaacctacacatattgtttttccaactttacataaaaaccgtgatcaagttcaagaagagtttaagaaattgggctatactggagacaatgaccctcaacatgaagctcgttttgttagaggatacttgcgcgactactttatgaaagctgattttggaataactggatgtaattttgccgtagctgataaaggtatcattaatttagatacaaacgaaggaaatgctgatttaacaatggctttacctaaaactcaagttgtagtaatggggatggaaagaattgttccatctatgaaagaagctgaagttttagataacatgcttgctcgttcagctgtaggacaaaaattaacaacatattgtactttctctggtaaaaaagtcgaaggtgaagttgatggacctgaagatttttgggtagttgttttagataatggacgttcagatgcattagggactgaatttgaaccaattttgcaatgtattcgttgtggtgcttgcatgaatgtttgtccagtatatcgtcatattggcggtaaaggatatggatctatctatcctggaccattaggtaaagttttatcgcctattttaggtggttatgaagaatttgaagatttgccatatgcttgttctttgtgtgctgcatgtacagaaacttgtccagttaaaattccgctacataatttgattaggaaacatcgaattgtagagatggacaaaaagcatatggatcatagtatgactaacttaattatgaaagtaattggtatgggaacaggttctccattcttattccaatcagcattaaaaatggagcatgctggcttaggtatgtttggaaaagcaaaaaatgatcaagatgttgatggaacaatttatgaaaatggcaagattaagaagttaccgaaaattgcacctaaattggttaaaggatggtctgatatccgtgatattccagttccccctaagagtaaagataacttcagaaattggtataagaatcatcaaccagttgagtcagtagtaagtattagacaaaagggggaaaagggtgatgagtaa

SEQ ID NO: 507 - DNA, 2367 bp, Lactobacillus salivarius
  isolated from gut, Lactobacillus salivarius
atgtcaacctctattggagttagaaaattagttgaatttatcctgaaaaaaggaaatttaacatctaatactaattcacaaaatactgctttagatgggatcagcattcatcaacgattacagaaaaaattctctaatgatacaaaatcggaaattgctttgaaaaaagaattagacattgatggtgaaacttggattattcatggaagagctgatggaattaaatatatcgatgaccgaccacaacaagttatcgaaataaaaacttctagtcctgaattttcagaattagctcctaatactctcgaactttattgggctcaagctaaaatttacgctcatataattatggaacaagagcaactgccagaattatctcttaaattgatttatgtacaaactactgataatacaatttctgaagaaactcaggttattagtcaaactgatgctcaaaatttctttgacaacattattgcggaatttacaaattggataaaacttcagcatcaactccaaaaagaacgcgatcattctattaacaaattagattttccattttcatcttataggaaaaatcaacatgaatttgctgctgcagtttataaaacaatagctttaaataaaaaattattagttgaagcccctactggaaccgggaaaactatttcaactatttttcctgcagtcaaggctttaggtactaaaaaatgtcaaaaaatattctacttaactgctaaacaaagtactcgcaaagtagctgaagaaactttacagttattggtaaaacatggactttctattactgcaattaccctaacttctaaagagcaaattacatttcctgaagaattagatttggcagacgatgaaaatccttattacttgggttattatgatcgcctacgaccagctttgatagatattttaaccaatgaaaaagtgattacccggaaaattgtggaaaattatgctaagaaacatatacttgatccttttgaattttctctagatattagtaattcttgtgatgtagtaatatgcgattataactacctttttgatcctttagttaagttacaacgattctttacagaaagaaactatgattatacttttttgttagatgaagctcataatctagttagtcgttctcgagatatgtatactaaagaaatttcttcacaacaaatcaaggatttattagacaaactccaaacgctgccacatccatcccaaaagattgtggataagctaaatactcttttaaatgattttgatttgattaaggaacccttagttaattatcaacaagctgacgtaataattgaggaaaaacttgcctcactgacaaaaaaattaatgtatttttgtgattttactactgattggctggcagaaaactcacatttttctcttaaagatgacttactggaatttttcttcgccgcttatacctttgttaagattagtgattattacaataatagctttagaacacatttatttattactgaaaattctgagttactaattagggtgttttgcttagattctagtgaattgattgctaatagtcttaacttgggaggtagtgctgttcttttttcagcgactttgtcaccattaaattactaccaagaaatgtttggattaattgataacagtttgttataccagctatcctcacctttcgatgaaagtaatcttaacttgttaataacatcttatattcctgttacttatcaacaaaggcagcaaagtcttggaaaaattattgatactattcacactatgattgctactaagcaagggaattatctgattttcttaccatcttatacttttttaaagcaggtagttgtggcatttaatcaagcttatccacatattgacactgtaattcaagaaaacgatatgattagagaacaacaggaagattttttgaattatttcgttgaaaatccaactaaaattttagtcggttttgctgtattaggtggtagtttttcagaaggaattgatttaaaaggtaatcgtctaagcggtgtagcaatagttagtgtgggacttccaaaattaagtaaagaaactaatgaactccaaagttacttcaataataaacaaaaagatggatttcaatatgcttatcaacttcctggacttaataatattttccaggctgctggtcgtgttatccgaagttctactgatgtaggtgtggtccttttaatagacaatcgttttgctacttctagatatgcgaaatttttcccaccacattggaaatatgcacagattattcacaatcaatatgaacttgaacaaaacttatctacattttggaataaaaataaagacagctaa

SEQ ID NO: 508 - DNA, 780 bp, Lactobacillus salivarius
  isolated from gut, Lactobacillus salivarius
atgagagattttcaaggcattgatgctaacgttaaagattggctaagaaaagctcgggaaataatattagatagtttcaatttaagcttggatgttgaaacgaaaagtggaccgacagatttagtgacgaatgttgataaagaggttgagagattttatattcaacaaatacaaaatgcatacccagaagctaagattttaggagaggaaacttcaaaaatacatccgcttacaaatatggaagggctagtttttattttagatccaattgatggtacgatgaattttgttaagcaaaagcgtaattttgcaagtatgattgccgtatattataataaccgtccgcttttaggatatatatatgacattataagggatgaactatattggggtggaccggtatatgatgccgtttattgcaacgattatcagcttgcaactccaacaaatagtattttaagtgaaggtttagtacaactttgtagaccttttgtcatgaatgatagctatggttttagaagagtagtagatgctagtgctggtttaagaatgtacggttgtgctggtctagaatttattaatgttttaacaggaagatgtatttgttatgcgtcagcattacgcccttgggatttggctgctggaaaaattttagctgaaacattagatttagttgttgaaacaattgacgtaaaagaaactaatatgttatcatcaaaagttgtattagtagctacaaagaatgctgaaaaagacattacaaaactcatttctatatag

SEQ ID NO: 509 - DNA, 1383 bp, Lactobacillus salivarius
  isolated from gut, Lactobacillus salivarius
atggcgattaaaaaaatgtggggtggacgtttccaagaaggttccagtaagttagttgatgaattcggtgcttcaatctcatttgataagcacatggcttatgaagatttagaaggctcattagcacacgtaaaaatgttgaaacatactaatattttatctgctgatgatgctgataaaatcatcgctggtttgcatattttacaagacaaattagctaatggagaattaactttttctactgaactagaagatattcatatgaatatggagtctcttctaactcaagaaattggcgatgttgctggaaagcttcatactgctagaagccgtaatgatcaggtagctactgacctacatttatatttgaaaaatcgtttagaaatcgtaatcgacgaaattaaaaatctccaaaaagttattgtaaagaaagccgaagaaaatgttgaaactgttatgcctggttatacacatttgcaacatgctcaacctatttcttatggtcattacctcatggcatattatcaaatgttccaaagagatattgaacgtttcgaattcaataaaaagcatactaacatttcgccattaggagccgcagcattagctggtacaactttccctattgatagagaatttaccgccaaagaattagacttcgataatatttatgctaattctttagatgctgtttccgaccgtgattttgtcctagaatttctaagtaacgcctcaattctcatgatgcacttatcacgtttttgtgaagaaattattctttggtgctcatacgaattcggctatattgaattatcagataaatattctactggttcttcaatcatgcctcaaaagaaaaatcctgatatggccgaacttattcgtggaaaatctggacgcgtttatggtcatctaactgctctactcgcaactatgaagagtctacctttagcctacaataaagacttgcaagaagataaagaaggtgtcttcgatgcagttaaaactgttattcctagtctaaagatttttgctggtatgttagatacactaactgttaataaagataagatgctacatgcaactgaacatgacttttctaacgctactgaattagccgattatcttgcaactaagggcattccatttagaaaagctcatgctatcgtagggcaattagtatttgaaggaattgaaaataatacaactttatcagatattcctcttgaaaaatacaaagaaattaacagcgaaattggtgaggatatttaccaattcttacaatctaaagttgcagttcaacgtcgccattcacttggtggtactggtttcgatcaagtaaaactacaaattaaaaacgctaaaaaacaacttaatttataa

SEQ ID NO: 510 - DNA, 1185 bp, Lactobacillus salivarius
  isolated from gut, Lactobacillus salivarius
atgaaagatataaaaacttataacgtaattgcgcaagaaggattagatgaattaccagcagatatgtacactgtgaataaaagtactaagcctgatgctttgttgattagaagtcaagatatgcataaaacaccttttggaactagcgttttagcgattgctcgagctggagcaggggtaaataatattcctttagagaaagcaacttcacagggaactgcggttttcaatactccaggttcaaatgcaaatgcggttaaggaacttattataacaatgctattactatctgttagaccagtttttgcatctgtaaaatgggcccaaaaattagctggggcagatgtttctttacaaacagaaaaagggaaaaatcattttgctggaactgaattatatggaaagaaaataggaataatcggtttaggtaatattggttcgcgtgtggctaaggcatgtatggatctggggatgaaagtaattggatatgatccatatatttctgttgaaaaagcatggcaactttccaatgatattcctagagctgaaagtttggaagaattgctagaacaaagtgattttattactattcatattccttacactgataaaaatagaaatatcattggtgaagatgagattaatgtgatgaaagatacggcagtattacttaattattcacgctggggaattgtggatgaagatgcagtaatcaaggcacttaatgctaaaaaattgcgtttatttatcacagacttcagttctgagaaaattttaaatcacaaacaaataattgtaactcctcatttaggtggaacaacagaagaagcagaagttaatggagctaagatggctgctaatactttgagaaaatatcttgaaactggagatattgttaattccgttaacttgccaaatgtagaaatggcattcgatgctccattgcgtctaactcttattcaccaaaatgttcctaatatggtgggtagaattactactattttggctaaagaagaaataaacattgataacatgattaaccgttcacgtggtaaaattgcttatacaatgattgatgctgcggatatttcagaaggaaaacttaaagaattaaagaaagagttactagaaatttctgaagttatccgagttcgagcattgcataatccaaaatttgtgaaatga

SEQ ID NO: 511 - DNA, 831 bp, Lactobacillus salivarius
  isolated from gut, Lactobacillus salivarius
atgttgatgaatttgcttaataatatagaagcaattttctccacactttctcgccaagaacgtaaagtagctttaaaagttcttcaaaatcctcaagaagtacaatctatgaatattactaaattagctaaaaaagcgggtgttagtaatgctactatcactcgctttgtgcgtagaatggaatgttctgattttcatgattttaaattaaagctcgctatatctgctgctagctctcctgaggttccagtttcttctgaaagcgattctatgggagataaagtttacgaattctatcaaaaagtacttcaaggtacttggaagcaactagatactgacactattcataatattgtccatgctattactaaggctcgtcgtgtctacgtttacggtttaggaagttcaggttatactgcacaagaattcactcaacgactaattcgtatgggaattgctgctttttgtacagtcgatagccatatgatgtttatagatagtactattgtaaactctgatgatgttatcatcgccattagtcaatctggtaatactgatgatgtaaatgttgcttgttctttagcaaaacaaaaaggaacaaaaattatcagcatcactggattttatcaaagtccacttatcgaactctctacttggagtgtagttgttaaaaacagtaattttgttgataatactcgctttattaattctcagctagcgatcgtttatgttatcgatattattacaatggaactgatggaaaaatctgaatatagttctactatgaataagaccgttgaattaatcatggatcgaaaattatctaaataa

SEQ ID NO: 512 - DNA, 1008 bp, Lactobacillus salivarius
  isolated from gut, Lactobacillus salivarius
atggaaaaacaaacaattacaatttatgatgttgctagagaagcagatgtttctatggctacagtttctagggtagtaaatggtaatcctaatgtaaaacctgctactagaaaaaaagttttagaagttattgatagacttgactatcgtcctaatgcagttgctagaggattggcaagtaagaaaacaacaactgttggagttattattccagacgttactaatgtctatttttcttcacttgctagaggtattgatgatgtagcttccatgtataaatacaacataattttggctaattcagatgctaatgaacaaaaagaattgcaagtgttaaatactttattagccaaacaagttgacggtattattttcatgggaaataagattactgatgaacttcgtaagcaaattgataaaaccaagacacctgtagtattggctggttctttagatgataaagaagaatttgaaagtgttcatattaattatgtagatgctgtagaagaagcagtttccgatttaattaatcatggtaatgataaaattgctttcatttctggaccattgtcagaaccaattaatagtaaatatagattacaaggttataaaaatgctttatctaaaaatggaattgcctatgatgaagaattagtttttgaaacagattatagttaccattcaggtgaaattttatggccagctttacaatcagttggggcaactgcagcttatgtaggtgatgatgaattagctgttggtatattaaatggtgcgcaagatgcaggtgctaaggttccaactgactttgaaattgtaacaagtaataattctaaattaactgaactagtaagacctaagttatcatccattactcaaccattgtatgatatcggtgcggtatccatgcgtttcttaactaagatgatgaacaaagaagaaacatcagctgatgaaaaaactattgaactaccttatggttatatcaagcgtggatcaacaaaatag

SEQ ID NO: 513 - DNA, 2154 bp, Lactobacillus salivarius
  isolated from gut, Lactobacillus salivarius
atggacaataaaggaatagtacagaatgacatagcagacgcacaagataaggtccaaaaacctcaacaaaatttaaaagatgaaatcaaaaatttaaacaaagatatagttgaattcacagaattaaaaaatgaaaaagagtcagagttagacaacttattaaatttacaaatatcattacaaaatgaatatgcaaaattagttaacataaaagaaaaaatttcaaatgaaggtgaagagagtcagaaagaagagttagagagaaataaaaaatctctagaaagagtagagaaatctttacacgagacggaattacagtggaatgataatcatagaaaattgattcaagccaaaaaagatctaaataatgtagaagaagaagttagcaacattgaaaaaaaacaagttaatgctaaagatagttcagaaataataaaaagagatgtagaacgtgctgatagaaaagtaaagatttcttatgaagattggatgcgtaagaaaaaagaaatagagagtacagaaaaagatatagctcagtgtaaaaacgatatttctagtaagaagaagcagttagaaaaagaaaaagataagttaccaactacggataagttagtcaaagaagtacagaaaaaaatagataagaatttggaaaatatagatacagttcaaaagcaaagggatgaattacaatctatattatctaaattagcaattgcaatagaaaaagaaaaaaataaaatagacttattgccgcaaattaggatacctcaagactacacacaattgctctttgaaaattttaattatggaaaaatttctcgtgaagaagtagcagatataatatctccaggcctagaacttaataataagaagttgaatttttcagaaattgatgataagaataaaatttcagatgtaacaaagcttacactgcaagaattaatagaaatctcaacatttgtagcaagtttattaaatccattacgagaaaaaatgggaagtaggttaatagaggttactccagattctatacagttcacacaagcagtggtagataggtataatcaggataattggcaaactttttacagtcagaaaagtaataaattaggtttaggacatgatattgaaggattgtcagatctatggaaccaaactccaagtgtttttgaggattatgatagcaaggatgaagaattggctaatggtgaagagtattttaatgaatttagtgataatgaaatgactatggctgacttaaagactgtgatttatagagtattagttgattttctatttaatgacactaaaaataattttggccatttagaaacgttgcttggtttaaataaaagcaaaaactatagtacacactatatggctgtgggaattgataacaatttagctattcactttgaattcgcgtataacaatataaaagctaatggttcatatgtcatatctgattttggaaagaaaaatatagaagcaaagatcaacgaattaaaggctgagcaagctggaaacttaataaaattaagtgatcttaatagtcaattggaaaatgaaaataagaataaaatagcgttggaagaagagttacaaaatgcccaaaagggtcctgatatgactgggattatgaaattggaagatgatttaaattctttgaataaaaatattagcgtactacaagatagattaagagggaaaaacaatttatcagaattggtacgtgaagagtggataaagaataagggacttttaagaagagaagaaaataaatttgaagcaagcaaagcagctatcactgcaactgaaattgaattgaattctattaaaattgatttaagtcagaaagaaaaacaagtagaaaaatataataaatcagagttagaaaatagtgaacaattgaatattttgaaagtaaactatgaaactattcaagaaaatatacagactatattagacgatttaaaagaatataatgggattgatcaaaagattgaagaattaaaggaaaagcttattaataatgaaaaagatgtagcaaagataactgccgtatataatgatttagttgttaaagttcaatcatatcaaaatgtattagaatataaggaaaaagaattaagtgacttacaagaatatgaatag

SEQ ID NO: 514 - DNA, 582 bp, Lactobacillus salivarius
  isolated from gut, Lactobacillus salivarius
atgggaaaattaattgtaaaagaaacaaaattacaagatgttaaattaattacaccggcagtatttggagataaccgtggattcttcacagaaagttattcagatcgtgatttcaaagcagctggaattgattttgattttattcaagataatcactctctttctacacaagcaggcgttttacgtggcttgcattttcaacgtggtaaagctgcacaaacaaagttgattcgagtagcaactggggcagttttagatgtgattgttgatttacgtaagggatctcctacatataagcaatgggaaggatacatcttatccgaaagtaatcatcgtcaattgttagtacctaagggttatgctcatggatttgttactttgacagacaacgttaacttcctttacaaatgtgataattactatgatgcagaagctgatggtggtatctccttcaagactcccgaacttaatattgattggccaattgatttagataaggcaatcacatctgaaaaagatgctaaccaacctactttaacagaatttgaaaaagacaatccatttgtttacggcgaaatttag

SEQ ID NO: 515 - DNA, 813 bp, Lactobacillus salivarius
  isolated from gut, Lactobacillus salivarius
atgtgtacagcaattactttaaatggtaatagtaattactttggaagaaacttagatttagatttttcatatggtgaggaggtaatcattactccggctgaatatgagtttaaatttagaaaggaaaaagctataaagaatcataaatcattaataggtgttggaattgtcgctaatgattatccactgtattttgatgctattaatgaggatggactaggaatggcaggattgaattttcctggaaatgcatattatagcgatgctttagagaatgataaagataatattacgccgttcgagtttattccatggattctgggacagtgtagcgatgttaatgaagtaagaaatttagttgaaagaataaatctcattaatcttagttttagcgaacagttacctttagcaggattacattggttaattgctgatagagaaaaatccatcgtagtagaagtaactaaatctggagtacatatttatgataatccaattggagtattgactaataatccagaatttaattatcagatgtacaatctgaataaatatcgcaatttatctatcagtacaccacaaaatacattctcagatagcgtggatttaaaggtagacggtactggttttggtggtattggcttaccaggcgatgtatctcccaaatctcgttttgtgagagttgcttttagtaagttaaattcaagtaaagggacgaccgtagaagaagatattactcagtttttccatatactagggacagtagaacagataaagggcgttaataagacagttagttacatatccatttga

SEQ ID NO: 516 - DNA, 612 bp, Lactobacillus gasseri
  isolated from gut, Lactobacillus gasseri
gtgcggattttgggagtccaaaatattaagcgttcaagtatctggaagattcggttgtcaacagcaacgataacgttgattcctgcagcagtcggaattaattatgttgccaaggcgtttgctgaaggattaaaattaccggtttggttaggaacgttgggaacttttctggcaagtatgttagctggcccggtggctggtgcaattagtggctttattaataacgtcatttatggattgacgctatcaccggtttcaacggtctacgcaattactagtattggaattgggattaccgttggggtcctccacgccaagggatggttttcatccgcaaagaaagtattcgtatccgctattattattgcaattgtatctgctgtcatttcaacaccactcaatgtcattttttggggtggccaaactgggattccttggggtgattcaattttcgctgcgatgatcgctaatcacattccggtttggatttcatcatttactgatgaatttattttggacattttggataaagttgttgttgcctacttggcattctttatctatcggcaactgccacagcgaatgattcactttttcagggatgataaataa

SEQ ID NO: 517 - DNA, 1155 bp, Lactobacillus salivarius
  isolated from gut, Lactobacillus salivarius
atgaagaagcaatttaagaattggctaattctagttatgctaggaattgcaattataactggtagtggaatcataagaggagtagaggcagataagattgatgccaaggcagcctacatgatagatgcaggtactggtcaggtcttgtatcaacaaaatgcgaatagtaaatacccaattgcatcactaactaaaatattaacattagcggttatcatgaaagatatccacaaccaaaaattaagttggaatcaaaaaattaaagtaaacaaagatgtgtctgatatggctaataactggcaatactccaatgttcagttaaacgagggtgaaagctatacagttaagtcactagtagaatcaatgatgattgtatcggcagatggtagtacagaagctttagccttggttgatgctggaagtgtgcaagcttttaatgaaaaaatgaaggaagtagcacatgaagcaggagttactgatgctgagatttataatatgattggtttgccaaattcagatttgggtaatttgaagttaaagaatgtaggcgatgatcaagaaaataaattttctgctaaagatatagctttgatttcaaagtatttagtaaataattatccagaagtaatagatattaccaaacagaagaatgttgattttaaaataagtgccgatcagacatataatatggagaatattaattacatgctggaaggaagttatgcagctcctaaaaatggaacaatagatggccttaagacaggatttacagatgaggctggatattgctttgtaggaacaggtacattcaatggacaacgtgtgataactgttattttgaatgcttcagattataataaacaattttctgaaacgaataagatgattgagtcagttatgaataatgataaagtagttaacactaaggatataaagagtgttaagcaagctttgaaaaaagaaaagttgaaagtaaatgatactaatatttgggtaacaaagaacaccgatcctaaacaaataaaagcaaaattaactctatctaatgaaaaaataaaagcaaaaaatgctaagaatgagaaagttggcacaattaaaatcagttcttctggggtatcttcagtggaattaaatgtcaatttagaagctaaataa

SEQ ID NO: 518 - DNA, 771 bp, Lactobacillus salivarius
  isolated from gut, Lactobacillus salivarius
gtggaaatatttgattcgcatacacatattaattcgcatgaatttgataatgatattcctgacgtaatagaaagagccaaggcacttgatgtcactgaaatgttggttattggatatgatgatgacagtagaaaaaaattacaagaaattattcaagaatatcctcatatttatggtgcggtagggtgtcatcctgaagatgcattaaattacaatgcagagtatgaacaagaattaagaaaatattttgaattagaaaagtttgttgctgtgggagaaataggtttggattattaccatgattcccctaaaaaagtacaacatgaagtatttgaaaagcaaatagctttggcccaagaacttaatttaccaataagtgtgcacaatcgcgatgcatttgaagattgttatgcaattttaaagaatatgaatattcaaaaaaatggcggaattatgcacagctttaatggtgatgccatttgggctgagaaatttttggacttaggcatggaattatcatatagtggagtagtgactttcaagagtgccaaggacgttcaagaatcaatgatgatgacaccattggagcatatgttagttgaaactgatgcaccttacttaactccaatgccatatagaaatagaatgaatgaaccagcaatgacaagatatacacttgaatttattgcagaaaaaagaggaatttcaagtgaagaattagctgaaataacaagaaaaaatacagaaagagttttaaagattaatgaatga

SEQ ID NO: 519 - DNA, 1161 bp, Lactobacillus salivarius
  isolated from gut, Lactobacillus salivarius
atgttagatctgaaagaaagggaaaatattatgaatattggatatatttcgccaactaatccatttgtagataagaaaagatggtcaggaactaattatagtactagagaagcattagaattggcagggcatacagttgaatggataaagtatgataataccaatttatttttgaaaatatataatagaattatttacaagttaatatatgggaatgggacacctacttattctaggttatccagctggttaaaagtaaaaactatccatgaaaatttagaaaagtatgatgtgatttttataccgggacaaatagatttggttgcgggtttaaaaacaaaaactcctataatttattatggggatgggacagttcctttaatggtagactattactggtttaattttactaaaagggctataaatgaagcaaaagagttagaattaaaagcagctaggaatgctagcataaatatatatgcatcaaattgggctagaaattctggaattaaagaatataaaatacatagttctaaagcaaaagtaataccatttggagctaatttatcatatgcagatactgataacattagtaatatagataaaaatgatagaattaatattattttttcaggagttgattggaaacgaaaaggtggagaattagctgtaaacgcttgtgaaaaattagttgaagatggctatgatgtaagacttacaatagtaggaataaaagatctagattatagagtgaagggtcttgattttatagattatttgggatttttagacaaagaagatgaaactcaatatttgaagtacttagatgcatggagaaaagcagatatattgttattaccaacgagagctgaatgtgcaggtattgttttcaacgaagcatcagcttttggagttccttctctttctgtagatacaggtggagtagcagattatgtgaaaaataacattaatggatataggatgccgctgtcagccaatggtgaagattttgcattaaaaatagaagaatggataaaggaagataaacttagtacactctctaaaggagcaaaaaaaatatataaatcaagaaataattggagaacttggggaattagttttaataaattattggaagatagtaatatttttaaaaagtaa

SEQ ID NO: 520 - DNA, 1734 bp, Lactobacillus salivarius
  isolated from gut, Lactobacillus salivarius
atggtaaagttgatgcgacgaaatttagattggtgggcagttattactgctactatctttttaggatttcaagtggtttgtgatttaagcttacctaatttgacatctaacttaataaataacggagtagctaaaggaaatgtaggatatatttggcaaataggtcttcaaatgctgggcctgactttagtcggtatttttgcagcagcaggaaatgtatattttgcttctactcaagcacaaaaaatgggtgctagattgagaggaaagatatttaaaaaagttttatcctttggaaattatgaaatggataaatttggttcttcatcattaattactaggacaacgaatgatgttatgcaaattcaaaacgttacaataatgatgttgagaatgatgattatggctcctttaatgctaataggggcaagtgtaatggcatattttaatgaaaaacgtctaactagcatattcttagtatctattccaatattactaatcgctattggatgtgctatgtattttgcagtgccgttatttcaaaaattacaaaaacaaatcgatagaattaatttaatctttcgtgaaggattaactggtgtaagagtaattagagcttttagacaagataagtttgaacaggaaagatttgatagagctaacaaagattatacagaaacaggaattaaagttttcagtattgtttctttaatgtttcctattatgaccttagttttgaatgtaacaaatatgggaattatttggtttggagctaagttaatagctaaccatgaaatgcaagtaggtaatttagtagctttcatgacttatgcctcaatgattttatttagctttatgatgctatcgatgatttttgtattggtaccaagagcggaagcagctgctaaacgtattaatgctgttttagagatagaaaattcaattaatgatgtagaatcagaaatagatagtgacaaggataaactacgagcaagcctagaatttaaggatgtatcatttagatatcgtggggcagaagatttagcattggataatttatctgtagatgtaaaagctggagaaacattagctattattggtgggacaggatccggtaaatctacattaattaatcttattcctcgactatacgatgtaaattcaggagaagtattggttgatggaaatgatgtccgaaaatatagcttacatgatttgcatgataaggtagcgttcgttcaacaaaaagcagtactttttaagggaactattcgttcaaacttactaattggaaatcctgaagcaactgaagaagacatgtggaaagctctagaaatagctcaagctaaagacttcatttcagacttaccagatggattagatgctgttgttgaacaaggtggggataatttttctggtggtcaaaagcagagattagcaattgcacgtgcaattatcaaacctgcttcaatttatgtatttgacgattctttttctgcattagactttaaaacagatgctaaattacgtttagcgctacgtcaagatgagagaattagcaaagcaattatagttattgtagctcaaagaatttcaacagttactggtgcagatcatattgttgttttagatgaaggcaaggtagtaggacaaggcacacataaggaattattagctgataatactacttaccaagaaattgttgaatcacagatgaaaggagctgcaatctaa

SEQ ID NO: 521 - DNA, 1803 bp, Lactobacillus salivarius
  isolated from gut, Lactobacillus salivarius
atggctttaccaaaaagaagtgaagttccagttaatgaaacatgggatttaaccgctatttatccagataaaaaagcttggaaagcagatatggtagcagttagagaattagttacacaatttcaaaataactatcgttctaaattaactgaggctaaaattattattgctgctttacatgatttagaaactatctatcaaaagcttagttggattgaacactatgctttcctacctcaaactacagatatgacaaatcctgaatacaatcagatgctagttgaaaatgataatttacaagctacaattacagctgatttgtcatttttcaagactgaagttctaactaatccagtgtctttacttgatcaagttgcagaaattgaacctcaatttgctcctgttgttcgtcattggaaagttgaaaaaccacatcaattatcaccagaagtagagaaaactttagcgacattaagtcctacacttaactcgtctgagcgtatctatactacagctcgtgctgctgattgggatatggaagattttgaagttgatggcaagacttatcctatgtcatttgtactttatgaaaatacttatcaatatcatccaaatcctgaagtacgtcataaggcacaccaaattttctctgatactttgcgcaaacataaaaatacagttgccgctaattattacactcaagtaagcaaggaaaagaaacttgctgatttacgtggctatgattccgtttttgattacttgttatcagatcaagaagtttcatgtgaaacatttgaccgacaaattgatgttattatcgatgaacttggtcctgttatgcaaaaatacgttaaacttctacaaaaagaacgtggcttagacaagatgctttactctgatttacaaatcgacttagatcctgaattcgcacctaaagctgatttagaatctgctactggctatattagcgaagctgtttccgtacttggtgaagattataaaaacgtgattttgaaagctttccctgaacgctgggtagatttccctgccaatgccggtaaagaatctggtggctttgaaacaactccatacggccttcatccttacatcttgatgtcttggactggtgttttacctgatgtctatactttaattcatgaattaggacacgctggtaactttattaagattaacgaaaataattcaatcttaacaagtgaaccatcattatacttaatcgagtctccttctacttttaatgaattattattaactcattcattggaacaaaagagtgatgatcctcgcatgaaacgtttcgcatataccacgatgctaacaaatacttacttccataactttatcacccacttattggaagcagcttttcaacgtgaagtttatactttagttgaaaatggtcaaacttttgatggtgataaacttactcaaattaaaatggatgttcaaaaacgtttctggggcgatgctgtagatattgacgaaaatgctggtctaacttggatgcgtcaatcccactactacatgggattatattcttacacttattctgctggcttaacaattgctactcaagcttatcttaaagttttagaagaaggtcaacctgccgttgatcgttggttagaatatatctctctaggtgatcaaaaggccccaatggatgcagctaaagttgcaggagttgatgttactactgcagaacctttgcataatactatcaagttcttaaacgacacagtcgataaagttattgcactaaccgaagaattaaatcaataa

SEQ ID NO: 522 - DNA, 924 bp, Lactobacillus salivarius
  isolated from gut, Lactobacillus salivarius
atgaataaaaataaaaaatacatactattaccttcatttctcacaatcgctctattattaagtggttgtgtacaaagaaccaaggatggaaaaccctatggattcatttacgaaaaattagctatacctactcaacatttattggaatggctatccggtgttctaggtggaagctatggctggtcaatcatagttattactttcattgttcgattaattatgatgcctattatgattaatcaatctaaaaaagcaactattcaacaagaaaaaattgcaatgattagacctcaacttgctaaaattcaagagcagcaaaaaaatgccaagactcctgaagagagaaatgctgctagccaagctatgatgaaactttaccaagaaaataatatttctatggttggtggaattggttgtcttccattacttatacaaatgcctatcttcgctgctttatatgcggcaatacaatattctcctgagttatctaagacaacttttatgggaattaacttaggtcatagaagttttacttttgttgtgctaacatttgttatttatgctttacaaggttggttgtctacattaggactacctgaagaacaaaaaaagcaaatgcaatcaatgattattgtatctccagtaatgctaactggaatgacatacatttcccctgctggtttaggattgtatttctttattggtggtatttttgcttgcattcaaactctaattattaatttcatgcgtcctagaattcgtaaggatattaaaaaagagctgaaaaataaaccaattaaagaagttaccgttgaatcacctgtaaagaagactgatgatgaaaagaaagtaacctcagtttctaaggatatgcatgaaaaaaatcgtaaaagaaacgctggtaagcaaaatcgtaagaaatga

SEQ ID NO: 523 - DNA, 738 bp, Lactobacillus salivarius
  isolated from gut, Lactobacillus salivarius
atgatatataccagtaactggtttaatattgatagcgagattgcgatcgataaattattgaagattggaaaatatagatctttctatgtaattcatagaaattctacttatttcgttttcaatattcataataatgactcaaaatataagtcaattatttttgataaaaaccaaggtattatattatcgaaactttcaacgacaacactatttaataaaataaatggtatatgtttcaccaagttaactactgagatggtcaagaaacatcataaatttcaggcatatacgtctgctatttctgactcccattgtttcattcgttcttctcagcatcctgctacttggatcaatctttacctagttgaatctatttgggatactaatcatcatgacatctcatttaaattcaaagatttatcaggctacgttacctttttaaatcagaaaacaagttttagaactagtttaaaagctactgctcatttcttgcataccgttgaaaatctgctaaatttcgatgcacaaaaaactatttctatgatttcggattacattgatatcggcacattaaaagatattcctcgcgatatttataccaaggaaatgctttaccaacttattaaagaaatttttgtttttctctgtgatgatattgattcgatgaatacagatgaaattcttgaagaatgccacaaatatctcgtgaacaaattctgctattttaatagaacatag

SEQ ID NO: 524 - DNA, 969 bp, Lactobacillus salivarius
  isolated from gut, Lactobacillus salivarius
gtgttacaatatgtgtatcttaaatatggggtggcagagatgcagaatttagtaattttggactttggttctaattctacaaggttgtctattaatgaagttagtgatgaaggtaagtaccaagaagtttttcgtactaaggaaatgacacgtatggcggaaggtatgggaaattctgaaaagaaagtgttgcaggctgacgcaattgaaagaacgctggatgctgttagaaaatttcagaaacattatgagaatttacctaatttaaagattaaaggaattgcaacagcggcagttagagtagctgagaataaagaagaatttttagagaaaataaagtctttgacaggtgtagaagtagaaattttatctggttctgctgaggcttactatgattatgtaggagtagctaattgtttagatgttaaggatgctgtcatctgtgatatgggtgggggtagctttgaggttattttgatgaaaaataaaaaggccttgaacctaatcagtattcagtatggagcagttagtttaactgagaaatttcaaacacaagataaaataaatgctggaaatttatttgagtttgaagtttttctccgagaattatttgctaaaaaactaccttggctatctgaagctaaagatttaccattggtgcttttaggtggggctaatcgtactgttgcgcgtaaaaaattgggcaagttagatgaaaaagatactactaatattcataacttccgtgtatataaagaagaatttcaaagaatatatcgtaagtggttagatatggacaaaactgagagatctacagatttaggggatgaaagtagtcgtgcagacatcataataggtggacttactcctgttatgcagttaatgttacaatgcgaaagtccatatgtgatgttttctgagagtggagtccgtgaaggtatcatctttgaattgttagctgaaaaatag

SEQ ID NO: 525 - DNA, 1737 bp, Lactobacillus salivarius
  isolated from gut, Lactobacillus salivarius
ttggaaaagcaaaaacttattaaattgatagatgtcgctgcaggtcgtaaaaaagctgatttagttttaaagaacgcaaagattgtagatgtttttcaagctaaaattttaacaggagatattgccatttctgacggttacatcgccggaattggtgaaagctatcaaggtgtagaagaacgtaattacacaggtaagtatgttgcaccaggtttcattgaagctcatattcatatcgagtcatcctatgtttctccagaagaatttagtcgagtttttattccaagaggaacgacaaccatcttggctgatcctcatgaaatcgtaaacgttgccggattaaaaggtttagattatatggtaaatgctgcaaagaacgcaaagatggatattcgctacatgatgccaccatgtgttccagcaactaattttgaaacttcaggtgcagatttatatgctgatgatatggaagatgcactaaagacaggtgaagttgatggcttagcagaactaatgaatttcccaggagttattaatgctgaagataagatgattgatgaaattcttatggctaaaaagtatggtgctcgaattgacgggcatgctcctcaagtagtaggaaaagacttaaatgcatatattgctgctggtccagctaacgaccatgaatgttcgactttagaggaagctgaagaacgtttagcgcgtggaatgtatcttttattacgtgaaggttcagttacacaagatttacgtaagctattgccaattgttaatactgctaattcacgtcgttgcttgttatctggcgatgatgtacaggcaaaaacagcgattaataaaggacacttagataatagtattagaatatgtattgatgaaggtttgaatccaattactgctattcagatggctacattaaatccagctgaatactgtggcttgaatgatagaggagcaattgcacctggtcgtcgtgcagatatggtcgtttttgaaagtttagaagactttgctgttgaagaaacttatattttaggtgaaaagttaagtcaaggaaatgaatatttaggtgaagttaactactatccaattgatagtgttgaatcttctatgcatgttaaggattttacacgcgaaaaacttcaactacatttaaatagtgacaaagttcgtgcaatcggagtagtaccaggtgaagttttgacaactgaagagcatgtgacagtaaagcgtgatggcgatggtaattttgtatacaacgatcaagaagatgtcacaaagattgtcgttgttgaacgtcaccataacactggaaatgtaaatgtgaacctattaagtggatatggtattaaagctggagcaatcgcaatttctattggacatgactcacataatattattgctactggaactaacgatgatgacatcttcatggctgttaatgaactcattaagcaagaaggtggggcagtcgtagttaaagatgaaaaagttatttcacgtatggaattgaagattgcaggattgatgtgcaatttaccagctgagaaaatgattgcacaacaagatgcacttgatgaagctgttcatgaagaattaggtgtaccagataatgttaacccagtaatgactttgagtttcatgccattagcagtaattccaaagctaaaaattacagataaagggttagttgatgttgaaaagaatgcttttgtcagcaatgagttagactaa

SEQ ID NO: 526 - DNA, 453 bp, Lactobacillus antri
  isolated from gut, Lactobacillus antri
atgattgagaaagaaaaagttttaagcgatgcaccaaaggttctaaattctgataacaatccttgggaagttactgttgaaggagattcgattattggtacatggaaatggatggatgcccggtttttcactgagggtggaatctccgatgaggacaaagagtttacttttacagttactttgaaagataacgggaaatggaaggaagttgatagcacttctagtaagacatcaagtattaggatgcataacggtaaactatctttcagtaaagacatctccttttctaagggaaagacttatcagaaaagtatttcttttggcattggacaggacaaggagagcggtaaagttggaattgttgaatctaggttagatacttcaatcattaaaaagtcgattcgagattatttgaaacaatgtggctggaagaaagctggactatttggatag

SEQ ID NO: 527 - DNA, 867 bp, Lactobacillus salivarius
  isolated from gut, Lactobacillus salivarius
gtgaaattctgtggagtggtagtttggtataatcctgctgatgatgttttgaataatatcaattcttatattactgaaattgagaaattatatatcattgataactcaaaagataatcacaacaacttattagctgattacaaatatcagaataaatgtgagtacatttctttacataaaaatctaggtttgacatatgctttaaatgtaggttgcaaaaaagcaattaaagatagctttgactatgttctaacaatggatcaggattcaatatttgaaccaacagctgttagtaaattaaaggtagcggctcaaaaagataaacgatatggtatcatttgtccaaatgttaagtctatttatcatgatgagaaaactaatctagacaaagtagcatatctaaaatggaaaaaggaagaatttaaagaaattccctggacaatgacttctggaagtttaacctcacttaaagcttatactgatgttggtggctttgatgatgatttatttatagcccatattgatatagatttttgcattagactaaaacaagataactggaaaattttaatggtaggaccagcagttattaagcagcgttttggaaattctaaaccagtgcgaattttatggaaaaaagttcacccatcatttgctagtcctgtgcgaacatattatttattcagaaatcagaaatatctagaaatgaaatatggaaaagagattcataaatttataggggtagatttatggaaattctttgtaaaaattactttgtttgagaaacaaagactaaagaaatacttgatgatgtttcaaggatacagggatgctaaagcaaatcgaatgggaaaatatagagattaa

SEQ ID NO: 528 - DNA, 1140 bp, Lactobacillus salivarius
  isolated from gut, Lactobacillus salivarius
atgggaaatgaagtgctttttccaggtgatactctggggattattggtgacagttctaatggaattagattggctcaaacagctaaaagactaggatttaaagtgattgtttatgctactaacgaaggaagtcctactttagcagatgcagatgttaagattgtgggtgattttagcgataaggctaagttacaagattttgctgagcgttgtgatttagtaatgtatgaatcagaacatatatcttctgaagttattgcatatctacaaaaattcactaaagttccgcaaggttctgaaactttagaaattacacaagatagattgttggaacgtgctttctttgaacaaatgaatataaatattgccccttatgcaacaattgttagcttagaggacgtttaccaagctgttagttcaattggatatccttgtgtattaaaacctattcaaaaaggatttggtcctaaacgtcaacaaataattcgtaagcaaacagatattgccaaatgtgcagacattattgatatggggacttatatcttagaatcgtggataccttataataaagaactatcagttataatgacacgtgattatgatggaaatttagcatattttcctgtaattgaaactagatataaagaaaatcgtcttaacgaggcaattgtaccagctaatgtccaacctgatgtagaggaggaagtaaaacgtttagctggtgaaattgtcagtggtttaaaatatgtaggtgctttagaagtagctttctatctaactgaaagtggttctttgtatgtaaaaagaattgtgccagctttacacaattctggctacgtctttgataaagcaactaatgtttcgatgtttgagcaacatcttagaactttggtgaagatgccattagttgatattaaattagttcaacctgcaggcatggtaatgattgaagaagaaaatattgatgacattcgtacacaatgggtactaaaaaataattggtattatacattctttagatacccagaatcaatgagaccacaaccagaaggctatattatagtattagctgaaagtgaaatggaaataaaacaacaaatagaatcgactggtatttgggacgatttatcaaaagaataa

SEQ ID NO: 529 - DNA, 1146 bp, Lactobacillus salivarius
  isolated from gut, Lactobacillus salivarius
gtggctaatgacaaaaataaagttcaaggcgatcaacctgaagaaagattaaaagctttagatgcagctttaaaaaagattgagaaaaagttcggtaagggttccattatgaaaatgggaggaaaggtagatacaaagatctctactatttctagtggctcaattgctattgatgcaggattaggtgtaggtggttatccacgaggacgtattattgaaatttatggtccagaaagttctggtaagacaacagttgcattacatgcagttgctgaagttcaaaaacgtggtggtacagcagcatatatcgatgctgaaaatgctttggatcctgcatatgctactgcattgggagtaaatattgatgaattactactttcacaaccagacactggtgaacaaggcttagaaattgctgatgctttggtttcatctggtgcaattgatataattgttgttgactcagtagccgctttagtacctaaagctgaaattgaaggtgaaatgggtgattctcatgttgggttgcaagctcgtttgatgtcacaggctttgagaaaactttcaggtacaatcaataagacgaagacggtagctatatttattaaccaaattcgtgaaaaagtaggggttatgtttggaaatcccgaaacaactcctggtggtcgtgctttgaagttctattcaactgttagaatggaagtgcgtcgttccgaagcaattaaggcaaaatctgaaattattggtaatagaactaagattaaatttgtgaaaaataaggttgctccaccattcaaagtagctgaagttgatattatgtatggtgaaggtatttctaaaactggtgaattactggatatggctgttgaaaaggatatcattcacaagagtggttcttggttctcttatggagatacaagaataggtcaaggacgtgaaaatgctaaggaatatcttagtgaacatgaagacgagatgaatgaaattaatatcaaagtcagagaagcatacggtataccggatgaaaatggaaatgtacctgaatctcaagataagaatactactcaatctgctatggatgacaaggctgcagatatagatgattctgaagaagtatctttagatgtaaatgatagtgacgaataa

SEQ ID NO: 530 - DNA, 1260 bp, Lactobacillus salivarius
  isolated from gut, Lactobacillus salivarius
atggcaatggaatattcattagattcaagtcaaaatacaggcgcaaatataaaagtaatcggtgttggtggtgcaggtggtaacgctgttaaccgtatgattgctgatgatgttaaaggtgttgagtttattgtagctaatactgatgttcaagctttacaacattcaaatgctgaaacaaaaattcaattaggacctaaattaacacgtggattaggtgcaggttccaatcctgaaatcggtagtaaagctgctcaagaaagtgaagaagcaattgccgaagctctttccggtgcagatatgatttttgttactgctggtatgggtggcggtacaggtacaggtgctgctcctattattgcaaagattgctaaagaacaaggtgctttaacagttggtgttgttacacgcccattcagttttgaaggaccaaagcgtgcaagatttgctgctgaaggtgtagcacaaatgaaagcacacgttgatactttagttatcatcgctaacaaccgcttattagaaatcgtagataagaagacaccaatgttacaagcattccaagaagcagataacgtattacgtcaaggtgtacaaggtatttctgatttaattacatcacctggttacgttaacttggactttgctgatgttaagactgttatgcaaaatcaaggttctgctttaatgggtattggtactgctaacggagaaaatagaacagcagaagctacaaagaaagctatttcttcacctttattggaagtatcaattgacggtgcagaacaagttttgcttaacatcacaggtggtccagacctaagtttatttgaagcacaagatgcttcagatattgtggctcaagctgctacaagtgatattaacattattttcggtacttctatcaatgaagaacttgaagattcagttatcgtaacagttattgcaactggtattgataaaaagaaaaaagaagcaccaaagcgtacaagaatgagtaatccacttaacaatacaggtattaatcattcaacaactggtgtgaatgaaacaacaactagaagtcaaggagatccattaggtgattgggatttaagtcgtgaaatgaataatcctcgtcaagctacacaaaatgaacgtggaaatgatttccaaaacgttgaaaagaaagatttcgatgtgttccaagctgattcagatgcagatgatagcaacgatgattctttaaatacgccaccattcttacgtcgccgtcgtcgttaa

SEQ ID NO: 531 - DNA, 2859 bp, Lactobacillus salivarius
  isolated from gut, Lactobacillus salivarius
gtgaatttctcatttgaaaaaaaagatttcaaaaaattatttatttggtattcaatttcatttgcgatagtcgctttttttgtttatggctcctattatttttcaggccattcattaatttggcaaatagatggttctcaacaacatttacctctattaattaattatcgcagagctttaattgaatttttacaccatcctttttctggtataacgacttggtcttggaaatacggattaggtgctgatacttttcaaatttattcttattatacagttggagatatctttgcttacctaaccttactatttcctgcaagtaaaataatttttgcttaccagttaatgattattttacgattatattttgctggattagcttttacatattttgctaatcatttcgacttgaaaaagtcagtcattattccaggagcaatggtttatatttttaatgcgtatcttttatacgccaacgttgcacaaccttttttcacaactgcattcataatttttccactaattatcttaggtttagaaaaagttttgcaagaaaaatccgcttggatgttgacatttgcattcacttggatgttaatcaacaacttttattttgcctttattttaggcattggagctatgatttatttagtaattcgagtctttttcacttatcgtaagactttaaattacttcttaatatttcggaagctcgcaggttctactattttaagtttgttactgagctctgtacttttaatccctgaattacttgcagtacaaaactctactcgagctggtagtactttcgccaatgggttaaaattttatccactctactattacttagccttaccatcgcagctaattaatggtggaaaccgtgatttttacttttggagtgctttaggtttttctagcatcgcctttttcggagtaatttatgtccttgctaagtatcgaaaatatccagttatgactgctattttcatccttagtgggattatgcttttattccccgcttttggtgcagcattcaatggtttaatgtctccttcaaatcgttggactctaatgctttgcttaccagtttcattatctgtatgtattttactagaacatgttaaaaaactatctccaaaaatgttaaagtacattacaattactaccgctatttatatcagtattgtaggtattaattattatttccaaaatagtgaaaaattatttattcctatcatcttcttatttgtatttttaggtttgattttttggttacgtttcattgattataaacacgcttatcgatgggcaaatattttagtattgttaaatgttattttaaatgctatttattttgaaacaccttataatggaggttttgctaatgaaatgttaccagctggtgcttatgataaattgcaaaatcaacgttatgctggtttagattcagatattgataatgataatacttttaaagtttctactattagtaataactattacttaggtgaagactttaaaatgtataacactcttaacgaaaaattgcatggacttagttcatattattccttacaaaacaaatatataggtcagtttgctttaaatatgcaaaatgtccaatatgaaactaatgtgcctctgcaacagtttgatgaccgctcagtgatcttaaactttttaggagttaaatatttatttactcagttgaatcaagaaaatgatactaaaattccatatggttatcatctcgataaaactactcgtttaatctatgatgtaaaccaaaattctagtaaaaaccaacaaacacgtagatatgctactaaaaataattttcctttgctttattggcaagacactgctatcactcctaaaaattacgataaactcagtgtctctcaaaaggaacgcttattaagtaaggcggtctttacatctagtaataatgccaaaggattgaaaaaagctaaaatttccaatactgatgtaattgacattccttatgtattggtttctagtcgtggaaatgttattgatactaataacttagaaaaacttgatgctaatgaaacttacaaacttgttttacaattagataaattgaaggaaaagaataatcttcctcaaaatgtagaattacatgttgaaataaatgatatcaagtacactccattttctttcaagaaacaaattgcactggaagaaaaaaatcaaacagatgatctaactaatggtcttctagctgctaatgaaaaattggcctactataaatactttagatatcatgttttgaagggatcacctgatatgagttatgctttaaatatcagctctaatcttggaactgaaacaattgctcaacctcgtcaaagcaaaacttcattctttaaaatcgtaaacagtggaaccatgaatatgggatatttcaagaatttaccggagactttaaaacttactccttcaaaaatgggaacttatagttttaaattaaaggtttatgctgaaccattaaatactagttacgataaagaagtagctaaaattcaaaaacatgcacttcaaaacttaaaattcaataagcacggtcttgaaggaaaaataactactaatcgtactggaatattaacttcttcaattccttattctaccggttggactgccacagtagatggaaaaaaagctcctgttattagaactaaccaagcttttgtaggattaaaactccctcaaggcacacataaagttaaattagtctataatattccaggtttgaaactagggatgattacctcaatcgttggattaattcttttagcaattagtttgatatatactaaatttaagaaaaaataa

SEQ ID NO: 532 - DNA, 1980 bp, Lactobacillus salivarius
  isolated from gut, Lactobacillus salivarius
atggctaaaattcacgaactttcagaaattttggctaatcaaattgcagccggagaagtagttgaaaggccggcatctgttgtaaaagagctagttgaaaattctattgatgctggggcaaagcagattgatataattattgaagatgccggattaaaatcaattcagattattgatgatggaaatggaattgaggctgaagatgttgaaacagcctttaaacgtcatgcaacaagtaagattatcgatagaaaagacttgtttaaagttcatacattaggttttagaggagaagctttaccaagtattgcctctgtttcagatgtagtgatggaaacagctgtatctggtcaagcaggaactaaaattcatatcaagggtggagaagtacttgaaaaaacactaagcgcaagtcgtgaaggtactactattacggtttcagatttattttataatacacctgcaagattaaagtatttaaaatctgttcaaacagaattgtcgtatattagtgatattgtaaatagattagctttgagtcatactgacgtagcactttcgttaacaaataatggacgtcaattattgcaatctgcagggaatggaaacttgcagcaaacaataggtgcaatttatggagttcaaaatgctcgtcaaatggtaaagtttgaggatgctaatctagattttaaaataagtggttatacttctttacctaaattaacaagagcgtcaagaaattatatcagtttgttggtaaatggacgttatgttaagaactttcaacttactaaagcagtaattgaagggtatggttcaaaattaatgacgggtcgttatccgataacggtcttgtcaatagaattagatcctactctagtagatgttaatgttcatcctacaaagcaagaaataaaaattagtaaggaagatgaattagttacatttattaagaagactatttttgaaagaattggtcaagaaaatctaattcctgatgggttgcaaaatattaaaagtaaaactaaggaaaaattagactttgagcaattaaaagtaggactaaatgaagcctctaaacaatatcaaactaaacagcatcgaacaggaataacaccagaagtgacagcagcattagttggagaaaaactgactaaagatgagagtcaaactcaaactaatgaaaaaataaaggaagaaactaaagtagagcttagtccgataattattaaagataaacaagatttaaaatctgatagagtaaaagagtgggatgaaaaatatcaatctcggaataaagaaacggaagttacatctatagcagaagaaagtggatcagtggatgacgaaagaaaagatgcaccgagatttccaactttacgctacattggccagatgcatggaactttcttatttgctgaaggcgaagagggattatatattgtagatcaacatgctgcacaagagcgtgtaaaatatgagtattatcgtgaagagataggaaaagtatctccaactcaacaaaatttgttagtaccaattgttttaacgtatccaacaaccgattcattgattattaatgaaaatgtggataaattgaaagaattaggtatatatttagaagattttggacaaaatacttatattattagacaacatcctacttggtttaaagaagggcaagaagagtcaattattcgtgaaatgatagactatttcttaaaagataggaaattaagtatcgctaaatttagagaaaaaaccgcaattatgatgagttgtaaaagatcgattaaagcaaatcatcatctagatgataagcaagctaaatcgattttagaacagttaaagacttgtgaaaatccttttaactgtccacatggtcgtccagtattggtgaaactttccaataaagatctggagcacatgtttaaacgaattcaagaccctcatcataccggaattttagaagaagattag

SEQ ID NO: 533 - DNA, 1326 bp, Lactobacillus salivarius
  isolated from gut, Lactobacillus salivarius
ttgaaaggggctggaaaaatgggtgaaagaggtcctattgaaggagaatttacagaattaaattcatcaaataacaatcaaaataacaacaacaataacaataataaaattataaagaaagttgcacttgttagcttagtagcaggcctacttggtggaggtattgcagttggtggatacaactggtatgaaaatagaaatgtaacttccaacaattctttgggaacaacgaaaacatctaatattaaggtagatgtaagtagtcagacaactaaagctttcaaatcagtgaaaaatgcagtagtttcagttgaagcttattcttctagcagtgcatctgattcacttgaagcaatctttggtaatagtagtaaaggagaaacaacaagtactagtgaaggttctggtgtgatttacaaaaaatctgggaatacagctttcattgtaactaataatcacgttgtttctggatccaataagattgaaattatcttggctagtggtaaaaaagtctctgctacagaagttggacatgatgcagttagtgacttagcggtattgaagatcaatgctaaagacgtaacacaagtagcgtcatttggtgactctgacaatattcaagttggtgaaacagccttggctatcggttcgccattgggttctcaatatgcaacttcattaactgaagggattatctcagctaagaaacgtacaattgatgtaactgatagttctggtaatgcaactggccaagcaactgtaattcaaacagatgcagccatcaaccctggtaactctggtggtcctttaatcaacttagcaggtcaagtaatcggaattaattccatgaaattgtcttctactggcacaagttcatatggcagtgacagcacatcagttgaaggaatgggatttgcaattccaagtaatgaagttgttaagatcattaatcagcttgtgaaaaatggtaaagtatctcgtccagccctaggtgtggcagtggtcgatttgagtaacatttcttctagtgatcaatcatcaactttgaaattgccaagtagtgtgactgaaggtgtggtaattgcgagtgttgaatctgattctccattgaagaacactgatattaagaagtatgatgtgattacaaaggttaatggtaagaagattagcgatgtagcgacattgaaagaagaattgtacaaacataagattggtgatactgtttcaattgagtattatcatgaaggtagtaagaagaccactaatgtgaagttgactttagaggcaaatgattctaataccacttcagcatctaacgaaaattaa

SEQ ID NO: 534 - DNA, 2268 bp, Lactobacillus salivarius
  isolated from gut, Lactobacillus salivarius
ttggataatgaaaaagctctggaacaaaaaagagtagatgatgtaatgaatgaaattcaaaagcaattagatgctactcaaattgaatatgataaagctcacaaggaaactacttcggttgaaagaaattatgttcaaaacgctagagtcaatacatatgaagttgatgatcaaatggaaacaaacgccgaaattcaacaacaaaagaatttagttgcaaaaacgattgaaaacgaaacaattttaaagaaacaattatccactctaaaaatcctacaagattctgcttactttggtagaatcgatatccatgaaaatggagaagaagattccgaaactctttatatcggaacatcttcattagtagatgaagatcaagattttctcatctatgattggcgtgcccctatttcttctatttactacaatggtacacttggccctgtatcctatgaaacacctatgggagaacaatttgctgaattaaaaaagaaacgtcaatttactataaaaaaaggtgtcattactaatatgtttgacactaatgaaacaattggtgatgaaattttacagagtgttttgggagaacattctgacgaatacatgcgtaatatcgttgctactattcaggctgaacaaaatgatattatccgcgatgttaaacatgacttgcttctagttcaaggagtagctggttctggaaaaacttctgctatcttacaaagaattgcttttctcttatatcacagtcgtgacaaacttaacgctgaacaaattgtgcttttttcacctaatcttttatttagtcactatatttctgaagtgttgcctagtttaggtgagaaaaacatgcgccaaattactttagcagaatttcttaataatcgttttgaagggttacaagttgaaagtctctttgataaatacgaaaagaagatcacttcttctaaaaaaacaaattcaattgaaagtattaaggaagatccacaatttatgcatacagttgaagaatatatccaaaatgttagctcatcccaactaagatttactgacattatgctagattccgagattttctttagtcataatgaaattcatgatatctattctcaacttccacaggctatgaaacctagtcaaaaatttgctgaaactaaaaacttacttattaaacaattaaatagaaaaattaaagaaaatgctcaagctgattgggttcgtagtgaaattgaaaacttatcagatgaagaatactatgatttacttggtactaaaagacgacatgcctttcaagcaattgatgatgaagaattttacattggtagaaaaattgtaaaaaaacgttttgctcccgtatatgacgctttatataacaattattttattgactactatgctcaatattctgattttttagccaataaattaccagaagctgttgacctttttaatcaaaatttggagtttcataaaatagatttagttgatgctgctcctcttttatatttacgtgatttactaacaggtagtgggcgtaatcaagccattgcacatctattcattgatgagatgcaagactacacattaccacaattaatgtatttaaagtatattttccctaatgctaaactcactcttttaggtgatagtgaacaagcattgttcaatgaatttagaacaccacaagagttactagattactttaacaaacatctcaatatcaaaaaatcacgcatcatcaagttaaataaaagttatcgttcaacacaacaaataactaattttatgaaagctttattaccagatggcaatgaaattcaagcttttacacgccaaggtaaaaagcctgaattaattatcgcttctaaagaaaatggattacatgcattgaaacttgaattaaagcaacgtgatttaagttctccagttgctttaataactaaaaaccaagctgaaagtgacttcttatatcaaaaacttcgtaaaagtttcgattctgtcactttactagaagataaagatcgttcattgcctaagggtatcgttattttaccaatttatcttgctaaaggattggaatttgatgatgttatagcttatgatatttcacatgataattattctggaataaatgatactggaattttatacacaatttgttctcgtgcgatgcacagactaactttaatttcatgtggaaagccatcatctttaattatgagtattccatctgatttatacactactaagtcaaccgttactttataa

SEQ ID NO: 535 - DNA, 864 bp, Lactobacillus salivarius
  isolated from gut, Lactobacillus salivarius
atgaaaaaaacattatttgtcattaagacattattacttgctttcttacttttgagtttagcaagtattccaggaggttttgccatgggattcagttccgcatcaaatcctggtacctccactgatactcctgtatttctaactatcactttaataggcgagattattgttcctatctatctccttatttattatcgtgctaaaaataatttagatgcacttgatattgttatgccatttaaaaaagataaaattgctcaaaaatttggtataggatatctcattggttttctagcttttgctatagttttcgccgttgctgtttttggtggaggttttactactaagattgtatggtcgagtaaaaatattgttttatttatattaatgcttattggatttctcatccaaggaactaccgaagaaattgtttgtcgtggttatgttcaaggaaggattactgaaaaattaggtgtattttgggcaattgctcttagtgccctcttctttgcgagtggtcacttaggaaatgctggtgtttcgctcgaagggttcgtcggtctgcttgcatttggtattctaacagccttgcttcgtttttatacaggtgatctttggctatgtggtgctctccatggtgcttggaatttcgctgaaggtccattctttggcactccagtttctggaattagtgggacagaactattatttaagtccacttctgtgcctcaccatccttggttaaatggtggtgcttttggtattgaagctagtcttacttgcatcatcgtattaatcttattatcatttttaactgtttacttaggtcaaaaatattcagttaataaattggacctaaactag

SEQ ID NO: 536 - DNA, 1716 bp, Lactobacillus salivarius
  isolated from gut, Lactobacillus salivarius
atgactgaaaagaaagtaattactgctcaagctcaagggcataacggaccaattgatttggaaattggagttgaaaatcaagaaattataaatgttgatgtaaagaaacattctgaaacaaaaggtatttttaatcaagttttctcaaaactaagaaatgatattcttgataatcaaagttttgatatcgatgcaattagtggcgctactgtcatgagtgatgcaattttgaaatcagctaaagatgcggtggaagaagcagaagtaaagattgattctaagaaaaaagatattcctcatgtaactgaagaattgcatacagatgttgttgttattggtggtggagaagctggcttagttgctggatgtcgcgccttaaaattaggaaagaaagtaattttagtagaaaaaaatggttacctaggtggagctacaatcctaaatggttctaatgtaactgcaacaggatctaaagttgctaagaatatttttggcgatgaagcggataatgatacaccagaaaaattagcagatgatgttagacgtgaatcaaaagatactaatgttcctgagttaactaatttaatggcaaataacattggtgatgcaattgattttatttctgaatttgctggcttagaatatcgaaaagctcaaactcaaacaccagaacattcagttgaacgtcaagttgaattaccaacatcaagtagttatgaatttatcactaaagttgctaaagcttttgaagaaaaaggtggccaaatcttacttgatagtcgagtagaagaggttataactgacggtgataagattacaggtattgtgactgaaggaaagcataaaacaaccaagatttttgcttcggcagtagttctagcttccggtggttatggtgctaatacaaagatgcgtggaccagaaagtcaaggtttatactattatggtccaatgacatcaactggcgatgcttatcaattcttagctccattacaattgaagacaaggaacttaggctggtataaagtatatcctcatggggtagaaactgaaccaggaattgctaagttaacaacatatgcatctaaacttgctactgatatgggagcaatttatgttaatacagatggtaaacgaatcgttaatgaatctgatgtatatgctgaattaagagatgcagtcttaaaacaaaaagacagagtggcattcttagtaatggataagcgaacatgggatgaattctacaagttgttagtcttacatgactttagtgaaagtgaaatcgctgattactttgcaaaagacggaaagagtaatccaattcttgtgaagggtagtttacaagaagttgcacaaaaagcaggtattgatgtagctggtttaagtgaaactgttcaaaaatacaatgactatgctaaacaaggaaaagatgaagaatttggccgagatagtaaattcttacatgaatatgaaggcgatgaattttacatcattgaacaacatgatcgttttgcaaccacattaggtggatttgtaacagatgcagatctacatctacaatttgaaaatggtaataaattggctaatgtagttgctgcaggtgaagtaatcggtggagcaaatggacacgattctatgccaagtatgatgaactcatggggcatttcttccggatttgtagcaggaaaagaagcagctgaaataagtgaaaattaa

SEQ ID NO: 537 - DNA, 1884 bp, Lactobacillus salivarius
  isolated from gut, Lactobacillus salivarius
atgatagaggcagaaaatatgaataaaaaagttcgcttcttccattcaatccattttaaaatagcccttgtatttgcattgttattactaataacttttcaaattgttggggctatatttgttagacaactaaaaaatgataatttaaaatctttcaaacaacgagtggaattgtctacttatgttgaaaattcattaatagttgctttgagtaggacggatacagaaggggctaacactaaaattaagaacatcttagatgatattaataacgctaatattcaagaagttcaagtaatagatgcgaaaggcactatcaggggagatagtgatgtaaatagtcgttctttaatcgggcaaaagacaacaaatagtgcagttaaaggcgtgctttatacaggtcgtacatatacagaaacgacttataatcggaatgataataagcaatattacatttcaatcacacctttgctgaatgtatcgagtaataataacgctgttgttggggcaatttatactcgggcagatatggcgagtgtatatgactcggtaaataacgttgtagtgatctttgcttctgcttcgttaattgcgattgttatcggtatgtttttagcgatcattgtttcaagttcgattactaagccaatcgaagaaatgaagcggcaaacagctaggattgcacgtggagattactcaggacacgtacatcaatatggaaatgatgaattaggtcaattagcacaagctgtaaataatttatcaattcgtgttgaagaaactcaggagctttctgaatcagaaagaagaagattggacagtgtgctatcgcatatgtctgacggtgtgattgcgactgatagacgtggtgggataacgattgttaatgatatggcgatgaattatctcgatatttctgaaggcgaagtattaggtaagtcaatcttagatattttggatattcgtaaccaatatacgttaagagatttgctagaaaaacaagatgaagttgtccttgatatgtcaggtgaaaaagacttaatcttgaatgcctatttctcagttattcaaagagaatctggctttatttctgggattgtctgcgtgctacacgatgttacggaacaacaaaagattgatagagaacgtaagcaatttgtttctaacgtttcccacgaattgcgtacacctttaacaagtatgcgcagctacattgaagcgttgaatgatggtgcttggagagatgaaaaagttgctccagaatttttgaaggttacacaagatgaaactgacagaatgatacgtatgattaatgatttgctaagcttatcaagaatggattctggaactgtaaaattagatctagaattagtcaatatcaatgggctagtaaattatattctggatcgtttcgacatgatgttgaagaaagataagattgatacgcgagatattaagactaagaattacacgattaaacgtgattttactaaacgtgatttatgggtagagttagataccgataaattcattcaagtggttgacaatatcatgaataacgcgattaagtactctcctgatggcggggtaatcacttgtcgcttattggaaacacacaataatgtaattctaagtatcagtgaccaaggtttaggaattccaaagaaagatctaggtcatgtctttgatcgtttcttccgggttgataaggcacgttcaagggctcaaggaggaactggtttaggattagcgatttctaaagaagtaatcgaacttcatcatggtcgcatttgggtagatagtgtagaaggtaaaggttcaacattctatatttctttaccatatgaagaatatagtgaggaggatttgtgggatgaaaattag

SEQ ID NO: 538 - DNA, 909 bp, Lactobacillus salivarius
  isolated from gut, Lactobacillus salivarius
atgaaaacgaagggcatattattagctgctggtggagcatcattatggggaggttcaggagcagcagcccagcaattattcatgacacatgcagtgacaacagagtggttagtagctgttagattattaggtgcaggattactattattaatttggggattaattaagtcttcaaaacaaatcgatgaaattattcatgatcgaaaaaatatggcaatggttttggcattcgcaattttcggagttatgaattcacaattatcttatttttttgctattaaatatagcaatgcaccgacagcgacagtcttacaatatttacagccagtattgatcgttttatggatggcttttggtcagaaaattagaccaagaagggtagatggaatttcaattgtcgtagcattaatgggaacatttttgctagtaactggtggtcgtttagatacactaactctaaccccaattgcgttagcttggggattatggagtgcagttgctgctacattatatacattacttccaagtggattgttgaaaaaatacgatgcgatggtagtatgtgggctagcgatgtttgttagtggaattattatgttgccatggttcttaacaatggaacaaccacatttatcattattcaatatagtgttagtgatctatattgtggtatttggaacgatgtttgcctataccttatttttacaaagtattcgttatatagcaccatccgttaccggaattttaagtgcttttgaaccattgattgcgacaattttagctgttactttattaggaactaaattatcaacagccgcaattattggatcattattgattgttttaacaacagttattcaagctgtgccatttaatgtaatatggcgaagatttagaagggttaaataa

SEQ ID NO: 539 - DNA, 405 bp, Unknownn
  isolated from gut, unidentified
atgtcaaaaaatttcagaaatgtaatcaattgttttacaaacggagtcggatatggtgcaacaacttttttattgtttgttgcctttgatgggtttcagagtgtaacatcatttaatgtgctaagtgttttaatcattagtgggttaattggggtgctgactttagtttttgacctagataattggtcatacttggttgaactgttgctccattttctcggggcctttagtttgattctagtgatgatgtggttgaatcattggctgagcttacaaaattggttgaatttttgcatcagctttataggaatttatttaattatcttttttattgtcaagatgaaaatagcttctgatgtcaaacgggttaatcaaaaattgtctgaacggcatcagaagaaatga

SEQ ID NO: 540 - DNA, 849 bp, Lactobacillus salivarius
  isolated from gut, Lactobacillus salivarius
gtgaaaaaaataattttaaagatagtattgattattttacttgtattagtaggatttcaaattacaagtctattacctagtaaaaacaaaccattgagagaagataagttactcaatgatataaattatagtgatacaccaactttattgattccaggttgggcaggaaataagtggacatataatcgtatgatagatacatatcaagatgaaaatgttgcacaaaaaacaatgacaattcatgttagcccaacaggaaaagtaaaagtacatggaactgtaaaaaataagaaaaatgcgatgatacaagttttgtttgattggaattatactgctagttatcgaccacaaacaaaatggttaactaatataatgctgattttacatgataaatatcatataaataaaatgaatgtaatagcccattcttggggtggtagtgcttggttgcatgccttagctggatctagtaaacttcaaaaagaaataaagttttctcgagtaatattattaggtgttccagtagaggagagctttgatgatattagttataaaaaagttaagaaaattcactcaactgatggaaattatcaaaaattagtagcgcaaactaagtatttgagacttagagcgaagataaagttctataatttcctaggtgagataaaaaatgagaatactgatggttcggtaccacatgtacaatcagaatttcttcagaaaatagtaaatcctaaatgggcctattatagccagatgacttttgaagatacaagtcattcaggtttgcatagcgatgagaaagtcttaaaggaaatagaacaaatattgtgggaaaaagaaaaataa

SEQ ID NO: 541 - DNA, 768 bp, Lactobacillus salivarius
  isolated from gut, Lactobacillus salivarius
atgaaaaaaagatatgttctaatggggttattatcattgctatttctaggagcatgttccaataataaacaggaaacagcttcatctagcagtagtcatgtgagctcaagtctagcatcaactgatactattaatcaaaccctagacactgtaggatcacttaaatatcatttaggtactgttactactagaaaagttgaaaatgaccgtaataactatacagaggccgaaagaaagttcaaatataagtcatctcttggggatacttactatcgtactacaatcacttatagtgttactaatgttggcgaagaaactattaatttagctaaaacaccattatcagttacaactgacaatggtagcaaatttacttcaacgggaaaacttaatcactatgcgcataacgttcttgtaaatggatataagttaaaggttggcaaaaaattacaaggaaaattagtactattatcatcacacaagttagacattagttctattcaattaaatattggaactcaggtaccttataacagtacagatgatactgccgaagtaactagtgaaaataccacaaatagtgctaccacttcttcagctgtatcttcaaccacctcttcttctgatagtatttctccggatttacaacaacaattaatccaaaatgaacagggcgagaataaggtcaacggttctaatagtggatcttcaaatagttcagcatcatcttcatctgctcaaaccggtactagtggaactgctcaataa

SEQ ID NO: 542 - DNA, 708 bp, Lactobacillus salivarius
  isolated from gut, Lactobacillus salivarius
atgaacggatttattggtgaatttcttggtacgatgattttaattgttctaggtgtaggtaccggcgccggcataaatcttaagacgtcatatgcacgtaatgctggttggttgttcgtaactctagcatggggtatggccgtaacgttcggtgtttatgtagctggtagttttggagcccaaggacatttgaatccagcggtaacaatcggatttgctctttttggtttcttcccttggagccaagttttaccatatttattaggacaatttttaggtgcttttgttggtgcagttttagtaatcattcaatatggagcacaattcaagaatgctaagaatactagcgatggtaatgtagttggaattttcgcaactggtccagctattgacaatggtttatataatttcttgagtgaaacaatcgcaacttttgtatttatctttacattattaaatcttggcgactttacaaaaggattgaagccattaatcgttggtttattgattatggtagttggtcaagctttgggtggaacaacaggtttcgctttgaatccagctcgtgactgggctccaagatttgcttatacagtattaccagtacctaataagagtaatgcaaattggggctatgcatgggtaccaatgttaggtccaattgttggaggtatcttagctgctggcttacaatatttattagtataa

SEQ ID NO: 543 - DNA, 1902 bp, Lactobacillus salivarius
  isolated from gut, Lactobacillus salivarius
atggttaataacgaattaataaaagatgacttatatatggctgtcaacggcgactggttaaagactgctaaaattccagctgataaagctgctacaggtggtttttatgatttagccgatgatattgaaaaaactttaatggaagatttcgccaattttatgacaagtgaagcaacatctgacgatagatacttaaatgaattcattaaatattatcgtctcgtttccaattttgaaaagcgtaatgctgatggatttaaacctgccaaacaatactttgataagattacttcattaaaagacatcaatgattggcaagaaaagctctatgatttaactatgatgggactacctaatcctttcccattatatgttgaacctgatatgaaagatactcaacactatgccctatatgcatctgtacctagcttaattttgccagataaaacctactatgaagaaaatcaccctcaagctgaagcattactcagtgtttatcgtcaaatggtacttgccttgtttgagcgtgctggctatgacaatgactttgcacaagcaactttagaaaaggcgcttgcttttgataagtcacttgctcctgttcaaaaagatagtaccgaacgtgctgattatgctaaatcctataataagtacagttttgaagattatacagcattcagtaagagtgtagatttaggagcttttgctaagaaattgatcggtcaaactcctgatcaagtcattgtggatgaacctaaatattatgaagcattagaaactttgattaatcctgatactttcgaaaacttcaagagttggcttttagtaaaaactctcatcagtgtaagtaccttattggatgatgatactcgtgttctagctggcacatattctcgtactttgtctggttctaaagaagctatgaaagcccaaaaagctgccttttaccttgctactggtcaatttagtcaagtagttggattatattatgcacataaatattttggtgctaaagctaaggctgatgttcatcatatggtagaaaagatgattgatgtttataaaaatcgccttgcttccaatgattggttgagtgatgatactcgccaaaaagctattgttaagcttaatactttgggaataaatgtaggttatcctgataagttagatccactttacactaagtttgttgtcgatgaagatgcagatttagttactaatgacttaaactttactcaaattagccttaaggaacattatgatcgttggggtaaagatgttgatagaagtcgttgggaaatgccagctcacatggtaaatgcttattataatccttcatttaatatcattgttttcccagcagctattcttcaagctccattttatagcttagatcaatcttcaagtgaaaactttggtggaattggtgcggtaattgctcatgaaatttcacacgcatttgacaataatggtgctcagtttgatgagtttggtaatttacacaattggtggactgatgaagatttgaaacatttccaaggacttgctcaagatatgattgctgaatttgatggtctagaaactgaagcaggtaaagttaacggaaagcttgtagtttcagaaaatatcgctgatgctggtggtctaagttgtgcattagaagctgctaagagtgaaccagatgttgatctaaaagccttcttcattaactgggctcgcatttggagaatgaagtcttcaattgaacgtcaaaaattattattatcaattgatgttcatgctcctcacgtattacgtgctaatgttcaacctaagaatctagctgatttttatacaacatttgagatcacatcagatgataagatgtatctcgctcctgaaaaacgtgtaaatatttggtag

SEQ ID NO: 544 - DNA, 918 bp, Lactobacillus salivarius
  isolated from gut, Lactobacillus salivarius
gtgtataaaaataaagaggtaagaaaaatgtctgattatttagttaaaagcttagtatatgatggagcaattagagcttatgcagttgatgctactgaaactgtaggagaagcacaaaaattacacgatacttggagtgctgcttcagctgcttttggtagaagtttgataggtactttattattatcagcatcggaactatctggtgatgaaaaaatgaccgtaaaaatcaatggcgatggaccaattggggctattgtggtagatggtaatgctaaaggtacagtcaaaggatacgtacatgaaccacatgtgcatttgcctttaaatgaaaaacataagattgatgttaaaggcgcagtaggtactcaaggctttttatcagtaactaaagatttaggattaaaagagccttttacaggacaagtgccccttgtatctggtgagttaggtgaagatttcacttactatctagctaagtcagagcaaattccatcagccgtaggattatctgtttttgttgaagatgataacacaataggtgtagctggtggttttatgattcaagttttaccaggagctagtgatgagattttagatgaaattgaaaagaagttacaagaaataccgttagtatctgaaatgatgcgtaaagatggtaagactcctgaagaaattttgtatacacttttcccaaaagacaaagtaaaaattcttgagaaaatgccagtagcatatgaatgcgattgttcaaaagaaagatttgctgaagcactagcaagtttacctaaaaaagatcttgaagaaatgatagaacaagataaaggtgcagaagcagtttgccatttttgtgggaaaaaatatgaatttaatgaagaagaattaactaaaattatgaatgaagctaatcaagcttaa

SEQ ID NO: 545 - DNA, 702 bp, Lactobacillus salivarius
  isolated from gut, Lactobacillus salivarius
atgaatttgtttggaggaatcgtcatggataatgttatcgatcttgcgttcaatttgcttcaccctgacattactattagcttaggtgggggaagtaatgttaaaaaactcgctcataagttgagtcaacatcctgaattgaatattaaagtttgttctccttcagaatatactagacaaatttgtcatgatttaaatttaaatctcattgatataactgaagtctctactatcgaatttggttttgatggttgtgatgctattgattttgatttaaatgtcttaaaaagtaacggtggtatccatacattggaaaaagaatatgcctataaagcagaaaaatatattattatatctccaccagaaagattaaaagcttctcttaatccaaatgttcaactttgtttagaagttgtttctccttctgttaactctgttttgtctgcagctaaacaattaggtttaaaagccgaattaagatcggccagtgctgttgctagttacgcccgtgcacctctaggcaattatcttattgattgctactgtgaaagctggcaagacattaaaaaaataaataacagactaagttcacttaacggagttgtatcaacttcatattttgaaaacattgtccactctgttttaacacttgataaaaataataatcctattgaaataaagaaaggtgatttacatgcataa

SEQ ID NO: 546 - DNA, 879 bp, Lactobacillus salivarius
  isolated from gut, Lactobacillus salivarius
gtgagtgtaaaaattattgtaccagctactagtgctaatataggtccaggatttgattctttaggattagctgtaactagttatttaacagtgactgttgtggaagagaatgtagatgcttggtatgttgatcatagtttaggtgaaaaaattccacatgatgaagaaaatttaattgtaaaaacagctttagaattagtaccagacctacaaccattaacagtaaaagtagaatctgatattccattaacccgaggtctaggaagtagttcttctgctatcgttgcaggcttgatgttagcaaattattttggaaacttaaatctttcgaagcaggaattggttcaaagagcgactgaaattgaaggacatccagataacgttgcaccagctatactaggcgattttgttgttgctacatatttagatggagaaataatgtatgaaaaaataagttttccagacgtaagcttgttagcatatattcctgattattggttagctactaaaaagagtaggggagtattaccagcaaatttggatttcaaagatgccgttagagctaatgcaattggcaatgcattggtggcgaagattgtatcaggaaataaaaaagatatgggaaaattaatggaagcagatcttttacacgaaccatatcgtgataaattagttccacatttcttaaagttaagatatttgggacatgaggtaggagcatttgctacgtatttaagtggagctggtcctacaacaatgacactaattgaaaaagacaagattgatgaatttataaaagttgctcaagaatcggggttaaatgatgaatatcgcctgcttgaagttgatagaaatggtgcaaggattgaaataaaataa

SEQ ID NO: 547 - DNA, 885 bp, Lactobacillus salivarius
  isolated from gut, Lactobacillus salivarius
atgcagaagatagtatattatggatataatgaaagcgtactggactttctgaaaataggcataaataataacactaggttatattttaattggcaaattaatgatactgatattcaggatgaaataaataatttggtagagtgttcacgtctgctatcacctaatttttatttttatataaatgaaactgtaaattgggatgaaattgacatgatgctactttcaattgatgtggatagagataatttcgctcaaaagaatagttggatccaaaaagtggtcactgaagctgtagccaatggatttaatggtatagttgtattagatagtaataaggactatttattgattaatgaaattttaaaatacacagggctttcatctagacaagtgttgggattaggaacttctatagaatcagaagttgtagctagaacggttgcaaagaaattaggaattaatagtaattatattcagacgagtgtaattggaactagagataagtcttttgttttgtggagtaagggtagagttgctgaagcatcacttatgagtttaatagtgcaagaaaaaaatatgtttagtataaaaaatatgcaagagatatctaaagagtataaaggattagctgaaaagactcgaaagttaattttttcttctgtattaaataagatattaatggcgatggatacttccgaacagtttataataactctggttcatagtaggaatgaggagattgaaagttatagttcacctgtattagttggaaagatgggagttatagaattaataaaagtgaattatacagaagatgagcaagatgctttaaatgaggtaaaaaaagctattaatgatgagttagatagatataaattaagatga

SEQ ID NO: 548 - DNA, 789 bp, Lactobacillus salivarius
  isolated from gut, Lactobacillus salivarius
atgaaacagagagttattacagcagtcatagcattgctgatttttattcctttactagtagtgggaggaaatttatttagtatattagtagtagcaatgggattagtgggaatgtcagaattcttaactatgaaaagaaaacttttaatttcacctgaggcaatagtagcttttatggcagtagcttgcctattagtaccaagtaattggatcaatttttttccaaatggaattttttatagtggattctatttcttcacgctagtattactaggatatacagttgttagtcgtaatagattttcctttgatgatgtgggagctataattttaggagctatttattcaggattaggatttcactatatgatttatgctcgccaagaaagtttatggatgattttatacgcattcttgattacttggattacagatagtggcgcatacttaatcgggcgtcaaattgggcgtactaagttagctcctcatattagtcctaacaaaacatgggaaggatcaattgggggtacagtgagtgctgtcattatcgtaggaatctatcttttctttaagcaaggtgtttttccatacggctttttaactatgttaggaataacagtatttctatcaattggtgctcaatttggtgatttaattgaatcagcatttaagagacattatggagtaaaagattctggaaaaattttaccaggacacggtggaatattagatagatttgattcaattttgttagttttacctttaatgcatttcgttgggttaatttag

SEQ ID NO: 549 - DNA, 2574 bp, Lactobacillus salivarius
  isolated from gut, Lactobacillus salivarius
gtgaaaaagaagaatgtagcgtattatacattatcatttttaattcctgtgttaatgctggcggtaacttttgcattggctaaggtgtatccatttggaaataatactgctgtagttggtgatatgaaaaatcaatatgcagcaatattaacctatggaaaagaaaatttttttaatatacataagctgttgtattctaatagtttggctttaggtggaaatttttacgctgtattaacatattatttattttcgcctatcaatttgattgcattatttttttcagataagtatataccgttattttatttcattaatatttgtttgaatgcaggatgtataggattaacgacatatatatttttactgaaatcaaggtttgttaatagttatgtggataaaactattagtgtaaaaacagtgaatatgttaagagtgatttttagtgcaatctatacattaagtacattttatgttcaatattctcatactataatgtggttcgatgcaataatattttttccattagtgttattagggtatgagcagttaattaatagtaataaagcaattttatattgtatttcattaatattactaattttatctaactattatattggtgtaatggttctagtatttttactagtgttgacgttattttggattgttttatcattagtctgcaagaaagaatatctgttaataatgaaaaaaagtatatacttgttgttgtatactatcttaccaataggggtaggtacaatagtattgttacctagctttttaggacaacaagctgtatatcaggaaaaatatcgattttctctagataaaatctatccgcttagagatagcttaggatcattgttaaatggcaatatgaataatgcagatataccaatgctatatacaagcatttttactttaattgcagtaacagtattttttatatctgataaaatagatttgaaattaaaggtaacatcatttgtagcaattatattattatttatatcaacctggataaaaggcttgtatatgatttggcatgctttttcaatgccaaatggatactcgcaaagagaagcatacataatattactagtattaataacaataggttatataggtagtacttatataagcagtggttatataagttttattatagctggtataatatggagtttgataggtgtatttataacatataaatgggattttctttcaaatcagcaactattagttgatatattattaataataattgaaattttagtaattactctaatgtataaaaagggtaaaaaatatatttggttgttgttatttattattttgggtgaaataggattttcatattatccaagggagaatgcaatagctcaaacgtctattccaatggatagttatgtaaaattaactgaagttaaccaaaatgtattaactaaattaaataagaacgatcatagcttttataggattggatctacaattcaattaaatgaaaatgatcctttgatgtatggttacaatggtttatcaacgtatgtgtcacagcaatctaaagaatctacagattatttatctgcacttggttactatcaaaaacattcatggattagatggagctcatttaataatggatcgacagcagcagtaaatagaatgttgggattaaagtatgtaattgctccaaaaaataaaaatcttttagatgcaactatatctggaaaatcaatgtcgactagtgacagtgcaccaaattttccagaaggaattaaagaaaatagtgatgatttcaatatttataaggataagggagcactaccaatagtatttaaaaccgagaataccgctaaagatgtagtaattaactataatccagtagataatccatttcttaggctgaactcgcttttttcacaaggttttggaatatcaaatatgtatcgagaaataaaaagtgatttaattaaacaaaatgaagtttccaaagaatatgcaattgatgtagtaagtgatggaaatgtatactgctacttaccaatagatcaaaatgtagttactgagagtagtataaaagtatcagtaaatggtaaacatataacaacaatgtttggagaaaatgtttggggagaaaacggaattgtatatttaggatcctataaaaaaggtacaaagattcatgttaattatgaaagtaaggatactcaaagtattaatccagtatttgcagttgaacatgaaggaagcttattagagctgaataaatttagaaaaggaattgctgacattaaagttaatggtgatttgattagctttgataaaaaaacagaagatactaatttagcaatatctgtaccatatgattctgcttggacggctgaaataaatggaaaaccagtacaaacttataaaactttaggtggtttactgggaattagagtaattgaaaaaggaaaagtaaatctgaagtataatgttccaggattgagggtgagcataataatatctactatatctgtaatattattatgtctatgttgggtactaaagagaaatagttaa

SEQ ID NO: 550 - DNA, 1368 bp, Lactobacillus salivarius
  isolated from gut, Lactobacillus salivarius
atggtagagaaacaaattgagagcgaagaagaaatcaatgctattttaaatttattaaatcaacagaaggcgcatgattttagagagcaatacttagacttacacgtctatgagcaagcacaaatttttgctgaaatggactatatccaacgttctagattgtatcgctatcttactcctgaagaagttggggaaatctttaatgttagtgaagaagaaccagtggtattagcaaattattttgaagaaatgactccgcgttatgcagcccaagttattaattcaatgtatacagataatgcggttgatattttggcgtatgctaagaagaaaaacttagtaaaatatatgaagttactgccagaagaatcggcaactgagattagagaaatgctgcattatgaagataaaactgctggagcgatcatgtctacagaatatgttgacattgtgggtaaccaaactgttagatcggcgatgcacgttatcaagagtgaagctttagaagcagaaactatttattatgtttacgtaattgacgatgaagaaaagttaatcggagttttaactctacgtgatttattaactaatgatgatgatacaatgattagcgatattatgaatactccagtaatgtcagttgaagtttctgaagaccaagaagaagttgctcaaacaatcagagattataatttcttagcaattccagtaaccgactacgatgataagttaataggaatcattaacgtcgatgatattattgacgttatcgatgaagaatcgtctgaagattactcaggtttggctggtgttgatacagagcaagttacgataaatccttttgaaaatgctaaaaaacgtctaccaagtttaacagtaatgttgttgttgggattattgacagttttattagtttcacatttcgaatacctgttaaatcaagctacaattttagcagtatttatttcaactattaccggtgcttctggtaatgcgggtacccagagtttagctgtggcgattaaacgtattgccaataatgatgatgatgagtctaggttaaaaattatggtaaatgaaattttgactggtatcttgattggtggagttactggtattattatttggattttggttggggcatggaaggcaaactttgttttaggatttgtagttggaatagctatgttctttgcaattattatagctaatttagtgggttgtttaattccaatgataatggaaaaatttaatgttgatccttctgttgcttcaggtgctcttatttcaactttaagtgacgtgacttcactattaatatatttcctttttgcacaaatgtttttacaattttttattggacaataa

SEQ ID NO: 551 - DNA, 1518 bp, Lactobacillus salivarius
  isolated from gut, Lactobacillus salivarius
atgatgtcagataaatatattatggctatcgacgaaggtactacaagtacacgtgcgattatcttcgacaaaaaaggaaataaagttgctgaaggacaaaaagaatttcgtcaatatttccctcaaccaggctgggtagaacatgacgctaatgaaatttggaacgcagtattatcaacaatagctaattcttttattagctcaggaatacaaccaaaacaaattgcaggtattggtattactaaccaacgtgaaacaactattatttgggacaaagaaacaggattaccaatttataacgctattgtttggcaatcaagacaaacaagtgacattgcacaaaaattaattgatgaaggttattctgatactattcatgaaaagacaggtttaatcattgatgcctacttctcagcaacaaagattcgttggatcttagatcatgtagaaggcgctcaagaacgtgctgaaaaaggtgaattattattcggtacgattgatacatggcttacatggaaattaacaggtggtaaagttcacgtaacagattattctaatgctagtcgtacaatgttgttcaacattcatgatttgaaatgggataaagaaattttagaattattgaatattcctgaagctctattaccagaagttaaaggaaattctgaaatctatggtcaaactgcagcataccacttctttggtagtcaagttcctatttccggtatggctggtgaccaacaatctgctttattcggtcaactagctttagaagatggaacagttaagaatacttatggtacaggttcatttattgtaatgaatacaggtaataaaccagttctttctaagaataacttgttaacaactattggatattctatcgatggcaagattaattttgctttagaaggttcagtatttgtatctggttcagcacttcaatggttaagagatagtatggaaatcattgaatcagctcctgaatcagaaagagcagcaaatgaatcaactaaccataatgaagtttacgttgttccagcctttacaggtttaggtgctccttactgggatagtgatgctcgcggggcagtgttcggattgacacgtggtacaactaagaatgactttattaaagctactttacaatcacttgcttaccaaacaagagatgtattagatacgatggaaaaagatacaggtattaagattccagtccttcgtgttgacggtggagctgctatgaataattacttgttacaattccaatctgatttacttaataagtcagttgaaagagctggaaacttggaaacaacagctctaggtgtagctttcttagctggattggcagttggtttctggaaagacacagatgaattgaaagaattatttacagttggtcgcagatttgaaccagaaatgtccgatgatgctagagaatatctatatgctggatggaagaacgcagtagaagcaacacgtatattcaaacataaaataaacgaaaatctttag

SEQ ID NO: 552 - DNA, 681 bp, Unknownn
  isolated from gut, unidentified
ttgatagataaaccccaatatattattgttgctggtattaacggagcaggtaagagtacgctgtacgatacatttcccatattgtttgataaaacaaaacggattaatgctgatgagattttacgacaaatgggtgacgattggcataaagacagcgataatttaaaagccatgcgtgaagaaataaagcaactacactattccttagataaccgacaaagtattcatgtagaaacaacacttgctggaagaggtaaggctcaactaaatttgattgataaggcgcatgaaaatggctttgaagtgactttattgtatgttgccctacgagatgaaaatttagctattaagagagtagaggatcgggtacaaaagggtggacatggtgtgccatcagaaataatcaaaaaacgttaccggcaatcaaatcataatttatcagcggttgcgtttaaaagtgacaatgtttttatttatgataatagtgaaaaatttgttactgtttataaaagagaaaaagggcaaataatcaagaatgatttaagccatttcccttggataaatcaaaatattaattgttcagaaaaggtgcaaaatcagttaaaaaattttgtagatcataacccagaagttaagctaaaaaataatcctgaaaacaaaaacgatcggcctagttattag

SEQ ID NO: 553 - DNA, 1932 bp, Lactobacillus salivarius
  isolated from gut, Lactobacillus salivarius
atgctattagagagtcaaaataaaaaaattattgtcttaggctcatataatagtggagctttaagtgcaatttatacactaagcaaacaaggatataaaccaattctggttgctcctagaattaatgaaagtcagatgtcagagctattagatgaattctatagtatgaaaatgacagctgataatttagcagacatagttactaaaactagaccagatgccattattccgatttttggtgggcaaacaggaataaatgcatgtataaagctagcaaaggatggtttactaagcgctctaaatgtaaaaattttgggaacagatttagcatcattaagtagtatgtttgatagagaaaaatttagtaacttacttaatgaagaaagaattccaacgccaatctctaagaaaataacaaatatagaagaagcaatcgactttgctagtgaatataattatccagtaattgtcagagcttcagcaacgactaataaacctggtggagatttgtgtaacaatagaagagaactaatagttaatgtaaatcgagcatttgaagaatcgccaataagtaattgtctgatagaagcaagtgtaactgggtataaggaattagaattagaggttgtcagggatagttatgataactgtattttggttggggcatttgaaaatattgacgctgttgggatacattcagctgactcaatggtagtagcaccgattcaaacattagatgatcaggaatttcagaaacttcgaactgtttcattgcgattagcaagaatgtttaatatagttggaagttgcaatattcgaatagcgtttgattcattgagagatacgtattacatattagaaatgaatccatcttttaatagatcttcggttctgatctctgcgattacagcatatccattagctgatattattactaaaatttcacttggaatacgcctagatgcaattagaagaactggattttcaaatcttacagctgctagtgaaccaataatggattatttagccgttaaggttccaaattggtccaaaggtcaagctaagaggttagggactagaagacaggcaaagggacaaatagttgctttcggtagatcattggaaagtgcgctaatgaaagctattgagtcaatgactaatgaaagaattgatagtatgctaacccagtttttgaatattgatgattttcaattagaagaaaacttagttcaccctcaagcaaatcgtttattcataattgcagaagcttttagacgtggatatacaattggtgaaattagtgagttaacgaagattgatgcgcagttcttatatacaatatacaaattaattgatttcatagaaaatataaaaaatgctgaaccaagtgagaaaagcattcgacaagcaaaggaacttggaatcagtgataaaatgttagctaaattatggaatattcaggtagataaaatagaacaaatacgtaatgatttggcgataagaccgacatataagaagatagatggagtcgcagggacgctagatgctaatgtatcatacttttatgcaacatatgaagaagaggatgagttggaggaaagtaaagcagatattttactaattgatggggttgaaagtttatccaatcgaagctttgccaataatcagcagctattgatattagcaaattctggattagatgtaagtttaatttcaaattctccagatacattggcttttagtctatctttgccaattacaactttctttgaaccgttgtcatatgaagttatagctgaaattacaagaaaatgtaatccagaaactctatgtttgaaaaaaccagaagaattatctgaggacttaaaatctgaattaaacaatttgaatataaaaataacagaatggaattatacaggaggaaaattatga

SEQ ID NO: 554 - DNA, 1578 bp, Lactobacillus salivarius
  isolated from gut, Lactobacillus salivarius
atggataaaaaacaattagaagaatcagttaataatcgtcgtacatttgcgattatttctcacccggatgctggtaagactacaataactgaacaattattactttttggtggagttgtaagaaaagcagggactgttaaagctaaaaaaagtggaaatttcgctaagtctgactggatggaaattgaaaagaaacgtggaatttctgtaacaagttcggtaatgcaatttgactatgctgggaaaagagtaaacattcttgatacacctgggcacgaagatttttccgaagatacatatcgtactttgatggcggttgactcagctgtcatggttattgactcagctaagggtattgaaccacaaacaaagaaattattccaagtttgtcgtatgagaggtattccaatttttacttttattaataagttggatcgcgatggtagagaaccattagatttaacagcagaattggaagacgttttgggaattgaatcttatgctatgaactggccaattggtatgggaaaaggcttgaagggattatatgatatttataatcatcgtattgaattgtaccgttctgaagatgaaggccaagcctttttagaattggacgataatggtgaaataaaaggagacaacccattaaaagatgaaagtatctacaaacaagttttagaagaaatagaacttattgaaggtgcaggtagtgaatttgatgaagaaaaaattgctaaaggtgaattgacaccagtatttttcggatctgcactgacaaactttggtgttaagacattcttagatgcatatttgaagtacgctccaaagcctgcagcacataaaacagaagatggttcggaaatagaaccagatagaaaagatttctctggatttatcttcaagattcaagctaatatgaatccaaatcatcgtgaccgtattgcttttgttagaatctgttccggtgaatttgatagaggaatggatgtgttcctagaaagaacaggcaagaaactaagattatctaattcaactcaatttatggctgatacacgtgaaacattggaaacagctgttgctggagatattattggtttatatgatactggtaacttccaaattggtgattcaatttatacaggtaaaaaagccgttaaatttgagaaactaccacaatttacaccggaattatttatgcgtgtaactgctaaaaatgttatgaaacaaaaatctttccataaaggaattcaacaattagtacaagaaggagctgttcagctctaccaaagttatagtactggagattatattttaggtgctgtagggcaacttcaatttgaagtgttccaatttagaatggcaaatgaatataactctgaagttgttatgactccgatgggacataagattgcacgttggattgatccagaacaattagatgaaaagatgtctagttcacgaaatcttttagttaaggatagagctggtatgccattattcttattcgaaaatgaattcgctgaaagatggtttatggataaatatccagatgtcaaattaacagctaaattataa

SEQ ID NO: 555 - DNA, 798 bp, Lactobacillus salivarius
  isolated from gut, Lactobacillus salivarius
atggcagttattaccatgaaacaattactagaagctggtgtacattttggtcaccaaacacgtcgttggaaccctaagatgaagaagtatatctttacagaacgtaacggtatctacatcattgacttacaaaaaacagttaagttaattgatgatgcatatgacttcattaaagatgctgcaagtgatgacggcgtagtattatttgttggtacaaagaagcaagcacaagaagctatcgaagaagaagcaaagcgtgcaggtcaatactatgttaaccatcgttggttaggtggtactttgactaactggaatacaattcaaaagcgtattaagaagttaaaagaaatcaaagcaatggctgaagatggtacttttgatcgcttacctaagaaggaagttgctttgttaattaaacaaagagatcgtttagaaaaattccttggtggtattgaagatatgccacgtattcctgatgtattgttcatcgttgatcctcgtaaagaacgtatcgctgttaaggaagctcaaaagttgaacattcctattgttgctatggttgatacaaacgctgatcctgatgaaattgatgttaagattccatcaaacgatgatgcaattcgtgcagttcgtttaatcacttctaagatggcagatgctatcattgaaggtcgtcaaggtgaagatgatgcacctgttactgaagatacatttgaaaatacagatgatcaagttgattcaatcgaagatatcgttgaagctgtagaaggcgacaatgatagcacagatgctgaatag

SEQ ID NO: 556 - DNA, 1695 bp, Lactobacillus salivarius
  isolated from gut, Lactobacillus salivarius
atgaggaagaagaaagctataatgataggtgccggtttagcaaatatggctggtgcagtttatttgatccaagaaggaaattgggatggtaaagatattactttttatgctttagacacacatggtgctaatgacggatctactgcttctgaagctgctgaagaatattggaataaaaatcatccaatggaaaatacaaagggatttattgctcgtggtggacgtatgttaaactatcgtacatacgttgatttgatggatttattggacagaattccttcagttacagaaccaggcatgacggctgctgaagatacacgtgattttgatagtaagcatcgtacctatgataaagctcgtttgcttcaaggaggcaagggaatcgttgatggtcacaagcttggtttaaacaatctagacagaatactactttcacgtttagttatgatgcctgataatcaagaagaaaagctagataatgtgacaattgcagaatattttgaagattcgccacatattttccaaactaatttctggtacatgtgggaaacaacttttgcatttagaacacaatcatcagctcaagaattaagacgttatatgcatcagatgatttatgaatttactcaaattgaacatttagtaggggtaaatcgtacacgttacaaccaatatgaaagtattatgttaccactaattaagtatcttgaaggacaaggatgtaattttgttatgaatagacgagttacagactttgaatttaaagatacaccaatgcaagatgaaattactgtaactggtttagaaatggaaaacatcgaacaaggcacagtagaacacgtagctgtagatgatgaaacagttgtcttctttactaacggatctatcacagattctgcaactttaggtgatttcaacaccccagctcctgaaaatatggactatggagcagcttcatcattatggaagaaagcatgcgaaagattttataacctgggaaatcctgataaattcttcaatgatagagatgcatcagaatgggtaagttttactttaacaactaagaatcatattttattaaatgaaattactagaattacaactcaagttccaggaaatgctttaaattcattcatttcaactgaacctattacaccattaggacataaagatgttaatatgtcgattgttgtacatcatcaaccacactttacaacacaaaaagctaatgaatctgtaatttggggatacttcttatatccacgtcgtcgaggagaatttgttgataaacaatatatcaagatgacaggtaaagaaatgttgcaagaattgataggacaattatctaaagtagatcctggtccacacaatatcatggacttagaagatgaaattatggacagtgttatcaattgtatcccagtatacatgccatatgcttcagcattatttaacaatcgtgctaagagtgatcgtccagaagtaattccaaagcattctacaaacttagcatttactggagagtttgtagaacaaccatatcaaatggtatttactgaacaaagtgcagttcgttcaggtgaagttgctgcattccattttgcaggagtgtcagagactaaactagttaagaatccacgctttgataaagatccaagagtattgcttagagcaacgaagagaatgtttgaatag

SEQ ID NO: 557 - DNA, 1392 bp, Lactobacillus salivarius
  isolated from gut, Lactobacillus salivarius
gtgatttttataaataagggaaataaatggctagctgcaggtttaggcgctgtagtccttatctgtggtggctcattcttctatcaaaagcaacatttcaatcgtaatatcgaaatcaatggtgttaaagttggaggaatgtcagtcgctgaagctacgcaaaaactcaaaacaactaaattaaataacaatgtatatctaggggaaaaattacttgttaaaggtagcgatcctaccaattcaactaatgctgtttctcaagaaaaggttcaagaaatttttgacaagcaattcagccttttcccatctagtcgtagttacgactaccaagctaagggtgatagtgattactcttatcgtaaaaatgaattgcgtgcagctgttaaaagtgaactagaacgtttaaacgttagtcgaacagctcctaaagatgcctatgcagagttaaagaatggttctgtccatgttattaacgctaaaaagggtaatcaatatgatatagataaaattatgcaagaatatgataagcaatttagcgataatcaaataaaacttactactgtctacactcaaccaattagtgctgatagcaagcaagttcaagctgacaaagctaaattagaaaaattagctgatcaaaaagttaattacactgttcaaaataagacttatactttagctgctaaagatgttattaattccgctaaaattgtagatggaaaatatgaatatgatgctgctaatttaaagaagaaaattgatgatatcaacgacagtcaaagtacactcgataagaatctcaaattcaaaacaactggtggttctgaaattaccttagataagggtacctatggatgggctcttagccctattaaggctacaaaatctatcaccactgcttttgaaaaaggtgattctagccttaatgccaaaagtgatatttatggtgaaggctataccgaaaatggtctaggatataacactacatccaacagtggtatcggtaattcttacgttgaagtttctatctcccaacaacatgtatgggtatataagaatggtactcaagtagcttcacttaatgtcgttactggtactaacgatggaaattacaacactcctactggcttgtactacatcatgtacaaacagactaatactacacttcgaggcaaaaacgccgacaacagtgcttatgcaagtcccgttagtcgttgggctccatttactttagatggatgtggattccacgatgctgattggcgtaaaaactggagtagtacagcttatctaactgatggatcacacggttgtgttaacgttcgacctgcacaaattagtcaaatttacgacaatgtcgaacaatatgaacctgttgttatttatagttaa

SEQ ID NO: 558 - DNA, 1110 bp, Lactobacillus salivarius
  isolated from gut, Lactobacillus salivarius
atgaagaagtttttaaaaaagcacgtattatttccaagttacgtaggactagccccttatttctggttactatggttatttccagcagtaagtgtgttacttacattgcccactattatgcgtaatataacgttaattttactaattatttttgtcaaagtttatagagattgttttttggccagagataaaggagtagttattaatattttttgtcagttaattttggcagctacactctctttctttgcaagatatccatttttatatatttatacgggcttcattattggaacttttagtattaatatgaaaaacgcaaaattagtgattgttccttattatgttttatctacgataagtttatatctagcttatccattacctagtatggcagtgggagatgtaccagcggctattatcaattatttattcatttttggaacaattccagcttcaaattcgttgtcaaagagctataggttaggaaaacaaaataatcgtttagaattaatagctagacatagtgaacgtgacagaatagctcaacaattacatgataatttggggcaatccttttccatgttagctctaaaagctgaattagctgagaagttattagagaaagatccagcattggctaaacaacaattaaaagacattgcagcggcttctcgtcaaaatttagacttggttagagaaattgtagcagatatgaaacactctacaatactacaaactttgggtatacaacaatctaatctggataaatctggtataatgctacatacaaaaaacgaagagattacagtagattggaataaggatattcaaaatacaataagtcaaattattactgagttggttactaatgctattcgttacagtcatgggaatctctttagtgttacttttagtcagaagaaaaatcaatatttaataactgtgcatgataatgggattggttttgataaaaatatatcttataaaaattcatttggtttatctgggataaaaaagagaattgattatctagatggtaatgttagttttgataatgataatggtgctaaaatagatataagtattcctattgtaaaggatgattga

SEQ ID NO: 559 - DNA, 993 bp, Lactobacillus salivarius
  isolated from gut, Lactobacillus salivarius
atggaatggaaaattggtgatatagttatccctaatcaagttgtagtagctcctatggctggggttacaaacgttgcctttcgtatgatttgtaaggaatttggtgcaggtttagttgtttgtgaaatgatttctgacaaaggaatccattttagaaataagaaaacattagatatgctatttgttgatccaactgagcatccagttagtgtccaaattttcggtggtagcaaagaaactttagttgaagctgctcaatttgtggcagaaaatactgcgactgatattatcgatataaacatgggttgcccagttcctaaagttacaaagactgatgctggtgcaagatggcttttagatccagataagatttatgaaatggttcatgcagttactagttctatagataagcctgtaacagttaagatgagaaccggttgggatgaagatcatattttagctgttgaaaatgcattagcagcagaagaaggtggagctaaagcattagcaatgcatggacgtactagaaagcaattatatacaggacatgcagattggggaattttaaaagaagtagctgatcatttaactaagattccatttatggggaatggtgatgttcgtacaccagaagaagctaagaagatgttggatgaagttggagcagatgcagtaatgattggtcgtgcagctttaggcaatccttggattgttaagcaaacaacacattaccttgaaacaggagaaattttggaagaacctacacctgcagaaaagattaaagttgctaaggaacatttacatcgtttagttaaagctaaaggtgaagttattgggccaaaggaattccgttctcaagctgcatattatttgaaaggaatcccacgttccgcacgtactaaagcggctttaaattctgcagatacagaagcagaaatgatcgatatttttgataatttcttagcagatacattagcacgtcaagctgtttag

SEQ ID NO: 560 - DNA, 1728 bp, Lactobacillus salivarius
  isolated from gut, Lactobacillus salivarius
atgagttggcaagatacttaccaagactggaaagaaaataaagaattagttgaagatttacgtgcagatttagtacgtatggaaggaaatcaagatgaacttgaagatgcattctatgcaccattagaatttggtacagctggtatgcgtggggttttaggtgcaggaattaatcgtatgaacatttatactgttcgtcaagctactgaaggtttagctcttttcatggaaactcttgatgaagaaacaagaaaacgtggtgtagctattagttacgattcacgtcaccattcacaagattttgcttttgaatctgctagagtattaggacaacatggtattccaacatttgtttttgaaagtttacgtccaacacctgaattatcattcacagtacgtcacttacatacttatgcagggattatgattactgcaagtcacaatccaaagcaatacaacggatataagatttatggtgaagatggggcacaaatgcctcctaaagaatcagatttgattactaaatatattcgtaaagtagatgatctatttgcaattaaagttgcagatcaagaagaactaatagaagatggtgttcttaaggtaattggtgacgaagttgataaagcatacttagatgaagtaaaacaagttactattaaccaagaactagttgctgaagaaggtaagacaatgaaacttatctttacaccacttcatggtacaggagctatgttaggtgaaaaagctttgcgtcaagcaggttttgaaaactttacaatggttccagaacaagctaagccagatcctgatttctcaacagttaagaagccaaatccagaagatacagcagcctttgatttagctattaaattaggtaaagaagaaggtgcagatttattagttgctgttgaccctgatgctgaccgtttgggagcagctgtgcgtcaaccagatggtgaatatcaattattaacaggtaaccaaattgcagcaattatgttaaactacattttaactgctagaaagaatgcaggtactttaccagctaatgcagcagcagttaaatcaattgtatcaagtgaatttgctacaaagattgctgaaagttttaacgtagacatgatcaatgttttaactggattcaaatttattgctgaacaaattaagcattttgaaggtacgaatgaacatacatttatgtttggatttgaagagagttatggatacttggttcgtccatttgttcgtgataaagatgctgtacaatcacttgtaatgttagcagaagtggctgctttctataagaaacaaggtaagaatctatacgatggtcttcaagaattatttgaaaagcatggttactttgttgaaaagacaacatcattaacttttgatggggttgaaggtgctaataagattaaagacttaatggctaaatttagagctgaagcaccaaaacaatttggtgattataaagttgttgcaatggaagattttgataaatctgaaaagagttatgctgacggaaaagtcgaagcaatgactctacctaagtctaatgtattgaaattcttattggaagacggtacatggattgctattcgtccttctggtacagaaccaaagatcaaattctacattggtactttaggcgataccttagaagcagcaacaaagaaacgtgcagtctttgaagaagaaattaacaattttgtaaatgaataa

SEQ ID NO: 561 - DNA, 888 bp, Lactobacillus salivarius
  isolated from gut, Lactobacillus salivarius
atggggaaagattcatcacaagaaatgcgaagaacacaagctgaaaaaatgttaaagcaacccaagaaacttcgtgctaagtggataagtcggttatttactttaatcatggtggctgctttaagtgtcgcaactatgggacttttgataaagactacggttttgaacgcagattttactagtaaggaattagctaaagatgaaaatattgggaaattatatactgaagccaatcaaacattagcatcatctgctcaaatgtaccgaattccagcaagttatgcggatagtttaattactaaaaagcaatttagacaagatgttgagattgcaattaaaagaatttatgacggacaagttacacaaattgtggatactaatactttaagcagtcaaattcaaacaaatgtgaataaagaaattgcaagctcaggagtacctgttgacgcgtctgtctttagtggagtagtggagtcactggcttctgtattaagcaattacatcagccaacaaattccaagtacacagttacaacaagtatatgatgcagccagcaatatcagtggttatgtgacattgatgataactgcaggaagtatcatcacagtggtaatgttgatcttagtattattattacagagaagtttatttggttggctgcactatacagggttagcatttttgattacagggataatcttttgcatcattggatatactagtgtgccagcagagatatttccaagtttaattaatcaatcaggaattttgggaagtattgttgaaaactatgcctacgcaattttaagtcagattgtgaatatgggaataattgaatctgtaattggtatagtggcattattagtaagtttctttagaaaggtttag

SEQ ID NO: 562 - DNA, 2802 bp, Lactobacillus salivarius
  isolated from gut, Lactobacillus salivarius
atggcaacctttattgtaggaaatactaagaaagtatttaattttggtacaagtaaagtttgggacttttctgaagcgtataggaatgcaagcgatggcgatgtaattcaattccaagcaggaactataataaatttaggacaaaatagatttacaattgagaaaaatctcagctttgttggtgatatgaaagatgacggaagtttaactacatctatcaatgggactatcttagttactaaaggatatcaagtttcgtttgaaaaaatgattttgaatgacaatattgatagaactgtagttactgttaatggtgcaaatgtcgttttaaatcaatgcattatgcgcaattttagtaatactaataaaaaagttttattgtatgctaacgataatgcacaagtgaaaattatgaactccatagtagatacatctgatcaaaaaagatgggatacaattaagacttatcaagcaaatttggtaattgaaaatacaacacttgataaagttgcgatttgggtatccgaaaatagtaattgtaaattaactagggttgaaagtagtagaattcgcagtacaaatgcagtatatgcaattagatctaatgtagagattgaagactcaaaaataattaacgatggtatagacggagaaaataagtacccaactgtctttttaaatcaatctagtttaaaatcacgtaattcaactttaggtaatcaagatgaggtagaaagtgttcatttagaaaaacattctgtatttgaatcaaataatgattacatatataaactagcagcatatagcagtcaagtatttttaagtaatgcgacaatacagttgattttattgttgaccaatcgttcttcaggttatgcaaatagtgtacattttaatgaacattcagaaagtataattaacattctaagtacagatgaatctgtgttatacataaaaaatgcagtatttgaggagataattgatcctaatgtcagagtagacaatgaagcttttgctgctattgataaaattgattttgtaaatggtaatccagatgatattttgatggaagctaaaaacggcggtaagttagtttatgatggacaacgtgatcaaaaatcaacatcagaaaatgaagaatcagtaggagatacagataataagactcaaagtgaagattcaaatgtagcattggaaaaattaaatagcttgattggcttagataaggttaagaaacaagttaaagagtttattaacttgaacattatcaaccaaaagcgtaaagaacaaggacttcaagtagttaatactagcatgcattcattgtttttaggtaatccaggtacaggtaaaacaaccgtagcacgaattataggagatgttctttatcaaaaacaagtaatcagtcgaccagatgtgattgaagtttcacgtgcagatttagtagctgaatatgttggccagactgcatcaaaaactagagaagtattaaaatcggctttaggtggaattctctttatagatgaagcatatactttaagcaatggtggagagaatgattttgggcgtgaagctattgatgaaattttgaaatttatggaggataatcgcgatgatattatgattatttttgcaggttatccaaaagaaatgaaaaagttcctcaagatgaattcaggtttgaagagccgtattccaaacgtgtttgattttgaagattatactgctgatgaaattgtaagaattggtttatttgacctgaagaaacgaaattacactgttaatgaattgtattacgaaaaggaacttaaagattactatgacaaagaaaatgatcatagtaatgggcgttggatccgcaatgtcaacgaaaaaattatgaaagctcaggcattgcgcttggcagagagcgataatataagcgtagatttacttcaagaaataacgcaagatgacattaaccaagttgtaaataaagatttagaaataaattcagccgacgacgcttatgctaagcttaactcattgataggtctagaaaaagttaaacaacaagtttctaaatttattaatatgagtgttattaataataagcgtaaagagcaagggttagcaacttctgcggtaagtttacattcgctatttttaggtaatccaggtacaggtaagacaacagttgctcgaattatgggacaaattttgttccaaaagggagttatccgtaaacccgaattagttgaagtttccagaacagatttggtagcagaatacgttggtcaaacagcccctaagactagagatgtgttagaatctgccttaggaggagtcttatttatagacgaagcatacactttaagctcaggtggaggtaatgattttggacgtgaagctattgatgaaattctgaaattcatggaagatcatcgcgacgacatcgtaattatctttgcaggttacaccaaagaaatggatcaattccttaagatgaactcaggtttgaagagtcgtattccaaatgtttttgactttgaagattatactgctgatgaagttgtgcaaattggcttatttgatctatcaaagagacaatacattttagaaaatgaagacacatattcagaagtagtaaaagatagttacgaaagtactaatgatcatagcaatgggcgttggatccgcaatgttaacgaaaaattgattgcaatccaggctgaaagattagcaagtagtccaaatgatatgaatgatatagatatgctgaaaacaattactgaagaggatttacttaagtttaaaggatag

SEQ ID NO: 563 - DNA, 864 bp, Lactobacillus salivarius
  isolated from gut, Lactobacillus salivarius
atggatattttaggaggtattagtttgaaaacaagacgaagcgacagattaattgatatgacgcgttattttatggaacgaccacatacactagtgtcattaactttttttgccgaacgttatgaatctgccaaatcatcaatcagtgaagacttggctattataaaacgtactgttaagttaagaggtataggaattttagaaacaataccaggtgctacagggggagctatttttatcccatctattgatgaagatgaagcacgtgcatttatcgaagatatgactgaacaactttcacatcaagatagattattacctgggggatatgtgtatttatctgacttacttggtagaccagatgttttgagatacgttggtcgtgtgattgcacgtcaatatatagataagcaaattgatgcagtaatgacagtagctactaaaggtgttccaattgcacaaagtgtagcttcatatttaaatgttccattcgtaattgtgcgtcgtgattctaagattactgaaggttctacagtatcagtaaattatgtatctgggtctagtgaacgcattgaaaaaatggaattatccaagcgcagtttgaaacgtggttctcatgtattagtagtggatgatttcatgaagggtggcggtactgttaacggtatgaagtccatgattgaagaatttgagtctgaacttgtgggaattactgtttttgcagaaggtgcatttgatggtcgtcgaatggttgaagattacacatcattattaaaagttgatagtgttaatacaattgataaaactattcacgtaagcccaggaaattatttagaaaaagtctttggcaaaaaagaagattag

SEQ ID NO: 564 - DNA, 660 bp, Lactobacillus salivarius
  isolated from gut, Lactobacillus salivarius
atggcaatgaatttaatgttgatggggttaccaggagctggtaaaggaacacaagctgaaagaatcgttgatgaatataagattccacatatttctactggtgatattttccgcgctgctatgaagaatgaaactccaatgggattagaagctaagaaatatatcaacaaaggtgaattagttccagatgaagtaacaaacggaattgtaaaagaacgtttgacacaagatgatactaatgtaggtttcttattagatggattcccaagaaatatggctcaagcagaagcattaactgaaatgggaaaagaattaggaaaagaattaaacggtgttatcaatattcatgttgatcctgaatcattaatggaaagattaacaggtagatatatttgccgtaattgtggtgctacatatcataaagtatttaatccaactaaagtagaaggtacatgtgatcgttgtggtgaacacgaattttaccaacgtgatgatgacaagccagaaacagttaagaatcgtttagatgtaaatatcaagatgaatacaccattacttgattactataaagaaaatggtttattacatgaagttgatggcaatcaagatattgacaaagtatttgctgatattaaggcaattttagataacttgaaataa

SEQ ID NO: 565 - DNA, 1434 bp, Lactobacillus salivarius
  isolated from gut, Lactobacillus salivarius
gtgaaagtaattcgctggctttttatgtataatcgagcgtttggggtgattattgtgagtgaaacaatagaaaattatatttattgccgtgttatttttgaagaaaatggaaaaagctattactatctaacagatgatgaagaaataaagcctttagatttagtagttgtgccggttggtattgatgggcatgaaaaaatagcacaggtgataaaagtagaaaaatatactatacacactgttccatatcctttagataaaataaaaaagattattcgtaaatgtaaattaacagattttagaaaattagaaaataaattagctgaagataagttaaagcgtgaatcaatagatgatgaagagttatcaattgatttattgaacttaggagtacaagcttatcgtcgaggagattatgaaatagctaaagaatattatgaggatgcggcacaactaggaaatagtcaggcagcctgtaatttaggttatatttatgcttatggaagaactggtgtaaaagatagtgaaagagcattttattattttgtccaagcatcattagatgggaatagtaatggtagttataaagtaggcgatgcatatttttatggtgattttgtagaaaaaaataaattactagcatttaaatattatcaaatatcagaagaacaattagggccagaagatcttgatattcgttcggatatttattatagattggcactctgttaccaccaaggcgcaggggttgttcctgatgatatgggtgccttaacttatattaatttggctcaaacaagtgcttattatgataggttaattggaaagtataattatgaagagttaaaaagaaaaattgaaaatttgcgtgaaaaaattctattaaatttaaatcatgtagataataaaacaaagattagattattgaaagcagacataacaaaagttgataatgttgatgcaattgttaatgctgctaatactagtttattaggtggtggaggtgttgacggtgctattcatcgcgtagccgggccattattattaaaagaatgtcgccaactaaatggttgtgaagttggacaagctaaaattacatcaggatataatttacctgtggaatatgttattcataccgttgggcctatttggaaaggtggtaatgctgatgaatcccaactcctagccgcttgttatagaaatagtctacatttagcccaaaaatgcaatattagaaaaattgcatttccagctatttcaacaggaatttatggatatccagttgttgaggctactaaaattgcatttcaagttgttaaagaatatgtccaagataatcctggagactttgatttagtagaatttgttttgtttgatgatagtacttataatgtttatctgaaagaaacaggaagtaatttgatagaattgtaa

SEQ ID NO: 566 - DNA, 1293 bp, Lactobacillus salivarius
  isolated from gut, Lactobacillus salivarius
atgtcatcagtagtagtcgttggtagtcaatggggagacgaaggaaaaggtaagattacagactttcttagtcaaaatgctgaagttattgcacgttaccaaggtggtgataatgcaggacatacaattgcatttgacggaaaaacatataaattacgcttaatcccatcaggtattttttattctgataagattagtgttattggtaatggggtagttttaaatccaaaatctttagttacagaattaaagtaccttcatgataatggagtatcaacagacaatcttcgtatttcaaatcgtgctcatgttatcttgccatatcatatcgttttagatggcttacaagaagctgctaaaaaagataataagattggtacaacaaataaaggtattggaccagcttatatggataaagcagctcgtgtaggtattcgtgttgcagatttattagaaaaagatacttttgaagaaaaattacgtacaaaccttgaagaaaagaatcgtttatttgaaaaaatgtatggtcacgaaccattaaaattcgaagatatttttgaagaatactacgaatatggacaagaacttaaagattatgtgacagatacatctgttattttaaatgatgctttagactctggtaaacgtgttttatttgaaggagcacaaggtgtaatgttagatattgatcaaggtacatatccattcgttacatcttcaaatccagttgctggtggagttactatcggtagtggtgtaggaccagctaagattgataaagttgttggtgcatgtaaggcatacacttctcgtgtaggtgatggcccattcccaacagaattacatgatgaaattggtgatcatatccgtgaagtaggtcatgaatacggtacagttactaaacgtcctcgtcgtataggttggtttgacagtgtcgttatgcgtcactcaaaacgtgtttcaggtttaactaatctatgcttaaactgtgttgatgtattaacaggtcttgatgaaattaagatttgtacagcatacgaattaaatggtgaaaaaatttatcattatccagcaagcttgaaggaattatctgcatgcaaacctgtatacgaaacattaccaggttggaaagaagatattactaactgcaagacattagaagatttacctgaaaatgctcgtaactatattcacagaattcaagatttagtaggtgtaaaggtatctacattctctgtaggtccagatcgtgaacaaacaaatgtcttagataacgtatgggcacatatttaa

SEQ ID NO: 567 - DNA, 1377 bp, Lactobacillus salivarius
  isolated from gut, Lactobacillus salivarius
atgacggataatttaccaccacaaaatatagaagctgaacaagcggtcttaggtgctatcttcttgaatacagatgctttagcagatgcgatggaatatgtggaagctgatgatttttatcgaagagcacatcaaattttattccaagcaatgctagatttgaacaatgatggtgaagcaatcgatgtattgacagtacaaaactatctgactactaataatcaattagatgatgttggtggagttgcttatattgcagaattagcaacatcagtgccaacggcagctaatgctggatattatgctaaaatcgttgaagaaaagtctatgttgcgtcgcttaatttctactgcaacaaatattataacgcaagcaaataacggcgatgatgacgtaccatctctattagattcagctgaacgtcaaataatggacgtttcagagcgaagaaatcgtagtgggtttagagagattaaggatgttttaaatgagacattgagtgatattgatagattatcacagcaaagtgaagatattacaggtttaccaactggatatagagaatttgataagatgacagcaggtttacagccagataatttgattattttggctgctcgtcctgctgtaggtaaaacagctttcgccttgaatattgctcaaaatgttgcaacgtctacggatacaagtgttgctattttttctcttgaaatgagtgctgagtctttagtaaatcgaatgttgtgtgcagagggttcaataaatgctaaccatttacgtacagggcaattagatgaaggagaatggcaaaatttaatcgttgcaatgggagctttatcaaatacctcaatctttattgatgacactccaggtattaaaatggctgaaatcagagcaaaatgtcgtcgactagcaaaagaaaagggtaatttagggttggtagttattgattatctacaattaattgaaggtagtaataaagaaagtcgccaacaagaagtatctgaaatttcacgacaattaaagaaattggctaaagaattaggcgtgccaattctagccttatcccaactttcacgtggagtagagcaaagacaagacaaacgtccagttctatctgatattcgagaatctggttctatagagcaggatgcggatatagttgctttcttatatcgtgatgattactatgaacgtggtgaatcaaaatcagaggaagatggcgatgatcaagattcattaaatcaagatgtcggtgaagttgaattaattattgaaaagaaccgtgctggagctagaggaacggttaaattattgtttattaagtcctacaataaattttcaaatatttcatatgctcaagagccaccgatgtag

SEQ ID NO: 568 - DNA, 642 bp, Lactobacillus salivarius
  isolated from gut, Lactobacillus salivarius
atggctaagatatttgtagttggtggctccggtagagtagcatcagaactaattaagaatttaattaatgatggtaatcaagtatttgcaagttcacgtcatcctgagaaaattattaagttagataatgttgttccagttaagttggatttgcatagtgatgttagtgcttggtctgaagtttttaaaggcatggatgttatttactttgtagctggatctagaggtaaagatttgctacaaacggatgcaatgggagctgtcaaaacgatgcaagcagctgagaacgttggtgttaaaagatatataatgttgagttctttgtatgctttacagcctgaaaaatggtcacaatatgaatcattggcagcgttgactgattataatatcgcaaaattctttgcaggtaattatttagtcaatgataccaaattggactatacagttgttcagccagcatcactaactgaagaaacaggtactggaagagtatcttttaatgaaataataagtaatactaatccaattccagatgttgctaaagtattggcagaggtaatcaaacataacaatacgattggcaaagttattatgatgtgtagtggggataacccaattgaaacagcattaaaagacatttag

SEQ ID NO: 569 - DNA, 450 bp, Lactobacillus salivarius
  isolated from gut, Lactobacillus salivarius
atgagtaatttaaataatttatatcgacaagcaattttagaagaagctaaccatccacgacataaaggtaaattagaaaataaaagtgttgaagttgaattgagaaatccaacttgtggcgatgttattaccttaactgcattaattgaggataataagataaaagatattgcttttgatggctatggttgcacaatttctcaatcatccgcaagtattatgacaaatgaagtattaaataaagacttcgatacaataaaaaacatggtattgtcattttccgatatgattacaaaagaagtaaaacccgatagaaaagttttaggtgaggcaataattttagaaggggttaaacaattcccagctcgaattaaatgcgcaatgttatcatggaaggcaatttatcaacttattgagaagtatgaaggaaagggtgaaaagaatgattag

SEQ ID NO: 570 - DNA, 834 bp, Lactobacillus salivarius
  isolated from gut, Lactobacillus salivarius
atggcaaaaaaatataatagtagtttgataaaaaaatgtgaaagggggaagattttgatgcaatacacgggagaaactattgattctgccataagtaaaggattgcaagatttgagtgtagatagagaaaatgtagagattgaagtcatctctcatggtcgcaaaggattcctggggttaggaaaaaaaccagcagttatagaattgactgtaaactcaagtgtgcaaactgaaagtgatactaaacctcaattagagattgtatctgaggatcaagtagatagagaatcagaaactttagataacgaggatagtaaaaacattgaaataaatagtgagaaagtagaagaagaaaatcaaaataatttagatgaggttattcaaaatttaggttactatctagctgatataactaagcagctgggaatagagactgttatagatgttagccaaggaaaaagggtagtttactataattttgatactgaactagaaggtttattaataggaaaacatggtagaacgttaaattccttacaactactagcacaagattacttcgataagcataaaaataataatcgaagaattcgcattatgttgaatgtagctgattatcgtgaacgaagagaagaaaccttgaataatttagctcagaaaaaagcgcatgaagctataatttctagaagtcaaattagtttagagccaatgccagcgtttgaaagaaaagttattcattcatccttagctaaagatgagcatgttaagactttttcgcgaggttcagagccttatcgttatgtaattattgcaccagcgaaagctaaatattaa

SEQ ID NO: 571 - DNA, 1449 bp, Lactobacillus salivarius
  isolated from gut, Lactobacillus salivarius
gtggccattgtggcatttgaaggtttaacagaacgtttacaaaacgcaattggaaaacttagacgaaaaggtaaaattagtgaatctgatgtcaaggaagttatgcgagaaattcgtttagctttacttgaagccgatgtaaattttaaagttgttaaagattttgtaaagaccgttagaagtagagctattggagcagaagtattagaaagtcttacacccgcacaacaaattgtaaagattgttaatgaagaattagtgaaagttatgggtgaggaagccgctcccctaaataaatcagctaaaattccaacaattattatgatggtaggtttacagggtgctggtaagacaactacagcttcaaagttagcaaacaagttaaaaaaagaaaaaaatgcacgaccttttatgattgcagctgacgtatatagacctgctgctattgaccaattaaaaatattaggaaaagatattgatgttcctgtattttcattaggtgttgatgttgatccagtagagattgtacgacaaggtcttgaagaagctaaagacaagaaaaatgattacgttattatcgataccgctggtcgtttacaaattgatgaaaagttaatgcaggagttatctagtattaaagaattagcacagccagatgaaattctattaacagttgatgcgatgactggtcagaatgcggttgaagttgctaaaggttttaatgatcaacttgatgtaacaggggttgttctaactaagctagatggtgatactcgtggtggggctgcactttcaataagagctgttactggaaaaccaattaaatttattggtcagggtgaaaaaatgacggatttagatgtattttatcctgacagaatggcttctcgtattcttggaatgggtgatatgcttaccttaattgagaaggcacagcaagaatatgatcaaaaacaagcagaagaacttgcagaaaagatgagagagaacaattttgattttaatgatttcttgattcagatggaacaagttcaaaatatgggaccgatggaagatattataaagatgattccaggaatggctaacaatcctgcactgaagaatttgaaagtagatcctaaggacattgaacacactaaagcgatagtatactcaatgacaccacaagaaagagaaaatccagatttattgaatcctagtcgtcgtcgccgtatagctgctggatctggtagaccaatccaggaagttaatcgcatgataaagcagtttaagcaaatgcaagatatgatgaaaaagatgtcaaatggtaacttctcaggtatggaaggccttttaggtggaggtatgcaaggtaagttggctaagatgtcaatgaatagaatgattagaaaaaataagaaattaaagcaaaagaagctgaaaaaactacttaaaagaaaaggaaaataa

SEQ ID NO: 572 - DNA, 747 bp, Lactobacillus salivarius
  isolated from gut, Lactobacillus salivarius
atggctgaagaaaaaacagttcgtgaaaagaatcaagaagctgccaagaaacaagctgaagcagtttctcaacaaaagaataaacaaatcatggaattcaatgaaaaatttgaaggtttaacaaagcgtaatcaagactacatgttccatttaaataaggcgttagctgaaaagaattatgcagaacgtgaaaaagttgttagtgaaatgtacaatgaattgatggaaaaacaaaagcaaggcgttgtagctaacaagttatatggaacagttaatgaaaaggttgaagcaattcttgctggtcctaagaaagaacctaagatgcctactttatgggaattatcacttgataatggattgatgatgttagctttattctgcatcatgtacgctttcttaggtatgttctctaagagcaatcaaaatgcagcaaatggtggaataatcacattgattgttacatctattgttgctggtgttggtttaggttatttctaccgtgcgatgatgccaggccaaagtaaacgtcgtggttggttaaacattatctttatgatcgcaatcttaatggtagtatgggtagctgcattcggtattgttgcaattatcccaccaacaattaacgttgttcttccaccactagcttatgcagtacttgcagttgttgcctatggtattcgttggtacctaaagaagaagttgaactttattagtccagcagattttagaagaaatagtcaaaattaa

SEQ ID NO: 573 - DNA, 783 bp, Lactobacillus salivarius
  isolated from gut, Lactobacillus salivarius
atgttggatttttttaataaaaaagaaaatatagacgaaaaaaggaataaattaaaaagagaactaattcctaatcatatagctattatcatggatggaaatggacgttgggctaagaaaagacacttaccgcgaatagcaggacataaacaaggaatggaaactgtaaaaaatataactaaggtagcgagtaatctaggtgttaaagtcctaacgttatatgctttttctacagaaaattggaaacgtcctgataaagaagtggattttcttatggatttaccggtcaagtttttcaatacttttgttcctgaattaattgaaaataatgtaagagtaaatgttatgggttatatagatatgctacctaaaaaaactcaaaaagctgtttatgatgcaattgaacaaacttcaaattgtacaggaatgatcttaaactttgcgttaaattatggtggtcgtgctgaattagtatctgctattcaaagcattgctagtgaagtaagtgaaaataaattagagatagaaaagataactgaaaaagtagtagatgctaatttaatgactggaaagcttgctccatacaatgatcctgatttgttaattaggacgagtggagaagaaagaatatcaaatttcctattatggcaattggcatacagtgaatttgtatttactgatacattatggccggattattcagaagaagatttattggctaatatttatacttttcaaacaagagatagaagatttggcggattaaaagaggagaaaaaataa

SEQ ID NO: 574 - DNA, 1302 bp, Lactobacillus salivarius
  isolated from gut, Lactobacillus salivarius
gtgaagacgattagtattattgatgctaaacaccatgttaacgaaaaagtaaaaataggtgtatggcttactaataaacgttccagtgggaagattgcttttttacaattacgtgatggatcagcatatttccaaggagtagttgtgaaaaatgctgttagtgaggaaacatttgtacttgctaaggaagtaaaacaagaaactagtttgtatgttacaggtgtcattcatgaagataaacgttcacatttcggatatgagattgaaattgaagaaatagaagttgttggtgaaagtaatgaatatcctattacaccaaaagaacatggtacagactttttgatggaccatcgccatttatggctacgttctaagaaacaatttgctattatgcaaattcgtaatgaaatgattcgtgcaacttatgaattcttcaacaaagaaggtttcattaaattagatgcacctattttgactggtagtgcaccagagggaacaactgaattgttccatacagaatattttgacagagatgcatatctatcacaatctggacagttatatgaagaagctggagcaatggcttatggaaaagtattttcatttggtcctactttccgtgctgaaaaatctaagacacgtcgccatttgattgaattttggatgattgaaccagaaatggcattcatgcatcaagaagaaagtctagaaattcaagaacgttatgttgcatatttagtacaaagtgttttagacaactgtcaatatcctctacaaattttaggtagagatacggaagttcttaagagatatacggaattaccatatccacgtatttcttatgatgaagcaattgaattattgcaacaatctggtaaattcccagatgtaaaatggggagaagattttggttctcctgaagaaacatatttagctgaacattttagcaaaccagtttttgttatgaattatccaaaagctattaagccattttacatgaaaccacatccaactcgtgatgatgtagtaatttgtgctgatatgttagcacctgaaggatacggtgaaatcattggtggatctgaacgtgctacagatccaaaatatttggaagaacaaattattaaagctggtctagatgtaaaggattatgaatggtatttagacttgcgtagatatggtagtgttccacattctggttttggtttaggattagaacgtgctgtaacttggattacaggcgaagatcatattcgtgaagcaattccattcccaagattattgaatagaatttacccataa

SEQ ID NO: 575 - DNA, 837 bp, Lactobacillus salivarius
  isolated from gut, Lactobacillus salivarius
atgagtaagaaaaatcctattactataagttcttggacattgggagataagtgtatatttgaacaacgctgtaaagctgctgctgaagctggctatgatggcatcggtttaagagctgaaacatatgtagatgctttaaatgaagggcttacagataaagatattatagatattttaaataaatacaatatcacttgtacagaagtagaatacatcgttcaatggtgcgaagaacctcgctcatatgaacaaaagtataaggaacaaatgtgcttccatatgtgtgaactatttggtgtaaagcatattaatacaggtttaatggaagattatcctgtagactatactgcacaaaaacttagagagttatgtgatagagctggagatttaatcattgcccttgaaccaatgccatatagtggcttaccaaacttagataagacatggaaagtattgcaaaaagctgattgtgataacgcaatgatgctattggatacatggcactgggttcgtgctaaccaaccttatgatttattgacaaaagaacaagctaagaaagttatttctatccaaattgatgatgcttatgaaagaccatatgcagattcaatcttgagagacgaatcaatgcatgatcgtttagctccaggtgtgggacaagctgacacagtagcatttttaaagatgatcaaggaagcaggtatcgatccaaaagttgttggggttgaagttatttctgataactatatgtccaaaggtattgattgggtagctgattatacttataagaatacagaaaaagttttgaaagaagcttggccagaaattttagactaa

SEQ ID NO: 576 - DNA, 1143 bp, Lactobacillus salivarius
  isolated from gut, Lactobacillus salivarius
gtgaaaggaatggttgcttggcaagctgcctggtattatgaaaatattgatttttcggcgatgccatttaagatgagagaattatcgcaattaataaaaattacgtcttttttatcaggtaaagaattacgactaaaattaaccaattactatggcaaagaagaactcatttttgatgaaatttatgtagctctaacagctgatatgaaagaaaagcaaagagtaacagctttgtatcaagatacgattgtaattccacaaggagaagcaatttggacagattcaatagacttagatattaaagttggacaaacaatctatgtctatatgaagtcttcgcaggaacaagaatactgtgattttaagtgtacttatgaaacatcattaaccaatgcctcttttgctcgtagtgctaatttcttacctaaattaagtgatacttggcaaagtaggaaaggttggttttgtttagaagaagtagacgtatggacgaaagcaaatcctaaatatttagaaattacaggtgattctctaatggaaatgggaatgataacggctcccctaatgcaatatttgatgaccgtacatcctgacgaagtaacagtgctaaataccgctatttctggaagtcgcttaattcatgatgcccctcatgatcaacccatttatgaaacttttggagagagtttattaagtagaatggttagaaacaggagtggctttaaacctgaattgacgattgtttcaattggggcaaatgatttgatgctaccattgatcagtgaagtagctgcaagacaaaaaataactaaggataatttttttaatgctgtccagaggctaaatgaaattttagaaaagcgcaatagtgaattaattttgctagatataccaccatttacgcttagtcacactggtcggccagatgataaagagctacaagcacaaaaatttagaaaagaattaaatagcaaacttgctacaattcctgagacagtgcccacatcacttcttttagaaatgctaccatgtggcgtacaaagtgcatatgattttggtgaccatatgcatatcaatcaggctggtggtagggttgtagcaactaaattaattcctaaaatagaacaagaactatttcattaa

SEQ ID NO: 577 - DNA, 1311 bp, Lactobacillus salivarius
  isolated from gut, Lactobacillus salivarius
atggcaaatccagtagtagcaattgttggtagacctaacgttgggaaatcaacaatttttaatcgattagccggggaaagaatttctattgttgaagatacacctggtgttacaagagatagaatttatgctcgcactgaatggttgggacatcctttcaacttaattgatacaggtggtatcgatattggtgatgaaccatttttaactcaaattactgagcaagcagaaatcgcaatcgaagaagctgatgtaattatctttgtagttagtgttaaagaaggagttacagatgcagacgaaaaggttgcaaggattttatatcgtaccgataaaccagtagttctagccgttaataaggtagataatcctgaattaagagctgatatctacgatttttactcacttggttttggtgaaccaattccagttgctggtgctcacggtattggtactggtgatttacttgataaaattattaaagaatttcctaaagatgcaactaacgaagaagatgattccattaaatttagttttattggacgtccaaatgttggtaaatcttcattagttaatgccattttaggtgaaaatcgagttattgtttcaaacattgaaggtacaactcgagatgcaattgacactcgctttgaaactgaagatggtacaaagtatactatgattgatacagctggtattcgaaagaaaggtaaagtttacgaaaatactgaaaaatattcagttttacgtgctatgcgtgctattgatagatctgatgtggtatgtgtggtattaaatgctgaagaaggtattcgtgaacaagataaacacgtagctggatatgctcatgaagctggacgagcaattgttattgttgttaataaatgggatactttgaagaaagacaacaaaacaatgtctgactttgaaaatcttattagacaagaattccaatacctaagttatgctccaattgtttttgtatctgctaaaacaaagcaacgacttgataaacttcctgagttaattaagcgtgtaaatgataatcatgaacaacgtatctcatctgctgtcctaaatgatgttgtaatggatgcaattgcacataatccaacaccaacagataatggtaagagattaagaatttactatgcaactcaagtagcaattaagccacctacatttgtaattttcgtaaatgatccagaattaatgcatttttcatatgaacgattcttagaaaatcaaattcgtgaagcttttgactttgaaggtactccaattcatatcattgaacgcagaagaaaataa

SEQ ID NO: 578 - DNA, 1263 bp, Lactobacillus salivarius
  isolated from gut, Lactobacillus salivarius
atgagtaaatggtcagaagatttacctaaagatttacaaaataaaatagagatagtggatgagaaaatatcttcaaaattagaggatataacagaaatagtattaaataatcagcgaagagtattagaattatttaggaagcatcatgtagctgaggaagacttagttggttcaacaggatatggttatgatgatataggtagagataaacttgatgctatgtttgctgattattttaaaactgaagatgctatggttagaccgcaattgacatctggtacccatgccatttcaactgcattttttggagtgttgcgtccacatgatacattgcattatttaacaggaatgccatatgatactattcaagaagttataggtgtagctggagataatccaggaactttggaagaacatctaattaatttttcttacacaccacttttagataatgggaaagtagattataaaagagcaaaggaagatttacaaaaagattcttcgataaaaatggtagctatacaacgttcgcgaggttattcttcaagagatagtttcgttgtttctgaaatagctgagatgataaaatttgtaaaaaaatatgcccctcaagcgataatttttattgataattgttatggagaatttacagagactgaagaaccaacattttatggagctgatttgatggctggctctctatacaaaaatgctggcggtggaattgcaaaaacaggtgcatttttagttgggaataaagatcttattgatagatgcggtgcaaggctcattgttccaggagcaggaaagaatgaaggtgccacgtatccatttatgagagatttttacgaaggtttcttcttggctcctaatgtgacaggagaggcaattaaaggatcgatttatgcagcagcattactagaagaaatgggaatggatgtatcacctagctgggatgcgcctaggacagatttggttcaaacggttaattttggtaatcctgatgcaatggtcaaattttgtgcagcaatacaacataattctcctatgaatgcatatgttgaaccagttccaagttatatggatggatatgaagataaaattattatggcatctggaagttttacagaagggtccacaatagaattatcaagtgatggtcctttaagagaaccatatacattatatattcaaggtggattaacttatgcacatgtaaaaattgctataactaaagcggtgctagaaacattttacaaataa

SEQ ID NO: 579 - DNA, 2427 bp, Lactobacillus salivarius
  isolated from gut, Lactobacillus salivarius
atgccgactgaaagaaaaattcaagaattatcactagaagctgttatgggagagcgttttggtagatattctaaatatattattcaggaacgtgctttacctgatattcgtgacggactaaaacctgttcaaagacgtattttatttgcaatgaacgaagacggaaatacctatgataaagcatttagaaaatctgctaagtctgtaggtaatgttatgggtaatttccaccctcatggtgatacctctatttatgaagctatggttcgtttgagtcaaagttggaaattacgtgaaccgttaattgaaatgcacgggaataacggttctatggacggagattctccagctgctatgcgttatacagaagctagattatctcaaattgcttctgaaatgttgcaagatattgataaaaagactgttgatatggtacttaattttgatgatacagagtatgaaccaaccgtcttgccagcacgtttccctaatttattagtaaatggggctacaggaatttctgctggttacgcaactgaaattcctcctcataatttgagcgaaacaattgaagctgcaatttatttgataaatcatcctaatgctagtttagacgatttgatgcaatttattaaaggaccggatttcccaaccggcggtattttgcaagggatagatggaattaagaaagcttatgaaacaggacgtggtagagcagttttacgttcaaaaactaagattgaagatatcagaggtaataagcaacaaattattgttactgaaattccatatgaagttaataaatcagctttagtcaaacgaattgatgaattgagaatattgaaaaaagtagaaggcatttctgaagtaagggacgaaagtgatagagaaggtcttcgagtagtaattgagttaaagaaaaatgccaatgcacaaggtattctaaactatctatttaagaatacagatttacaagtttcctataactttaatatggtagcaatcaataataagcgacctgaacatgtaggactaaaaacaattttagaagcttatttagaacatcaacgtgaagtaacaactagaagaacaaaattcgatttggaaaaagctaaagctagagaacatatagttaaaggattaattaaggctttatctattctagatgatgttattaaaacaattcgtgcatctaagaataagtctgatgctaaaaagaatttggtatctgaattttcatttactgaagctcaagcagaagcaattgtttctttgcaattatacagattaacaaatactgatgttactgcacttcaaaaagaagcagaagaattgcaaaaagctattgctaattttgagaatatccttgctaatccaaaagaacttgataaagtaattcgtaaggaattaaatgctattaataaaaaatatggttcagaacgcttaactgttattcaagatgaaatttcatcattaaagatcgaaactgaagtaatggttgctcaagaagatgtaatgctacttgtttctcatgatggttatgttaaacgttcatcgcttcgatcattcaatgcatctgataatgatgagaacggtttgaaggatgaagactatccaattttacaaagtgttgttaatactttatcacatctgtttattttcactaataaaggtaacctaatttatcgtcctattcatgaagttatagaatctcgttggaaagatacaggagaacatttatctcaaactgtaggtctaggaaatgatgagtatgttttaaatgcttttgtttttgaaagtatagatcaagatgcaaagttcttaatagctacaaaagagggctatataaaacaagtaaaattggctgatttaaaaccaggacgaacatataagacacgtgctagtcgatatgttaaattaaagactgatgatgatgaagtgatttcagtatctcaagttgaatctgatgaatctcaagtcttttgtgcatcatatacaggatatggattgagatatagtctagatgaagtccctactaatggagctttagctgctggtgtaaaatgtatggatttaagagatgatacattagcaaatgtcattttagtatctgaaagtgacgaagtttctatcttaactcaacgcggtagttataaaaagatgaaagtagctgacgtaccattgactacaagagcaagacgtggtgttcaaattttaagagaattaaagactaagccacatcgtataatttttgctgaattagttcaaacaaatcaagagttagtattattattgtcagatggtaagcaagaaattgtaaaacctgaagatcaccaagtaaatgatagatattccaatggatcatttgtagttgatgctgaaactgatacaattgaaaatatctatactaaaattattaaagattaa

SEQ ID NO: 580 - DNA, 732 bp, Lactobacillus salivarius
  isolated from gut, Lactobacillus salivarius
atggaattaaaagaaaaagtagttctagtcactggaagttcaagaggaattggtgcagaaatagcattagcttttgctagaaaaggaagtactgtagttttaaatggacgccatcaaatacctaatgatatgattagtaagatggaagaaattggttgtaactatgatgttattcttggtgatatcagtatagaaagtgatgttaaaagaattgttaaagaagccatcgaaaaatttggtagaatagatatactaattaacaatgccggaataactaatgataagttactaattggaatgaaacctgcagattttaaatctataattgctgttaacctaattggaactttccaaatgacacaagctgttgtaaagaaaatgtataagcaacgatcaggagtaattataaaccttgctagtgtgattggacagcatggaaatattggtcaagctaactatgcagcaagtaaagccggagttatcggattaactaaaagtgtggcaaaagaaggagctatgcgaaatattagagttaatgcgattgctccaggaatgatagttagtgatatgacagatgttttaagcgataaagttagagaaaacattctcactaccatccctttaaatcgttttggaaaagcagaagaagttgcacaaactgcagtctttttagctgaaaatgattatataacaggacaggtaattactgttgatggtggaatgacaatttaa

SEQ ID NO: 581 - DNA, 1278 bp, Lactobacillus salivarius
  isolated from gut, Lactobacillus salivarius
atgattatcacaataattgcatttattattgtttttggagtcctcgtttttgtacatgaatttggacattacttttttgcaaaaaaggcaggaattttagtaagagaattttccattggtatggggcctaaactatggttttatcgaaagaatagtactacatatacaatcagattattacctataggtggatatgtgcgtatggcaggcgccgaggaagatgatgttcctctgaaaaaaggaatgacagttagcctgttaataaatgatgaaaataaagtagtaaaaattaatacaagtaacaaaaaaactttaatttcaggtgttcctgttcaaatttctgattgggatttagaagataagttgtggatcgaaggatacgagaatggtaatgattcagaactaaaagtatatgaagtagatcatgatgcatgcataattgaaaatgatggaacagaagtgcaaattgcacctaaagatgtccaatttcagtcagctaaaattattcaaagaatgcttacaaactttgcaggccctatgaataattttattttagcaattgtagcttttctagtgatcgcacttgtgcaaggtggagtagcttctacagataatcaaataggaaaggtccaagaaaattcggttgcacagaaagcaggaataaagcctaatgaccgaataatagctgttgataatataaaaactactacttggcaagaagcttccgcccaaatccaaaaaaatgggaataaaaaaattattttaaaaattgatagaaaaaataaaattattaaaataaagataacacctaaagttcaaattgagaatggtaaaaaagttggaatgataggagttatggcaaaagtccattatgataaatcaattgttgcaattttgtcatatggatttactcaaacttggtatataataacaagtatcataggagttttaggtaaaatgtttacacagggattcagtttgaatgatttgggtggacctgtagcaatgtactcttatacgagtgaagctgctcattatggtatcttgagtattatgaatttaatggcagttttgtctataaatttaggtattgtaaatttattgccaatacctgcgttagatggtggaaaattgctattaaatgtagtagaagcaatcagaagaaagcctttggatccagaaaaagagggtataattactttggtaggatttggttttttaataattttaatgattttagtaacctggaatgatattcaaagatattttttacattag

SEQ ID NO: 582 - DNA, 918 bp, Lactobacillus salivarius
  isolated from gut, Lactobacillus salivarius
atgattgtaaaaagtgtctatgagttgataggacagacgcctttaatagagttagatgtgccagtagctaaaggaagtaggattttagctaagttagagtcttttaatcctggtggtagtgttaaggatagattgggaatatctttgattgaagcagcattaaagagaggcgatattgataaagatacgacaattatagaacccacagctggtaatactggaattggtttggctttagcaactcaaaagtatcatttaaagacaattttggtagtaccagagcatttctcagctgaaaaacaaactttaatgagagcgttgggtgctgaaattattaatactcctagagctgaaggcatgcagggagctttgagaaaaagtcgcgaattagctaatcagatcgctaatagttatatacctaatcaatttgaaaatagtgataatcctgatgcttatactagaggattgggacaagaaattatagatgacttacaagcaaataatttgaaattagatgcttttgtggcaggtgcaggaacagggggaacctttgctggaacggccgaaacattacaagcagagtatccagagttaacttcagtagtagttcaaccagagggatcaattttggataatcaacctgaacatcctcatcggacagaaggaattggcgttgagaaagttcccccttttttcaaaaaattaaaggttgatgaagttcaaaccatcagtgatgatgaagcttttaattatgttaaacaaatggcacaagatcaaggcttgtttattggctcttcatctggtgcagcattagcagcaagcatgcatatggcagaaaaattgccagcaaattcaactattgtgacaatttttccagattctagtgaaagatatttaagtgaaaatatatacgattaa

SEQ ID NO: 583 - DNA, 1950 bp, Lactobacillus salivarius
  isolated from gut, Lactobacillus salivarius
atgtctagtataaaaattacatttccagataattcagtaaaggaatttgatgctggtgtaacaacagctgaaattgctaaatcaattagtattagtttagctaaaaaagctgttgcaggaaaagttgatggtaattttgttgatttaaatcaaccattaaaagaagatggatctattgaaattattacaaaagattctaatgatggattagttgtattgtggagaacagcagcacaagttttagctaatgcattgcatgaattatacccaaatatgaaatttggtttgggtgatgttacagagcatggattctattttgatactgataattctgaaggtcaagttgcagaaacagattttgaaaagatttctcaaaaaatgtctgaaataataaaggcaaacttacctatagaacgagttgagttttcagaagaggaagctttgaatttagtatcaggtgacgaatatcaagaagaattagttagagatgtagctaataaaaataatggtagagtagttgcttataagcaaggtgatttcattgatatcactgatggagtagttttatcttcaactggtgaagtaaagatttttaaactattatctgttgctggtgcatactggaaaggtgcttcaagcaatccaatgttacaacgtatctatggtacagctttttataagcaaaaagatttggatgctgaattacaacgtcaaaaagaagctcgtgaaagagatcatcgtgtaattggaaatgaattagatttattctttgttgatcctaaagttggtgcaggattaccatattggatgccaaatggtgcaacaattcgtcgtgtaattgaacgatatataattgataaggaagttgcatggggattccaacatgtttacactccagtgctagcaaatttgaacttgtataagcaatctggtcattgggatcactatcgtgaagatatgtttccaccaatggatatgggcgatggtgaaatgttggaattacgtccgatgaactgcccatcccatattcaagtttacaatcatcacaagcgttcatatcgtgaattgccattacgtatcgctgaattaggtatgatgcatagatatgaaaaatctggagcattaacaggattgtctcgtgttcgtgaaatgactttgaatgatggtcatgactttattgaaccagatcatattgaagatgaaattaagactttaattaaattaatgacggaagtttataatgactttgatattacagattatcgtttccgcttaagttatagagatcctaagaatacagaaaaatactttgatgacgatgaaatgtgggaaaaatctcaaagtaagttaaaagctgctatggatgatatgggactagaatattttgaagctgaaggtgaagctgcattctatggtcctaagattgatgtccaaactaagacagctttaggtggagaagaaacattatcaactatccaattagacttcttattgccagaaagatttgatttgaagtacattggtgctgacggtgaagaacatagaccagttatggttcaccgtggaattgtttcaactatggaacgttttacagcttacttaactgaaatgtataaaggtgcatttccaacttggttagctccacatcaagtagatattattcctgttaagaatgatttacatatggattatgtaaatgatttaagcagtaagttgagagcacatggcattcgcgttactgttgatgatagaaatgaaaaaatgggatataagattcgccaagctcaagtaaacaagataccttatacacttgttattggtgatgaagaagtttcaaatggaacagtaacagttcgtaaatatggtgaagaaaagactaacactatgacaaaggatgaatttaagaatcttttgtttgaagatatagaaaattatagtagagaaaaataa

SEQ ID NO: 584 - DNA, 966 bp, Lactobacillus salivarius
  isolated from gut, Lactobacillus salivarius
atgaatgaaccaatgtttttaaaacctgtattccaagaaaaaatttggggaggaagccgcttaaagacagaatacaattatcctattccaagtgatcatactggtgaatgctgggctatctcagctcatccacatggcccagcaactgttgaaaatggtgaatttaaaggacaaacattagatgaagtatgggcaaatcatcgtgaagtctttggaaatgctgagggagatgtttttccattattgaccaagattttagatgctaaacaagatttatcagtacaagttcatcctgatgatgcttatgccgaagaacatgaaggtgaattaggcaaaactgaatgttggtatgttttagctgctgatgaaggtgctgaaatgatttatggtcaccatgctaaaactcgtgaagaattagctgagttaatagaaaatggacaatgggataaattgttaagaagagtaccagttaaaccaggtgactttttatacgtaccaagtggaacaattcacgctatcggaaaaggtatcatggtactggaaactcaacaaagtagtgatacaacttatcgtgtatatgatttcgatagggtagataagactactggtcaaaaacgtgaattgcatattcaacaatcaattgatgtaacaaatgtacctcatgttgatcctaaattagatattaaggaccaaaaagttggggatgcagatgtaagaacatttgtagaaacagatttctttagtgtttatcgttggcgcttagaaggtggagaagcaactttcactcgtaaggcagctccatatactttggtttctgtattaaaaggccaaggtcaaatcattgtgaatgataagagttatgaaattgaaaaaggcgtgcatttcatcttaccttatgatgttaaagaatggacaatcaaaggtaatttagaggttattgcttcagaaccaggtttaaaagcctag

SEQ ID NO: 585 - DNA, 891 bp, Lactobacillus salivarius
  isolated from gut, Lactobacillus salivarius
ttggaatggaacgagttaagtgtaaccacaactaatgaggcaattgacgcagtagttaacatattaatggaaaatggtgctggtggcgttcaaattgatgatagtgaaggcttagaaaaagtaaaggtaattacttattttcctagtaaattaggcttagttgaattaattccagaattagaagaaaagataaagaaattaaataactttggtctgaatccaggagaagctaaagtatcattgactaatttacaagatgatgcttgggtagatttatggaagaaatactatcatccggttagattgactaagtatctaacaattgtaccaagctgggaagaatatcaaaaagaacaagaagatgagattttaataagattagatccaggtagagcatttggaacaggtacacatcctactactcaactggctttgcaggcattggaaacatctgtacgaggtaatgagagtatgattgatgtaggaacaggatctggtgtcttaagcatagcagcaagacattttggtgttgataaggtatatgcttatgatattgatgataatgctgttacagctgctaaagaaaattttgcgctaaatccaattagtaataatatcgaagttaagcctaacaatttattagaaggtatacataagaatgtagatataatagtagctaatattctagcagaaattatagttccattaattcctcaagctaagtcaaatcttaaagatggtggtatcttcattacatctggtattataaatgataagaaagaattaatcttaacagaattagaacaaaatggttttgttgtagatgaaattttgaataaaaaagattggtactcaattattgcgcataaaccagctaaggaggacatttaa

SEQ ID NO: 586 - DNA, 1254 bp, Lactobacillus salivarius
  isolated from gut, Lactobacillus salivarius
atggattttaagaaattagaccctgaattatggcaagccattgcaaacgaagaacaacgtcaacaaaacaacatagagttaattgcttctgaaaatattgtttcaaagaacgttttagacgctcaaggaagtgtattgactaataaatatgctgaaggttatcctggacgccgttattatggcggatgccagtttattgatgttgtagaaaatttagcaatcgatcgtgcgaaacaactttttggtgctaaatatgtcaatgttcaacctcattcaggttctcaagcaaacgctgctgcttatatgagtttggtagagcctggcgataccatcatgggcatggacttagctgctggtggtcatttaactcatggttctccagttaactttagtggaaagacatataactttgttagttatggtgtcgataaaaaaactgaaatgctagactacgatgaaatagctagattagcacgtgaacatcagcctaaattaattgttgcaggagccagtgcttattctcgaattattgatttttctaaattcagagaaattgctgatgaagtaggggcaaaattgatggttgatatggctcatattgccggtttagttgcggttggtcttcatccaaatcctgttccttatgctgatattacaacaactactacacataagacactccgtggtccacgtggaggaatgattttaactaatgatgaaaatttagctaaaaaaataaacagcaatgttttcccaggaactcaaggagggccattagaacacgttatagccggtaaagcagctgcttttggtgaagctttaacacctgaattcaaagaatatggtgaacaaattatcagaaatactcaagaaatggcactatgctttgctgataatgaaaaagctcgtttagtatctaatggttcagataatcatcttttactattagatgttagaaactttggtttaaatggtaaagaagctgaaaaattacttgatcaagtaaatattacagttaataaaaattcaattcctttcgaaacacttagtccatttaaaacaagtggtattcgtatcggtacaccagcaattactagtcgtggctttaatgaggaagattcatatcaagttgctaaattaattcttacagttcttgcaaataaagatgatgaacaagttttagctgatgtaaaacgtcaagttaaagaattgacagatgcacatccaatttatgctgaagattcaattagataa

SEQ ID NO: 587 - DNA, 2145 bp, Lactobacillus salivarius
  isolated from gut, Lactobacillus salivarius
atgaagataaaagatttttttgaaaagataaaagatgactttttagccaattctagaatttttggttcttggtttaagaaaaaatggacaagatatcaagggtggcgatggttaacaatagtctttttaagtatatttttcttaattagtagctatggggtttttttagccaaaaagacaaatgttagagggttaaaatcagcattacaaacctctactgagatttatgattataaaggacaaaaagcaggagcattatattcacaaaaagggacatgggtacctcttgataagatatctgataatgttcaaaatgctgtcttatctacggaagatcgtaatttctatcatgagtatggtttttctattactggtattggaagagctactcttttatatgctaaaaacaagattttacacagagattatataagtggcggtggtagtacactaacgcaacaacttgtaaaaaatgcatttctttctcaagaacagacattttcaagaaaaattaaagaaatatttattgctatgcaagtagaaaatgattactcaaagaaagatattttagcaatgtatctaaataacgcttattttggaaatggtgtttggggagtagaggatgcagctgagaaatattttggtgtacatgctagtgaattaagtgtgccacaagcagctaccttagcaggtatgttaaagagtccaacagcttataatccaataaatcatccccaggcttcaagagatagaagaaatgtagttttgggattgatggaggataataaaaagttaagcgcagaacaagttagtcagtatcaagcaaccccaatgacaacaaatgataactatcaatatacatctagttatagatatccatattattttgatgcagttattaacgaagcgatgaatagatatgggttaagcgaaacagatattatgaatagaggatataaaatatatacatccttgaatcaaaattatcaaaatgaaatgcaagatgattttgctgacagtagtttattcccatataatgcagaagatggaactaaagcacaaggggcatctattgctattaatcctcaaaatgggggtgtagctgcagttgtaggtggaagagaaggaactcatgtatttagagggtataatcgtggtacacaattagtaagatcgccaggatcaacgataaaacctttagctgtatatactccagctcttcagttaggatatcattatgatactgatgtaaaagatgaattaaaggcatatggtaaagataagtatgagcctcataactggaatgacgtgtactctggagaaattcctatgtaccaggccctagctgaaagtaaaaatacttctgctgtatggctattaaataaaattggagtttctaaaggttataagtctgtcgaaaaatttggaataaagttaacttcagatgacgaaaatctaagtttagcattaggtggcttgaagaagggagtttcgccttatcaaatggccaatgcttatacagcctttgcaaatggaggaaaattatatactgctcattttattacaaagatagtcgatgcacagggcaaagtgattgtggataatacagagaatgattctaaaaaaataatgactaaaaaaattgccaatgagatgactagtatgatgatggatgtatatagaacaggtgggacaggtcaatctgctagtccaagtggatatacgattgctgggaaaactggttctaccgaaagtttaacagcatctaatagttcaaatgaaaacgatcattggtatataggatatacacctgatgtagtagtagcaacttgggtaggtttcgattctactaagtattcgttaagtgaagaaggcattagaggtggagcaagtctatttaagaatgaaatggaaggtattttgcctcatactgctggaaatacgtttactgttaaaccagcttcaactatggtagcccaagaaagtggagcttcttcgagttcatcaaatgtatgggatacatttagaaaagcaggtgaaacattagatgattcattctctaaatcagcatctgattggggaagtaaggcttcatctttgtttgatcaaggaaaacaaaaattacaagaatggtttggacaataa

SEQ ID NO: 588 - DNA, 1143 bp, Lactobacillus salivarius
  isolated from gut, Lactobacillus salivarius
atgaaaaatgaaatgttaggagtaatccttgcaggaggtaaaggtacacgtttaggaaaattgacacataatcaagctaaacctgctgtaccatttggtggacgttatcgcattattgatttcactttaagtaattgcgttaactcaggagttaaaaatatcggtgttattacccagtatcaacccttaaatctaaatgcacatattggaaatggtgctagttggggattagatgacttgaatgcgggagtaacaatattacaaccatattctaataatgaaggtagcaagtggtttgaaggtactgctcatgctatctatcaaaatattggttacattgatcaaatggatccagaatatattttaattttatctggtgaccacatctataagatggactatgaagcaatgcttgaccaacataaagaaacaggagcttcattaacagttgctgttattgatgttccttgggatgaagcatcacgtttcggaattatgaatactgatgacaataatcgtattattgattttgaagaaaagccagctgaacctaagagtaatcatgcttccatgggtatttatatcttcaactggaagagattacgcgaagttttagtaaatagctttactcgtaatcaagatatggtggacttcggtaaaaatgttattccatattacctaaagagtggtgaaagtgtatttgcatacaacttcaaaggatattggaaagacgttggtactatcgattcattatggcatgcaaacatggaattcttagatgaaaataatgaattaaacttacaagatagaacatggcgtatctattctagaaatcctattgcaccaccacaaattattgctgaaacagctgaaattaaagatgcaatgattgttgatggctcttatattgcaggtaaggttgatcatagtattttatctgctaatgtaagaattcaaacaggttctgttataacagattctgtgatcatgccaggtgcaaagattggtaaaaatgtaactattcatcgcgcaattatcggtgaaggtgctgttatcggcgatgatgttgtcattgatggtacagatgaaattgcagttatcggaaataaagaagtagttggggtgacaagtcatgaagaataa

SEQ ID NO: 589 - DNA, 918 bp, Lactobacillus salivarius
  isolated from gut, Lactobacillus salivarius
atgacaaagaaattagcattgcaagatattattttaacgttgcaacaattttgggctaaacaaggctgtatgttgatgcaatcatatgatactgaaaaaggtgccggaacaatgagtccttatacattcttaagagctattggaccagaaccatggaatgttgcctatgtagaaccatcacgtcgtcctgctgatggtcgttatggtgataaccctaaccgtttatatcaacatcaccaattccaagttttgatgaagccatctccaagtaacattcaagaactttaccttgatagtttacgtgccttaggtattgaacctaaagaacatgatattcgtttcgttgaagataactgggaaaatccatctatgggttgtgccggtgttggttgggaagtatggttagatggaatggaaatcactcaatttacttacttccaacaagttggtggtttagaagttaaaccagttgctgccgaagtaacatatggtttggaacgtctatcatcatatattcaagacgtagattctgtttatgatctagaatgggcagacggtgttaagtacggtgatattttcaaagaacctgaatatgaacattctaagtattcatttgaagaaagtaaccaagaaatgttactaaacttatttgatacatttgaaacagaagctaagaagcaacttgcaaatggactagttcatccagcttacgattatattttgaaatgtagtcatactttcaacttacttgatgctcgtggtgcagtatctgtaacagaaagagctggttacttatcaagaattagaaatatggctaaatctgtagctaaagtattcgtagctgaaagaaagaaactaggttacccattaattaaagatgaaaaactaagacaagagttactaaaggaggaaaaataa

SEQ ID NO: 590 - DNA, 645 bp, Lactobacillus salivarius
  isolated from gut, Lactobacillus salivarius
ttgaagaaaccatatctaacaattaaagaaaacggcgaagcaacgattgaaataaaaaaatcagagtttatctgttctttggcgcgaactgagacagaagaagaggccagagcgtttatagatgaaattaagaccaaacaccgtaaggctacacataattgttttgcttatatgattggattgaatgatgaaattcaacgtgaaagtgataatggtgagccttctgggacagcaggagtgccaattctagaagttttgaagaatcttgaattgcataatgtcacagcagtggttactcgctatttcggtggtatcaagctaggtgctggtggcttaatcagagcttatagtaatgcgacttctaatgcgattgaacatgttggggtagtaagaaaagtagttcaaacagaattatcattaaaagttagctactctgcctggggtaaactgcagaactatcttgaaaatagtcaggtaaatgtaagtgatacggtatttatgactgatgttacggcagtagtttatgttgatacgccagaagttgaatcttttactgcgacaattgttgatttaatgaacggacaagttgaagtagaagaaggtcaggaaaaatatgttgaagtgccatatgaactatataaataa

SEQ ID NO: 591 - DNA, 1452 bp, Lactobacillus salivarius
  isolated from gut, Lactobacillus salivarius
atgtcttatgaaatcaaaggattaaacgaagagtgtggagtctttggagtttttggggctgaaaatgcaagtcaattgacttattttggtctacatagtttacaacatagaggacaagaaggagcaggaattgtttcaagtgatggcgatagactacatcaacatcgcgataggggattattagcaaaagtatttgctgacgaaaaagacttactaaggttaactggagatagtgctattggtcatgttcgttatggaacaagtggtaataattctatcaataacattcaaccatttttattcagatttcatgatggtgatgttgctttagctcataatggtaatttgaccaacgctgtaactttaaagcaagatcttgaagacagaggggcagtttttcagtcaaattcagatactgaaattctaattcatttgattcgtcaaaaacaaaattgcacttttattgaagcacttaagcaaagtttaaatgaagtaaaaggtggatttgcttttctcttattacgtaaggatagtttaattgcagcactggatccgaatggttttcgccctttatcaataggacaattagataacggtgcatatgtagtagcaagtgaaacttgtgcgttggacacagtaggagcaaaatttgttagagatgtgcagccgggtgaattaattgtaatcaacaaagatggtatgaagatagatcgatatactgataaaacacaactatcaatttgttcaatggaatacatatattttgccagacctgattcaattattcatggtgtaactgtgcataatgcgcgaaagagaatgggaaaacttttagccaaggaacaaccagcagatgctgatatggttattggcgttcctaactcctcattatcggctgcttctggatatgcagaggaattgggactaccttatgaaatgggattaataaagaatcagtatattgctcgtacatttattcaaccgacacaagaattacgtgaacgtggagtaaagatgaagttgtcagctgttagaggggtagttgaaggcaagcgagttgttgttgtagatgattcaattgttagaggaacaacttcaaagcaattagtaaaattattacgagaggctggagctaaagaggttcatatgcgaatttcatctccaccatttaagttcccttgtttctatggaattgatatttcaactcgttcagagttaatggctgcaaatcataccgtagaagaaatgtcagatttaataggtgcagatagtttaggatttttgagtatatcatccttaataaaggctatttctgttaaaggcggtgccgattatcctaatggtggattaacggttgcttattttgatggtaagtatccaactcctttatatgattatgaagaagcttacttaacttctttgaaatcacaacaagaaagagaggaaaagtaa

SEQ ID NO: 592 - DNA, 3075 bp, Unknownn
  isolated from gut, unidentified
gtgagtaagagttttaatgaattatctcgtgtgcaattacccgcagtattgcacttaataagattggaatataaatacttatcatacaaagaaaacaaagataagttcgatttagatgataatattattgtacctatctttaaggaacaatttttaaatttaaaccctgaagctagtaaagaggattttgaaaaagaatatcaagatatcaagctagagctgaattttgatgatttgggacaatcttttttcaatcggctccaaggcaaaggcaactcgcagtaccgtctgattgattgggaaaattttgacagtaacagttttcatgtggcaatcgaggttccttgtataaatggtgaagaagaattcagaccggatattactatttttattaatggtttgccattaacctacattgaagtaaagcaaccaaatgcaatccgagatggtatgactgggatgaagtcagaatttgaacgaatgggtactcgctttagaaataaaaagtaccgagcttttcacaatattacacagttaattgccttttcagacaacatggattatgccgacgatgatggtcaacaaatgcagggatcatactatgcaactactagcttaggcaaagctgttttcaattcaatgcacgaggaacgttatggtgaactagtcgatcaaattggaacattatccgaagaagatgttgattatgtcttgaaagatgccaataaaatcgtcttgaaaaatacggcagagtttaagagcaactgtgatcctaatactccactcaatagatttttgacttcgatatacactaaagatagattagcatttttcttacgctttggtattgtatatgttgatgctaccactaaagatggtaagcctactatccagaagcacatcatgcgttacccacagtacttcgcgactcgaaaaatctccgaaaaaattgatgaggggatgaaaaaaggtgtcatttggcatacgcaaggatctgggaaaacggcgctagcctactttaacgtgaggtatttgaagtacaaatttcagcaaaaacagctcatacctcgcttttactttgtggttgatcggttagatttagcaacgcaggcaagtaaggaattccgaaagcgaggcttaactgtcaaactaatctcaagtaaaaagcagttgaatgaagcatttgctgaagacattgcagtagtcaatattcaaaaagttaatgaagacactgatctaaccaataaatcaggttatgcgttaaatacacaaaatgtctatttcattgatgaagcccaccgctcttataacgaaaggggatcatatttgccgaatctctataatgccgataaaaactctatcaagatcgcattgacgggtacgccattaattagtgtagacggtaaaaatagtaagaagagtcgggcgacaacacgtgaaatatttggtgactatatccacaagtattactacaaccaatcaattgaagatggatataccttacgcttgctccgagaagaaattgctactagctacaagaaaaaattgtttgatgttttaagtagcatttctggagaagtagagaaggggagtttggataaaacgaccttgtattcacatcctcattttgtaacaccaatgttggagtatattctaaacgatttcactaagtctcgtgatatttatgatgatcaaacaatcggaggaatgattgttagccagtctagcgctcaggctcgtgaaatatataaacaatttatgaacaagcgtgaacagggagaaacaacccttactgcatctttgattctttcagatgaagatgataaggaaacccgggctaaagaggttgatgattttaagagtggaaagacagacttcttaattgtgtataacatgcttttaaccggttttgatgctccacgattaaagaagttatacttgggacgaatgattaaagctcataacttgttgcagactttgacgcgagttaaccgtccatataaggatttcagaatgggctatattgttgatttcgctaatatttctcgtgaatttgataagaccaatcatgcttattttgaagaattaaatcaagaatataacaaagatacaacggacgaggaattacaaaatatttatggctctttgtttgttccatctgcagaaatcgaagctagtttgaaaaaggcagagattgtacttgcagaatacactacagataacttggagcaatttagccaggaagttaatgagacgccagaaaagaaagatctgttagaattagctaaaaccttgaaagaattgaaacaatactacaatatcagtcgattgatgggttatactgatttaactgatcaaatcagaaatctggatgtagccaaactactgacggtggtgactaatcggattgcaacattaaatctattggctaatgctagggatgatagtagtgaaaaattactaaagctagcaatgaataaaatggactttagtttcaagaaggtcggtgaagttgagctagaattagcggctaatgactttatggaacgtcaacgcaaagcagcaactggactaggacataactgggatcaaactgatccagaatggattagtctttatgatgaatttacccgaattctgcaaaggcaacatattggagaattgtcggctaaagaaacgaagatcaatacgactgccttagataaagtcattattcagattaataacttaaatgctcgcaatagaaaaattgcgacagcatttagtggtgattataagtacgcacgggcctataaacacgttatttatagccaaaagcagcaaatgccaacttctgtcagagaagagccggggctttatcgagtaatgttacgagctaagacagatattgatgataaggtagctaagaatcaaagcatggttgaaaatcaaggctactttactaatgaatcgattgctactattcgtaatagtagtcgccaagaacaggttaaaattgcgccaacgcaagttaaaactgtctcacagttgttgactgatgaatatgaaaaagaattagagatgctaggagtttaa

SEQ ID NO: 593 - DNA, 396 bp, Lactobacillus salivarius
  isolated from gut, Lactobacillus salivarius
gtgaagaaaagatcaaagattgctatcatggataatgattattttcgtaagcaacaagctaaaagtaaaaatgctgctttaaaagctaaacactatcaacattatcgattgtttagagtaagtattatttctttaactatactattaacaatagtgtttgggataagacttattacaatgcactatcaaacccaaaatattaatgttcaaacggaagaagctaataagaagttagaaaaagtaaaagctaaaaatactgatttgaaagagcagattaagcaattaaatgatgaagattatttaagaaaattaattcgagaaaagtactcctattctaaagataacgaaataatttataacttaccaacagatgttacaaaaaatattggacaataa

SEQ ID NO: 594 - DNA, 1098 bp, Unknownn
  isolated from dental, unidentified
atgcaaaaagaagttgcaaataaaaaaatcgatgagttgctacatgagctcccttattatatgaatgattttgttattgtaaaaaccgctgatgaatattctcctaatactattcttgaatacttgaagaatttccatcaatttttgatttggttgattgaaaatcattatattaacgaaaataaaactagtgacatcgccccagaatcgcttgataagcttacagttcgtactgctactgaatacaaatcttatcttttacgccgaaaaaagcaaaataaaaaagctcttgataaaaatggtcataaagaagaatctactgagactctatctaaagtaactattcagcgcaatatcactgctttaaaggtgatatttaagttcttaagcagaagtgctaataactctcaagaaaaaccttttttaacacacgacgttatgcaaagtattgataatgtggctgataagcaaacgctacaagctagagctgatgccttagaagaaaagttatttttagatgatgaaactgatgaatatctgcaatatatcaaagaagtttatcctcagtcattatctactcaagctaaaaaattctacaatcgcgatgttgaaagagatttagctatcaatgctttaatgttaggatccggtctccgtttatctgaagttgttaatatcaatattgaagatttagatttcgaaaacaatcgagttgctgtacttagaaaaggaaataaaaaagattctgttagaattgccgcttttgcaatggaatatctagctaattatcgtgatatccgtgctagtcgttatcgtgcagataaatatgaaaaagcattcttcttagctattagtcgtggtggttccaaacgcattactggctctgctattgaaaaaatggtttccaaatactctaaaggtttcaaagtcagagttactcctcataagttgagacacactttagctactagattgtataaacaaactaataaccttgttttaactgcacaacaattaggacatagctcaactgctacaactactctttatactcatattgataatgatgaaactacggatgcattgaattctttatag

SEQ ID NO: 595 - DNA, 522 bp, Unknownn
  isolated from dental, unidentified
gtgaaacgagggtttgaatacgcattgaagaataacggacttatttatggagtactagcacagttaaattacaaggtggggcatcctgattttgaggatatgtttgaagaagcgagaattttactagcagagatatataccgaatattatcgtaaagaaaatgctaaagaggaatgcggaagttatatgtttcaaaaactaaagtggcgcttattggataaactaaggcaaaagaaacgtaagcaagtagaagtgtgttttagtcagttagccaatgagaatgatgaattaccccaaatagaagaaattatcgaaactggggataacattgagattagcgatgctctgtatcagttatataaaagatgtactgataatgaaaaaatgttgttgagctattatagtgtagggataactaagactacagaaattgcaaagctgatgggaaaatcacgaatgacaattaatcgctggagaaaaagcatccaagaaaaatatttagaattaaataatgaaaaataa

SEQ ID NO: 596 - DNA, 1011 bp, Unknownn
  isolated from dental, unidentified
atgtatgatgaagagagaatagtttctggtgatagttttgaaggtgaagatttaaatgaacaatccttacgtcctcagactttcgatcaatatattggtcaaaaattattgaaagatgaaattagtgtttatatccaagctgcaaagcaaagagaagaatcattagatcatgttttattatatggccccccaggtttagggaaaacaactttagcgacagtaattgctaatgaaatgggtgttaaaataaaaactactactggtccggcgattgaaaaacccggagatttagtagctttactgaatgaattagaaccaggcgacgttttatttattgatgaaattcatcgtttgccaaaaaatgtagaggaaatcttgtattcagcgatggaagattattttattgatattattgttggtcaaggtccaactgcacatcctgtacattttcctctaccaccatttactttagtaggtgctactactagggcggggcttttatctgctccattaagagctagatttggaattgtcggtcatatggagtattataatgaagttgacttatcacaaatcattaaaaggtctgcccaaattttaagtacaggaattgatgatgagggtgctcatgaaatagcacgtcgttctcgtggaactccacgtgttgctaatcgtcttttaaagcgagtccgagactttgctgaagttaagcataaagacaagattgatacggaaattgtacaatttgcgttagatttgttgcgggttgataaagtaggcttagatagaactgatagaaaactactaaaagcaatgattgaattgtatgatggaggtccagtgggtctaaatactattgctgctaatattggtgaagaaagtgatactattgctgatatgattgaaccatatttaatgcaaataggatttattaaacgaactccaagaggcagaatggtaacattagctgcttatgagcatttgggaataaaatataataaagaaggttaa

SEQ ID NO: 597 - DNA, 2010 bp, Unknownn
  isolated from dental, unidentified
atgaatttgggcaagaggagtagtgagaagatgaaagcagatacgataagattgttagatttattagcacagtctaaggctatttttgaaatacctgtataccaaagaaattatgaatggcgagaagagcaatgtcgtcaattgtttaaagatattttactggctgctaaggaacaaaagccacacttcactggggcagttgtatatgtagaagagtcaggacctaatatgagtcacatctacaatattattgatggacaacaacgtttaactagttgttctttgttattaaaggcaattgctgatacaagtaatgacgaagaattaaaagaagaaattgaaactaattatttaaaaaataagtttttatctgataacaatcatattcgattaaaatcagtggaaaaagacagagaagcatattatgcaataatgtcagatagaattgatgaatatgataagccatctaagatgaaaacaaattataagttatttatcaggttaattgaagaatcagaattaagtagtagtgaattgtttacagcaattaattttttaaatgttgtatatatagaaattaatagcaatagggatgaggaaaatccacaagttatttttgaaagtttaaattcgactggtgtatctttatctgcatctgacctagtgcgtaattttatattaatgagtttagatagtgaagaacagactaagttatataaagagtattggataaagattgaaagcttgtttatcaataataatatttttgcagagtttattaggcattatttaatatctaagacaaaaaaagctgttaaaagagagaatacttattctgtatataaaaaatattattacgaacaaaacttcaatgctaaagaagctgttaaagagctatacactaatgtgcgctactattctcaattattaaatgcaagtactgagaataaagaatttaataaagctgtcagccatattaatacattagataaaaaagttctttatccatatttattaaaactattagatatgcaagttaaacaagaaataagctggaacgaagttgtagatatagcacatttattagaaagttacatatatcgtagaatgatttgcagtgttccaagtaatgctttgaatggtttagtagtttcattaactaataaagagaataagaatgaattagaagtagttgaacgaagactattgaataataattttcctactgataaagaattcaaagaaaaattactggaatatccaatttataaaaaaagaaaagactgtgctaaattaactttggaagttttggaagaatcaaagacgaaagaaacaattgattttgaaaaaacacaggtagaacatataatgccaaaaaaattatcaacagattggcgaatagaagtaacaaatgctgaaagtactaatcgtcaatatggagatactattggtaatttaacattaactggatataatcaagaaatgagtaataaagtctatacagaaaaaagaaaattttatagtaaatcaaatatagttttatcaagagaaattagtgaaaaatatgaggtttgggataaaaatagcatcgtagaaagagctaagaatcttgcagacgaactttgcagaatattcgaacgtcctactttaattaagaagaatattgctgatacctataaaggtgaacataacattttagatgaattggatgtaacgggtcaaaaaccagcttatctgattattcaagaacatgattatcaggtatcgacttggggaagtatgattgtaacatttttcaattatatttgggaaaatgacagtatgacatacaataagttaaagtctgaaaagacattagaatggctattttcaaatatacgaaatcctaaagtattgaaaaatggcgatgtaatagaaactaatttctcagctaatactgtagttgcagtattggctaaagtatctgaaatgtgtggtatttcagaagaagtaagttatattcttaaatag

SEQ ID NO: 598 - DNA, 807 bp, Unknownn
  isolated from dental, unidentified
atgaaaaaaataaaagtttgtattttttctacttgtctagttgatttactttttcctaaagtagagatggcgatggtagaagttttagaacgtttgggttgtgaaactgtattacctgaaaaacaaatttgttgtggacaaccaacatataatagtggctattctaaagatagtatgaaaacgtttaaaaatgaaattgatgcattactaagtattgatgctgattacattgttggtccttcgggttcttgtgtttttatgattaaagaatataaggatatttttaaagatgatcctgagtatggtcctaaagccgcagaaatagatagcaaaatttatgaatttacacaatttatttaccgagttttaaaagtcgtagattgtggtgcggaattagatgctaaagtaactgtccatcgttcatgccatatgacgcgtttgataggcgaaagaacagctccatttgtattattggatcatgtaaaagatattgaaagagttcctttaaagaatgtacagttatgttgtggatttggtggtactttctcagctaaaagaccagaactttcagtagaaatggttgatgaaaaagttaagaatattgttgatacagatgctgagatcctaattggaacagaagaatcttgcttgatgaatattgtaggtagaatgaatcgtttaggatataagataaaagcgatgcatattgctgaagtattaaaccataatgttgatataaatagaattaaatatattaaggatacagatcatgttgttgtaccagctaatggagaaggggtgttttaa

SEQ ID NO: 599 - DNA, 1182 bp, Unknownn
  isolated from dental, unidentified
atgcaaatttcacaaagagctaaaaatatacaaccatctgcgacgcttgcactatcaactagagctaatgcaatgcgtgctgaaggaattgatgtaattaatttaacggtaggagaacctgattttcaaacacctaagaatataagagatgctgctattgctgcaattaatgatgggaaagcagattcatatactcctgtattaggtataaaggaattgagagaaaaagtagcagaggttactaacaaagactacaatactaactttacgagtgataatgttgcagttacgactggtgggaaatttgctttatatgccatagcacaatgcttgctaaatcagggagatgaagtgattattccactcccatactgggtaagttatggtgagcaaattaaattatcggatgggaaacctgtatttgttaaaccaagtaagggactaaaagtaacagcatcagatttagaaagtgctagaaccgacaaaacagtagcgatgattttaaattcaccacaaaatccatccggcttagtatatacaaaagaagaattggaagaaattggaaattgggctgtaaagaatgacatagttataatttgtgatgacatgtatggaaagttggtttataatggtactcggttcgtatcattaatggatttaagcgatgatattagaaaacagacaattttagtaagtggattatctaaatcttatgcgatgacaggctggagagttggatatgcggtagctgatgcagaatttattaaaaagattgctgcagtagctggacattctacaagtaatttgacagcagttagtcaatacgcagctttagaagctttaaatggagatcaaagtagtgtgtctactatgcgagaggcttatgaagaaagattaaataaaatctatgaggaacttaaagaaattccgggatttgtgtttgattcaaaacctcaaggagctttctacctatttcctaatgttgctaaagccgcagagttggtaggatgtagtaatgtctctgaatttgcagaatttttattagaaaaggcacatgttgctgtggttccaggagttgcatttggaatgtctgattacattagaataagttatgctgcaagtttagataatcttgaagaagcggtaaaacgtattaaaatgtttgttgaagaaagaaaatag

SEQ ID NO: 600 - DNA, 981 bp, Unknownn
  isolated from dental, unidentified
atgactaaatcatataccgctattaattggaatgctttagaagatgaaattgataaagctacgtgggaaaaacttactgaacaattctggttagatacacgtattcctttatccaatgacttatctgattggcgtgaatttaatgaagatgacaaagacgtcgttggtaaagtattcggtggtttaactttattagatacacttcaatcccaagatggtatgtcttcattgaagaaagatgttcgtacacaacacgaagaagctgttatgaataacattgaatttatggaatcagttcatgctaaaagttattcttcaattttttctacattaaacactcctaaggaaattgaagaaatctttgattggacaaattctaatgaaatcttgcaatacaaagctaatcgtatcaatgaaatttatcaaaacggtagtcctttacaaaagaaagttgcttctgtatttttagaaacatttttattttattcaggattctatactccactatattggttaggtcataataaattagccaacgtagccgaaattattaaactaattcttcgcgatgaatcggttcatggcacttacattggatataaattccaattaggctttaatgaactatctgatgatgaacaagaagaatttacttcttggatgtatgatttgctttatgagttatacgaaaatgaagaaaaatatactcacttactttatgacaaagttggttggactgatgatgtattagttttccttcgttacaatgctaataaagcattaatgaacttaggtatggatccactatttgctgatggatatgcgcaaaatgttaatccagtcgtcatgaatggtatttcaacttctacatctaaccatgatttcttctctcaagttggtaatggatatctccttggtgacgttgaagcaatggaagattctgattacttatttaactttgatgataactccgataaatag

SEQ ID NO: 601 - DNA, 555 bp, Unknownn
  isolated from dental, unidentified
tggagaggttcttacacatacggctatcgccgtataatgccacttcttgaaaaagctggatatcacatggctgaagccactttacgtcgcctaatgaacgaattaggtgtacaaccagctatgtataatcgtcgtaaaaataatcactattcttcttataaaggtacagttggtaaggtagctgataacttgttaaaccaaacatttgatgctacatctccttttaccgttcttcatacggatgtttcacaggtacgtctaggtgattcgacctgggcttacatgtcagtcattttagatcaagctaccaaggaagttttagccgcttctgttagccaaagcccaaataaattgttgattatggatacattaaaccagcttgaggataacctccctaataactttagtccaattatccattctgaccaaggatggcactaccaattagaatattaccgtgaaaagattgattcgttaagtttaattcaaagtatgtcccgcaagggaaactgcctagataatgcccccaatggaaagctttttctatctttttaa

SEQ ID NO: 602 - DNA, 1353 bp, Unknownn
  isolated from dental, unidentified
atgaagtattttggaactgatggtgttagaggaattgcaaacgaaacattgagcccagaattagcatttaagctaggtcgttgtggaggatatgttttaactcaacatgcttctaataaaccagcacgtgtgttagttgcaagagatacacgtatttctgggcaaatgcttgaacaagctcttattgctggtcttttatcagtaggaattgaagtattttctttaggagttatgacaacacctggggtagcttatttagtaagattacaagatgctgatgctggaattatgatttctgcatcacacaatcctgtacaagataacggaattaaattcttcggtagcgatggttataaattatctgatgaaaaagaagaagaaattgaagcattattagaaagtgatgaagatactttaccacgtccttctgcagaaggcttaggtactctaagtgattatcgtgaaggtgctttgaaatatacacaattcttagaacaaacaattcctgatgatttagaaggaatgcacattgctgttgatggagctaacggatctacaagtgcattggtatcacgtttgtttgcagatttgggtgcagattttgatacaatggcaacaaatccagatggacttaatatcaataagggagtaggttctactcatccagaagcattagcaaaatttgttgtagaaaagggtgcacaagttggtgtagcttttgatggtgatggcgatagatgtattgctgttgacgaaaatggtgaaatcgttgatggcgataagattatgtttatttgtggtaagtacttgagtgaacgtggacgcttgaagaaagacacaattgtaacaactgttatgagtaatattggtttgtacaaagcaatgaaagaaaataatcttaattctgttcaaactaaagttggcgatagatacgttgtagaagcaatgagaaaagatggatataacgttggtggggaacaatcaggacacgttgtattcttagacttcaatacaactggtgacggaatgttaaccgcacttcaattattaaatgtaatcaagcaaactggtaagaagttatcagaattagcagctgaagttaagacatatccacaagaattagtaaatattaaagttactgataaaaaagcagctttagataatgaaaagattaaagaagctatcgctaaagttgaagaaaaaatggctggcgatggtcgtgtcttagtaagaccaagtggaacagaagacttacttagagtaatggctgaagctaaaactcaagaattagtgcatgactatgtaatggaaattgcagacgttgtagaagctgaaatgggtgtaaatgaataa

SEQ ID NO: 603 - DNA, 996 bp, Unknownn
  isolated from dental, unidentified
atgaagaaaattatcaataatccagcagatgttgttccggaaatggttaatggaatggttcgtttatatccacaatatattgaaaagattgatggtactgaagtaatggtgcgtagtgacaaagaatctatgcaaggtaaagtaggtattgtcagtggtggtggtagtggacatgaaccatcacatgcaggatttgtaggtaaaggtatgttaagtgcagcagttgcagggcaagtatttacctctccaacacctgatcaaatatacgaagcaatcaaggctgttgatagtggcaaaggtgtatttttagttattaaaaattattctggcgatgtaatgaacttcgatatggctaaagatatggcagaaatggatgatattgaagttaaatcaattattgttaatgatgatattgccgtagaagatagtttgtatacacaaggccgccgtggtgtagccggaactgtattaatgcataaaatcttaggtgctgcagcagatcaaggtgcaagtttagatgaaatagaagaattggctaagaaagtattacctaacttgaagactattggggtagctttatcagcagcaactgttccagaagttggcaaaccaggatttgaattagctgaagacgaaattgaatatggtgtaggaattcatagtgaacctggctatagaagagaaaaaattaagccatccaaagaattggtagcagaattaattgaaaaacttgatgaagaacttcatttagataaggataagaaatatgctgttttaattaatggtatgggtgcaactccattaatggaacaatatgtatttggtaacgatgtattagatgcattagaagctaaaggtgttaaaccagtatttacaaaggctggaaattatatgacatcaattgaaatggctggtatttccttaacaatatttgaattagctgaagataagtggctagattatttgaattatccagtagaaacaattgcatggtaa

SEQ ID NO: 604 - DNA, 1704 bp, Unknownn
  isolated from dental, unidentified
atgggaccaggatacgttttgaatggtcgttataagattcgacgtgttctaggtgaaggtggaatggctaatgtttatttagctgatgatttaattttaaatcgaccagttacggtgaaagttttaagactagatttacaaaatgatcctgcttctttgagaagatttcatagagaagcgatgtcattaacagaattaactaatcctaatatagttaacatttatgacattgatcaaacagatgatggtatgcagtatctagttatggaatatgtagatggtatggatttaaaagcatacataaagaaaaatcataaacttccatacgaacgtgtaatagaaattatggaacaaatcttatcggctgtagaggatgcgcatgcacacaatataattcatagagatttaaagccgaaaaatattttaattgataagaatgggacagttaagattactgattttggaattgctgttgcagttgcggaatttacaatgactcagactaatacattagttggttcagtacattatatttcacctgaacaagcaagaggaagtatggtaactaagcaatccgatatttattctttaggaataattttgtttgaaatgttaactggtgaagttccgtaccaaggagagacagctatctctgtagctttaaagcattatcgtaatgatatgccatctgttcgtaattatgataataatattccacaatccctagagaatgtcatattgcatgcgactgctaaaaatttaaatgaccgatataaaacagtggcagaaatggcggatgatttaagaacagttttagatgaagatagaaaaaacgaaaaagtatggagaccgcaaaattttgttgatgaagaaacaaagatattacctcaaataaaagacagttttattgacgaaaatttagatgaaactaaaactttaattctctcagaagatgctataaagaagaacgaagaaactactaagactagagagaaaaaacaaaagtggagcagaaaaaaaagaggtattacagttggggcaataatattagctttaatcgttgtttcggttgtgatttttgctttaattacaactcccaaagtaattactttgccagatttaagaggaatgactcaaacgcaggctgaaagcattcttgataacaagaaattagaaaaaggtaaagttacggaaaaatattcaaatttatataattatggccaaatagttagtactaatcctaagcagggatcaaatgtacggcaaaaaacatcggtaggtttggtaatatctaagggaccagataagaaaccatttggcgattatcgcggacaaaattatgatgatgttaaagagagacttgaaaatcaaggtgtacatgtctataagaaattgaagtatactgatgacgttgctaaagattcaataacatctcaaagtttaaagccaagtgctgctgttgttatgagtcaaacaaccgttacatttacagttagtaagggtcccgttcattttaggttaaaaatgtttagtgggatgaataaatctcaaattgaaagttacgctaagcaacagaatatagatgtagtttttcagtacgaggcatctgataagtttaaaagtggtgaagttgtgagacaaggtccggcacccaatgccattgttgagagaggatcacaagtaattgttgtgttagctaaataa

SEQ ID NO: 605 - DNA, 489 bp, Unknownn
  isolated from dental, unidentified
atgattattatggctcaagaatacaagcgtgtcttagttgcaattgatggttctaaaggggcagacgcagcattacgtacagcaattgaagttactaagcgaaatgaccacactcatctagatgtgttacgtgttttggatttaaactctcttgaatatggtggggcaggaattgctcttgacggtcaaaagatttacgaaattgaacaagcaaatgaagattacatgttaaaacttaaggataagattgtagctgaatacgatctagctgcagatagagttagtgttcacctacgtttcggtaatccaaaagcagttatcacacaagatttccaaccagaatacaataacgatttaatcgtagttggatcaactggtaagaactttgtacaaagaatgattgttggttcggttgcatcttatgtaattagaacagctaagtgtgatgtcttaatggcaaaggttcgtaatggggaagaagataagtaa

SEQ ID NO: 606 - DNA, 1185 bp, Unknownn
  isolated from dental, unidentified
atgtacaattttgataaggtggcaaaatttcaaaattcacttaagtggcatgttaatgatagcgaattaccaatgacacttggtgatatggattttgaagtagcacctgaaataattactgaattacacaaaagaatagaaaataagaattttggatacgaatatattccgcacgaatattatgcaagtgtagctaaatggtataaagaaatgcataattgtacccttgatatttcctggatgtctttttctcaaggagtagtagctactttatcagctattattactaatttaatgaatgaagatagtgtaataacagttttaactccaggatttgataaatttaagaaagttggagaaggaaaacaaaaagtattagtaagtgaacttatttacgataaagaaaaacgcgattatgacattaattggctagatttagaagataaattaaaaaagactaatctctttgttctttgtaatccacatagtccagttggaaaaatatggtctcaaaaagatttagaaaagatactaaaactaagtttaaagtatgattttaaaatttttagtgatgaaattcatggagaaataacatttgataagaaatatactccattatttagtttagacgaaaagttattaaagaatacgattatagcagtttcaccaagtaaagcatttaatattgctggaattcaaaccgcaacaataataacgccaaataaagagttgaaagagcaagtagacaacgcaataaaaagtttccatcttaatgaagctaatagtttagcagttccggcaacaattgcagcatatacagaaggaagagtttggcttgaagaattgaaagattatctaagagaaaatcgaaatttcattgaacgttttttagagcataatgttccagatgtgaaaccaagtttaaacgaagcatcatactttctttggttggatatatcatcattaaatgttgatgcacaagaattaacggaatttattcgtaaaaagacagggttaattttaactgctggagataaatttgatggaaatggaaaacaattcttacgtatgaatatagcaacttcaacggatttaattgaagatgcattgaggagattgcagcgagctattgtactatttaagcggaaagacgacgatttaatgaacttgatactaaataaataa

SEQ ID NO: 607 - DNA, 840 bp, Unknownn
  isolated from dental, unidentified
atgaaaattgcaatttctagtgataaccatttagatgtaaatcgacaaaatcctgatgaaattgtgtacttacaagctaattatttaaatgaacagaatgtggaatactatctttttgcgggagatatgtttaatgattttcaaaagacaaagaactattttgaaaaactaaataccttaattactgggaaagcttattttattgctggtaatcatgatatgctgaaaaacataacttttgaaaaactagagagcaataatatttctgatttttatctgcataatacttacatcgatattcctaatactaattggcgtatcattggaaacaatggatggtatgattatagtttctcccctactttaactgaggatgagattaagcgttggaagaatacttattggattgatgctggtataaagcaaccaatgtcggataatgaacgtgagcaattagttttacagcaatctaaacaacaatttgatttagcaaaacaagctaaaaagaaagtgatatttgtaacgcattttgtacctaatagtaaagctttatggtcaaaacctgctactttaaagagtgacaaagaaattcgtatttttgaaatggtaaatgctcttttaggtagtcgacatttaggcaagttaattcaagattatcctaaaattaaatatgtattttatggacatgtacacggttggcatgaacctttccaaatagcaggtacgtcttatcttaaccaagctgttggtgtaagaaagaaaaaacgcaaatatcatgaatggcaaaaagatacttttatggatcaatggaagtatcggatgaacattattaatatctaa

SEQ ID NO: 608 - DNA, 936 bp, Unknownn
  isolated from dental, unidentified
atgacaaaaaaactttcaattatagtgccttgttattacgaagaggaaactatacctttgttctatgaggctgttgaaaaagttaaaaaggaattaaatggaattgaattagaatattggtttgtgaatgatggttcacaagatggaactttagatgaaatgcgtaaattaaacgctaaagataaagaacatgtacactatgtatcattttctagaaactttggcaaagaagctgcgttatactgtggtttacaacaagctacaggagattatataactgtaatggatgctgatttacaagatccgccagatatgttgccagaaatgatagaaattcttgaaaatgaagactatgattgtgtgggaactagaagaacgaatagaaaaggtgaaccaccaattcgttcattttttgcaagaatgttttataagttaattaataaaatttctgatactgaaattgttgatggtgccagagattttagagtaatgacaagacaaatggtcgatgcaatcctttcaatgacagaatacaatcgtttttctaaaggtatttttagttgggtaggtttcaatactaaatatttagaatataaaaaccaagaacgagtagctgggacaacaagttggaatttttggagcttgttgaaatattcaattgatggaattgtcaatttctctcaagcacctttagatatagctgtttattttggaatgttaacatcattcttttcagggattggaattgtatggattattattcgttactttttagaaggtggagatccaacgacaggttggacatcaactatttgtttattgctattttttagcggaattcaactaatgtgtctaggaattgttggtaaatacattggaaagatcttttctgaagttaagagaagaccggtgtatattataaaagaaaagaagtaa

SEQ ID NO: 609 - DNA, 924 bp, Unknownn
  isolated from dental, unidentified
atgacacaaaaagttattgtgattgttggcccaacagcagtaggaaagacagctttatcaattgatattgctaagaaatataaaggacaaattatttcaggcgattcaatgcaagtttataaaaatttggatataggaacagcaaagataacacctgatgaaatggaagatataaagcactatatgatagatatcttacaagttcagcaaagattttctgttgctgactttatagataactgccgtaaagatataaaggaaatagctaatgatgataatatacctatcatcgttggtgggacaggcttttatttgcaagcacttttagatggttatagtttaggtggagatacttttgatcaattgagtattgaaagaagaaaaaagtggcaactttttatggaaaaaaatggaaaagaaagattgtgggaagaactagcaaaattagatatagtagctgctaggaaaattccaatcaataattctagaagagtgataagggctttggaggttattgaacaaactggacgccttttttctgaacaacatgatgaaagtaatgaggaatttgagccattattaataggattgaatactcaaagaagtaccctatatgaaagaattaataaaagagtagatataatgattcaaactggattgattgaggaagcaaagtacctatatgatttaggcggagctacactacctgctggtaaaggaataggttataaagaattttatccttattttgatggtgaaatatctaaagatgaagctattgaactagtaaaaagaaattcacgtagatatgctaaacgacaattgacatggtttaggaataaaatgaatgtagtttggtttgatttagttaataaccctgaagatataaagaaaatatataaactaattgatgattggatataa

SEQ ID NO: 610 - DNA, 732 bp, Unknownn
  isolated from dental, unidentified
atgattgaatttaaaaatgttgataaatattatggaaatttccatgctttaaagaatattaacttgaaggtgaaaaaaggcgaggttgtcgtacttattggtccctctggttctggtaaaagtacacttattagaacaattaatggtttagaagatattagtaatggtcaattaattgttaataactatgacttatccgataagaaaacagatatgaataaaattagaaaagatgtcggaatggtattccaacactttaacttatacgaaaataaaactgtattagaaaatattatgttagctccacgaatagttttgcataaagatgaagctgaaaataagaaatatgctctagaattgctagaaatggtaggtctttcaagtaaagcagaatcatatcctagaatgttatctggtggacaaaaacaacgtgttgcaattgcgcgttccttagctatgcaacctaaatgtattttgtttgatgaaccaactagtgctctagaccctgaaatgattgatgatgtattagatgttatgaagactgttgcagaacgtggaattacaatggttgtggtaacacatgaaatgggattcgcacgagaagttggaaatagaattgtatttctagcagatggggaaattttagaagatgatgatacagaaacattcttcaaaaatcctaaagaagaaagagcccgtcaattcttgagtaagatcattactcacaaatag

SEQ ID NO: 611 - DNA, 1194 bp, Unknownn
  isolated from dental, unidentified
atgagtgaaacagaagcaaacttattagaagaagctttgaacagcgttaaagaagttaaagttggagacgttgttaaaggtgaagtattaacaattgatgaatctaaccaagttatcgttggtatcgaaaacactggtgtagaaggtgttgtacctgtacgtgaattaagcgtaaatgctgataaagttgctgacacatacaaagctggtgacatgttagatttagttgttattgctcgcattgggtcagataaagaaggtggaagctacttattgtctcaacgtcgtttagaagcacgtagagtgtggaacgaaattgaagataagttcaaagctggcgaaactatcaaggctcctgttacacaagttgtaaagggtggtttagttgttgatgctggtgttcgtggttttgtacctgcatcaatggtatctgaccactttgttgaagatttaaaccaattcaaaggtcaagaacttgaacttaagattgttgaaatcgaaccaagtgacaaccgcttaatcttatctcgtaaagaattagtacaagctgaacgtgaagctaagcgtcaagctgttatggaaaaacttgttgctggtgacgtagttgaaggtaaggtagctcgtttaacaaactttggtgcatttattgaccttggtggtgttgatggtttagttcacgtttctgaaatttcttacgaacgtgtaaacaaacctgctgatgcattaaaagttggacaagaagttaaagttaaggttctttctgtagacgcagaaaaaggtagaatttctctatctatcaagcaaacattacctgaaccatgggaacaagttcctgaacaagttgctgaaggtgacgttcttgaaggtacagttaagcgtcttacaagtttcggtgcatttgttgaagtattaccaggtgttgaaggtttagtacacatttctcaaatctcacacaagcacattgctacacctaacgaagtattgacttctggcgaaaaagttcaagttaaagtattgagcgttgacgcagcagatcatcgtctagctttatctattaaagcattacaagaaaaaccagcagttgaaaagaaagaagcagctcctaagaaggaagaaaaagtagaaattcctgaagaagatacaggatttactttgggtgacattgttggtgaccaattaaaagacgaacaataa

SEQ ID NO: 612 - DNA, 1197 bp, Unknownn
  isolated from dental, unidentified
atgaaaattatggttcaaaaatttggtggaacttctgtccaagatgatgaatcaagaaagtctgccatgcgacatattgaacatgcagtaaatgaaggatataaggtggcaattgttgtatctgcaatcggaagaaaaggtgccccttatgcaactgattcattacttagcttggtaggtggtgaaagaaccaaacttactcctcgtgaattagacatgattgtttctgtgggggaagttatttcaacagcagtctttacacaaatgttaaaagaaaatggatttaatgccgtagctatgacaggcccagatgctggttttagaacaaataatgactatcaaaatgctaaagttttagaagtgaagacagacgctgtattagatgcatttgcttcccatgatgtagtagtggtttctggattccaaggaatgtcagaagaaggacacgttacaactttaggtcgtggtggatctgatacatcagctgctttgttagcagttgcattagacgcagaacgtgttgatatcttcactgatgtttctggtatgatgacagctgaccctcgaattgtaaagaatgcacatttcttgaaaactgttagttatgacgaagttgctaatatggctcatgaaggtgcgaaggtgatccatccgcgtgctgttgaagttgcacatcaagcacatttaccaatgagaattcgttcaacttgggataatgtagatgagttgggaacactagttactgataagaatcttagtattgaacattatcgtacagttacaggtattgcgcatcaaacaggcttaacacaaattaatctttcagttaacaatacagaagctgaaaagatcttcaaagtgttggctgaaaatgaggtaagtattgactttatcaatatttcacctaatcaagttgttttcaatacaagtcgtgaagatggattaaaagctaaaaaaatctttgaagaatataatatatcagtgaactttgttgaaaattgtgttaaagtatctattattggtggcggtatggtaggaaccccaggtgttattgctaaaatggttacagcactttcaaaaactggggttgaaatcttacaaacagctgatagtgataccactgtttggattttagtgactgaagataacttcaaactagcagttaataccttacatgaagccttcttagaaaattaa

SEQ ID NO: 613 - DNA, 708 bp, Unknownn
  isolated from dental, unidentified
atgaacggatttattggtgaatttcttggtacgatgattttaatcgttctaggtgtaggtaccggcgctggcataaatcttaagacgtcatatgcacgtaatgctggctggttgtttgtaactctagcatggggtatggctgtaacgtttggtgtttacgtagctggtagttttggagcacaaggacatttgaatccagcggtaacaattggatttgctctttttggtttcttcccttggagccaagttttaccatatttattaggacaatttttaggtgcttttgttggtgcagttttagtaattattcaatatggagcacaattcaagaatgctaagaatactagcgatggtaacgtagttggaattttcgcaactggtccagctattgacaatggtttatataatttcttgagtgaaacaatcgcaacttttgtatttatctttacattattaaatcttggcgactttacaaaaggattgaaaccattaattgttggtttattaattatggtagttggtcaagctttgggtggaacaacaggtttcgctttgaatccagctcgtgactgggttccaagatttgcttatacagtattaccagtacctaataagagtaatgcaaattggggctatgcatgggtaccaatgttaggtccaattgttggaggtatcttagctgctggcttacaatatttattagtataa

SEQ ID NO: 614 - DNA, 1332 bp, Unknownn
  isolated from dental, unidentified
atgacggaacaatatgatgtcgttgtaattggtggtggcccggctggtaacgcgatagcaagtggcttacaggcgcaaggtaagtcggtgctgatcgttgaagctgacttatggggtggtacttgtccgaaccgcgggtgtgacccgaaaaaaatcttgttgagcgccgttgaagcccaacaggcagcccaacatctccagcatcaaggcttaacaggaacaccgacgattgattggccggccctgatggcgcataaacgaggctataccgatggcattaatgatggcacgcttaaggggctgcagcaccaaggcatcgcgaccttacatggtcaggcccattttcaaaacgacggccagctagcagtcggtgaccaagtcgtaagtgcgacggattacgtgattgcgaccggacaacgcccagcaattttgccgattaccggacaagaatatttcaagactagtacggactttttagatttggatgagatgcctaagcgcgtgactttcgtgggtgggggctatgttggcttcgagctggcagcgattgcgaatgctgccggcgccgatgtccacgtgattcatcataatgaccggccactcaaagccttcgatgcggacctcgtccaagatttgatggcggccatgactgcggacggtgtcacttttgacttgaacacggacctccaagccatcgaacagaccgacgccggcctgcaattgacggcacctgactttgagctgacgacggacctcgtgattagttcagcggggcggattccgaatgcggaccagttaggactcgaaaacgtcggtgtcacgtttaaccgtcacgggattcaagtgaacgatcgactacagacggctaatccgcatatttacgcgattggtgacgtgagcgatacgcccgtacctaagttaacgccagtagcgggttacgaagcgcgttacttagttcaacaactgacccagccgggagcggcaatcacgtatcccgtcatcccgacccaagtctttgctgcacctaagctagcacaagtgggccttagtgcgacggatgtggctgaccagccggataaatatcgcgtgaatacgctggatatgaccaaatggttctcttattaccgttttggcgcacgacaagcacaggccaaggtcattattgatcaggctagcgggcaagtcgtcggtgcgacactgttgagtgatgtcgcggatgaaatgatcaattacctgacgttactgattgaaaaacacgtcactttagcccaattacaacaactcgtattagcctacccaacaccagccagtgacctgcagtatctgtactag

SEQ ID NO: 615 - DNA, 726 bp, Unknownn
  isolated from dental, unidentified
atggaagaaggagtatttattatgaaaataatcaaagttaaagatcaagtagaaggcggaaaagaagcattaaaagtatttaaagaagctttagataatgaggtcaaagtattcggcttagctacaggtagtactccagaaacaacatacgatgaattagtaaaaagtgatattgatttttccagtagtatctctgtaaatttagatgaatatgtgggattaaagccagaagatgaacaaagttacgcttactttatgaaggaacatttattcaatgctaagccatttgcaaaatcatttttaccaaatggaatggctgaagatgctgatcaagaatgtgagcgctatgataagttgttagaagaatatcatgttggattacaacttttaggaattggacgtaatggtcatattggttttaatgaaccaggatcatcatttgatagtaagactcataaagtggctttgacacaatcaactattaatgcaaattcacgtttctttgacaatgaagaagatgttccaaaatacgcatattcaatgggaattggaacaataatgaaatctgacacaattttattagaagcatttggtaagaacaaagctgaagctgttaaggcaatgattgaaggaccagtaacacctgaagttccagcaagtgtactacaaaatcaccctgatgttgtagtaattattgatgaagaagcagcttcattgttgaaataa

SEQ ID NO: 616 - DNA, 780 bp, Unknownn; identical to SEQ ID NO: 95
  isolated from dental, unidentified

SEQ ID NO: 617 - DNA, 1371 bp, Unknownn; identical to SEQ ID NO: 287
  isolated from dental, unidentified

SEQ ID NO: 618 - DNA, 1677 bp, Unknownn
  isolated from dental, unidentified
atgaaaaaactaaatgttaaaaataatgagactgctgtttttgcaatcggtggtcttggagaaattggaaagaacacttacggtatccaatttcaagatgaaatcatcgtagtggatgctggtatcaaatttccagaagatgatttgttaggtattgattatgttatacctgactattcatatttaattgcaaatcaacaaaaaattaaagctttagttatcactcatggacatgaggatcatattggaggtattccttatttactacaaaaaataaatgtacctgtctatgctggccctcttgcacttgcattgatcaaaagcaaactagaagaacatggactacttcgcacaactgaacttcatgaaatagatgaagactctattctaaaatttagaaaaacgacagtatctttttttagaacaacacattctattcctgatactttaggtgtagctgttaaaacaccttctggaacaattgtatgtacaggagattataagttcgatcttactcctgttacaaatcagccacctaatttacaaaaaatggcaaaattaggtgatgaaggtgtgctttgccttctttctgatagtactaatgctgaagttcctaactttactaagtcagaacgctgggttggccgttctattcgtcgtatatttgaaaaagtcgaaggccgtataatatttgctacttttgcctctaacatttcacgtgtacagcaagctacatctgcggctattgctcgtggccgtaaaatagctgtttttggacgtagtatggaggctgcaattgtaaatggtagagaacttggttatttagatattcctgatgatgctttagttgatgctagagaaataagtagtttacctgctaataaaattatgattctatgtacgggatctcaaggagaacctatggcagctttgagtcgtatagctaatggtactcaccgtcaagtatctattcaacctggtgatactgtagtattctctagttctcctattccaggaaatactaccagtgtaaataaagttattaatgagttagaagaagctggagctactgttattcatggtaaagttaataatattcacgcctctggacatggtggtcaagaagaacaaaaacttatgcttcgattgatgaaacctaagtacttcatgcctgtccatggtgaatatagaatgttaaaaattcatactgagttagctgaaaagtgtgatgttcctaaagaaaattcatttattctaaaaaatggagatgttttagcacttacaaaggattcagcaagatatgcaggccactttaatgctggcgatgtctatgttgacggttctggcgttggagatataggaaatattgtacttcgagatcgtcgtttactttcagaagaaggtctagtagttgttgtagcaaccatagatatgcaaaaacgccaaattattgctggcccagatttattatcacgaggttttatctacatgcgtgaatctggcgatttaattaatcaaggtcgtcgtcatctttatcgttctattaagagagaacttaaaaatgataaagtttctgaaactcaaattaaaaatactattatctctgatctgcaagaatttttatttgagcaaacagaaagacatcctatgattttaccaatgcttgttacaatataa

SEQ ID NO: 619 - DNA, 684 bp, Unknownn
  isolated from dental, unidentified
atgagtttaaatttaggaagtgataaaatggcaataacagtttacattgtacgccatgggcaaacattattgaatcgttataagaagatgcaaggatgggtagactcaccattgactgaaaaaggaattcaagatggtaagcgagcaggtaaaatcctagaaaatattaagtttgataaagcgtatagttcagatacaatgcgtgcaattcgtacttgtgagtacattttaagtgaaaataaagtatcaggtgatttaaaagaaccacaagcaatgatggaatttcgtgaacaaaagtatggttattttgaaggtagtgattcaccacaaacctggatgctaattggtgcaacgcatggagcaggttcatttaaagaacttgtaaataagtatcctttagatgagattaaagattttatgcatgagactgatccatttcatgaaagtgaagatagtaagacatactggaagagaataaattcaggttttgactatctaagaaaaaatcataaagatggagaaacggttttattggtatgtcatggtagtacaattgccagtttggctgataaatatggagataatattaatgtcggagaaaactatcctcagaatggatcaattactaagttaaaagtaacagaaaatgatattgaaattgaagaatataataaaatagattag

SEQ ID NO: 620 - DNA, 1251 bp, Unknownn
  isolated from dental, unidentified
atgaaacaactatccatagatgaattaattgaacttcgaaaagagcccgaatggtttaaagctaagcgaaatgaagctaagcaactaattgaaactactaaattacctagtttccaaaagattaaatatcatgattggaacataaatgttgatggaacaactgcaattgataatcaacctgaatttgataccaatgctgatgtttatcaatatgcaagtgacaaagcacaaattaaactaccacaagaatttcttgataagggagtaattgttgaagattttgaggatgctctggttaaccatgaagatattatgaagaaatactttatggaaaaaggactaaaaatggacgataatcgtctattagcagaacatgtagcaaatcttcaaagtggtgttttagtctatgtacctaaaaatgtagatttagaaacaccattaacttgtgaatatatccaaaattcacgagttgaaggagattatgttcatcatgtattaattgttacggaagcaaatagttcgctatcttatgtagaacgtttaaaaactgatggtgataagagtaatacagccaatattgtagttgaagttattgccggtaatggaagtcgcattcactttgctagtgttgataatttaagtaagaacacaactgcctatatgaatcgtcgtggatacttacaaagagactctaagattgactgggcaatgggtatgatgaattctggtttaacaatcggtgattttgattctgatttagttggcgatggctctcatgctgaattaaaagtcgtaggtatttcaacaagtgatcaaattcaaggaatcgatacacgagttacaaatattggaaagaatacgatcggccatatcttacaacatggtgttgctttagatgcatccgaactaactttcaacggcattggacatgtaatgaagagaagtaaaggttctgatgcacaacaagaaagtcgtattttaatgttatctccacaagctagaggggatgctaatccaatcttactaattgatgataatgatgttactgcaggacatgcggcaagtattggtcgtgtaaatcctgaacaattgtactacttaatgagtcgtggcttacaaaaacgtttagctgaaaaattagtaattagaggtttcctagctcctgttttagatgaaatacctttgaaagaaattcgcaatgagtttagtgaattgattgaaagaaaggtaagttatgatgaagaaaactag

SEQ ID NO: 621 - DNA, 1488 bp, Unknownn
  isolated from dental, unidentified
atggctaatcaacaatcaatgaatgatcagttaagagttcgtcgtcaaaagatgcaagaattgcgtgatgaaggcgttgatccattcggtcatagatttgagcgtgatttcttaaacaaagaattacacgacaaatttgaagataagacaaaagaagaattaattgacttagatgttaaggctacaatcgcaggacgtatggtagcaaagcgtggtaaaggtaaggtaggctttgctgatttacaagataagacaggtagaatgcaactttacattcgtaaagatgaagttggcgaagaaatgtaccatatctttaaacgttcagatttaggagatttcttaggtgtaactggtgatgttatcaagactgatatgggtgagcttacaattaaagtaactaaacttactttcttatccaaagctctaagaccattgccagataaattccacggtcttcaaaacgtagaacaaatttatcgtcaacgttacttagacttaattactaaccgtgaaagttacaatcgttttgtaaaccgtagcaagattgttacagctgttcgtaattatttagatagtaatggatttttagaagttgaaacacctgtattacataatcaagctggtggtgcagctgcacgtccatttattacacatcataatgcattggatattcaactttacttacgaattgctttggaattacacctcaaacgtttgattgttggcggaatggaacgtgtttatgaaattggtagagttttccgtaatgaaggaattgatactaagcacaatccagaatttacaatgcttgaaacttatgcagcatactttgactttaaagacgttatggatgaaacagaaggtatctttaaagcagctgctaaagttgtaacatctgatggaaagattaactatcaaggaacggacgttgattttaataaagaattcaaacgtgttcacatggtagatctaatcaaggaaaagacaggagtagatttctggaaagaaatgtctcttgaagaagctagaaagatagcagatgagcataaagttcattatgaaccatactggcaagtaggtcatattattaatgaattctttgaacaattctgtgaagatacaattgttgatccaactttcgtttatggtcatcctgtagaaatttcaccattagctaagaaaaatgctgatgatccacgtttcacagatcgttttgaattattcattttaggaaatgaatatgcaaatgcctttactgaattgaatgatccaattgaccaacgccaacgctttgaagcacaagttgctgaacgtcaagctggtaatgatgaagctgaaggtatcgatgaagattatattgaagctatggaatacggaatgcctccaacagggggattaggtataggaattgatagattggtaatgcttctaacagatgcaccatcaattcgtgatgtactcctattcccaactttgagaccagaataa

SEQ ID NO: 622 - DNA, 1083 bp, Prevotella histicola
  isolated from dental, Prevotella histicola
atggttgatattattgaaaatataattaagaaggatggagtaacagtatatgttgtatatcctactcgcaaggaaacggctattgattatttagaaaaattaggtgtaaagacgatctatttacctttttataagctcaataaaaatggaagaaaaggaatgtggaaatatataattaagaaaattatgtcgccatttttattttttaaattaaggcagatagtaaagagagaaaagattagtattatttacagtaatacaattgtaatagattatggttttattttgagtaaaatggctaaccttcctcatatatggcatataagagaatttggaaaagaagatcatggcattgtgctaagaggtggagaaaaagccttatatcgtaagttgaatgaatctaaaggaataatctatatatcaaaagcgatagaggagaaatactctcctcatataaaaaaaggaatttttcaagaagtaatctataatgacatttcaaaggattttataaatagaaaaactaattttaatattgatcctgataattcattaaaggcgactataatcggaactattcaagaaggtaaaggccaattagtagcagtaaaggctgtagaaaaagccaataaattaggtgctaaaattgagttacatatatgtgggaaaaaaataggatcttattacaatgaggtaaacaattatgtgaaagatcataaattatctgatcagatatactttgatggtttcaaaacaaaaatgaatgaatatcgttctgatatggatattggaattgtagcatctaaaagtgaggcttttggaagagtaacagttgaaggaatgctcagtaatttagcaatgataggtgctgatagtgctgctacaagtgagctaataacagataatgtaacaggtttattgtataagaatggagatattgatgaattagctgaaaaattagtgtacttatataaagacaggaagaaactgaaagagttagctatcaatggatttgattttgcaaagaaatttacagaaggaaacgcagcaaatgaaatttatgatatgattactaaactgagttaa

SEQ ID NO: 623 - DNA, 600 bp, Unknownn
  isolated from dental, unidentified
atgaaacttattttgctaaaattgaaaggaagatataaaaaaatgaaaatgattgtaggtttaggtaatataggaaaaaagtatgaaggtacaagacataatgttggatttatggtagtagagcgttttgtggaagaacatggtggaaattttaacaaagaaaaatttgattcattgatagcagagttatttattaatggtgaaaaaataatagtaataaaacctacaacttatatgaatgaatctggtagagctgttagaccattgatggattattttaatctaactactgaagatattattatttgccatgatgatatggatttggaaattggacatttacgtttacgacaaaaaggatctgctggtggacacaatggaattaagtctattatttcacatgtggggactgaaaaatttaagagagtccgtgtaggaattgatcatccacaaaaaatgtcagtggtagattgggtattatctagatttactaaagaacaagaagcaaaattagatgatggattaactagagctgttgctgctttagatgattggatagaaaatgatgattttatgaatacaatgaatagatttaactag

SEQ ID NO: 624 - DNA, 495 bp, Unknownn
  isolated from dental, unidentified
atgaaaattactcgtcatgacgaacctctatcaactaacggaactcctgtagatgttaatggagttttcccagaatttacagttcaaaatgccaaaggtgaaaatgtaagtagttctgatttattaaagaaagtgacatttatcagtgttgttcctgacatcaacactagagtatgtagtatttctactaaaaagtttaaccaagatgtagacaaatattccaacatcgctttctatacagtttctacaaacacaattgaagaacaagcaaattggtgtgcagctgaaggcgttaagaatatgcaacttctttctgacaaagctttcgattttggcaagaatgctggtctttatgttgctgataacgatactgatgctcgcagcgtttgggtattagataatgacggtaaggttctatatcgtgaattagttattgaacaaacaaatgaaccagactatgaaagtgtactacaatttttagatagtctagcttaa

SEQ ID NO: 625 - DNA, 888 bp, Unknownn
  isolated from dental, unidentified
atgcagattaattggatttattcggaagatgttagttgtaagttgaaaactttcttcaaaaaacaaggaatatctagaagattattagctaaggtcaggtattctgacggaaagattttgataaatggtaaatccgggcgtaagatagataaaataaaaaagaacgataaaataactttagttgttccagacgaagagtttagacggaacgttccgccatcatttgtaccaattaaaattttgtatgaagatgataattatcttttagtagacaaaccggcttttgtagcgtcaattccttcacctttgcatcctaatgactctttagttaatcgagttgtaggttattatcaaattcgaggatatcgtggaattatcccacatattgtgactagactagatagggatacgtcagggattgttattttcgccaaacatcgctatgctcatgctttactagatagtcaattaaaagagcataagattagcaagacatatacagcaatattgagtggaattttgcataataatcattatataattgatttacctattggtagagatagtacaagtttaattaaacggaaagtactattctctgaaaaagctaagagaagtaaaactgaaatttttgtaaaagagagaataagagacaatacactttgtaaaataaagttgcatacaggtagaacccatcaaataagagtacattgctcctatttaggatatcctttggttagtgatactttatatggtggggctatttctatgccactacaacgtcaagctttacattgtagtgaggttgtattctgggatcaatttagttctcagtatataaaagtaaagagtaatattttccaagatatgatgaattatttaaagtga

SEQ ID NO: 626 - DNA, 504 bp, Unknownn
  isolated from dental, unidentified
atggaaatagattcaattgtaaattctctcaaaacaatgtctcaagttagtaactataaaatttatgtttctggatctttaccaatgaatgttggttttcgattaaaagctaaagcaactcaggctgatttaaaaaagtttgataaaattaattactctcttcccaacgattatttagcctttataagtcaaataaatggtgcagagttatttactgatggacagtatatccaaaaatgtaaaatctattcgattcaagaagtattacattggcgagaatttttaagaagctcaggattttacccggagtgggataaacttctcccaattctagaactacaagatatcggtcaactaatacttaatttggaacgatatgaaaaccaagaagattatttattatatcctgatgaatcaaataaatatttccacattggctttactgaatggttgaataattatttactaacaaacggtagcgaattttggtatatgaactcataa

SEQ ID NO: 627 - DNA, 717 bp, Unknownn
  isolated from dental, unidentified
atgaaagacacaaagaagttatttcaacatggtacattagccttacttgttccaggattatttgatggtacattacctttaggttccttactagaacatggtgatacaggaataggaacagctacaggattagatggcgaaatgattatacttgatggagtgccatatcttgtacgtagcgatggtagtgtaaatgtattagatgctaatgaagtaaaggttccatttgcaaattcccattttgataatccagaaatagaatttgatgttactgatgcaactcctgatcaattaaaggatatgattttctctaagtataatttgaagaatgttttctttgctgtaaaagtaaagggaaaatttgattatataaagacaagggctgttgaaggacaaaagaagccttatccaacattgacagaggtggcagataagcaagctatttttgaagaaaatgatgggcaaggaacaattgtaggatacttttctccagaattattccatgggatggcttcagcaggtttccacttacattatttaaatgatgcacataatttgggtggacatctgttggattacaagataaaagaagcaaaggtttatttgcaagtgtttgaaagtgtagaaacacattttccagttgaaaacgaagattttatgaaagaagaatttgatattgatagtttacgtgcatcaatatcatctgctgaaaagtag

SEQ ID NO: 628 - DNA, 699 bp, Unknownn
  isolated from dental, unidentified
atggtatcacctgtttatatacagattcataatcaaataaaaaaagatatagaagctggtaagtggaaaataggagaaaagattccatcagaaagagaattagctgaaaatttttctgttagtagaatgactttacgtcaagctattcaaactttagtggacgaaggaatccttgagagaaaaattggttcaggaacttttgtggcaagaaaaaaagttcaggaaaaaatgtctggaattacgagttttacagaaattacagaagctcaagggaaagtaccaactagtaaaactgtttcttatttaattactattccctcactaagtgaaagtgaaaaattgaatttagatgataatcagaaagtcttaaggatggaaagaattagatttgctgatgatgtgcctatttgttttgaagtggccacagtaccattagaattggtaaaggattatgacaaaactcagattacttcatctttatatagaactttagaagaaaatgggttaattattggccatgcccaacaaacggtatctgctatgttagcttcagaaagaatagcggactttctacaattaaagaaaggtgatgctattttaaggttaagacaagtttctttcttacaagatggaagtccttttgagtatgtacgtactcagtatgcaggtgataggtacgagttttatttagaaaaatag

SEQ ID NO: 629 - DNA, 918 bp, Unknownn
  isolated from dental, unidentified
atgataacgcgtcaagaaataaatgggaagtcaccattaaattatagttggtacgatattaaaaatattgatgataacgacattgtaaaattgaaaaaaaggtttcattttacgccgactattatctcatatgttgccgatagaaatgaacgtcctcactatgatcacgatagtttaactcatagtgaattaatagtatacgatgttcctgtttggccagaagaaaaatctgatcattttacgactcgtcctctaattttcctattacaaggaactacagtatatactttccacactaatgctactgaggatatatttgaagagtttaaagaagaacgagctcacgaggcacaagatgctacggaatttatcatgctattcttacttcatgtaactcaatatttccaacgagctctaacacaattaaatcatcaattaaatgagttagatagaagattgaatactaaaattaaaaataaagatttattggaattagcacaaatggaaagaagtttagtttttgtttcaagtagtgctagaactaatttgatgatgttagaagatttgaagaacacaccgatgtcttggcaaattactaagtcagctcaagaaagattagatgatgttttaattgaagctgagcaggcctcaagaacggttgaaatttctaatgaagtgacagaaaaaatttctaagacatcaaataatatcttgaataataacttgaacgatacaatgaagttcttaacagtatggtccttgattttaactattccaaccattattacaggtttctttggaatgaacgttaaattaccaattttaaataacggatttgactggattttggtagttttcgttaactttttattgatgggtggattatatctctacttgaaaaagaacgattttatttaa

SEQ ID NO: 630 - DNA, 2178 bp, Unknownn
  isolated from dental, unidentified
atgttggatttaaaaacagataaaaataatataaaaataataaaagaagtaccaagttacttcgttaaaagagatggagcaaaattttcctttgctttatataaattaaaattagtactaaatgcaatggatttatcgggtaagatccaagaaaatgtaattagtggaatactaaataaattagtaggaaaagacgaagtaagtgcacaggaagtggcaactgcttttgtagatacgctaaaagagctagatttagatgataaagctcaagcttacatagaatatcgtaaacaagatgaagaaaaatgggaagaacaaacaaatccaacagagagactagctagacttcaaggaaaggatccaagtttagttcacgaaaatgctaataaggatagtaaagtttttaatacgcaacgtgatttaacagctggaactgttggaaagacactaggcttgaagatgatgcctgaacacgttgctaaggctcatttacgtggtgatattcattatcatgacttggactacacaccatggagtcccatgactaattgttgcttaattgactttaaagaaatgttgacccatggatttaagattggtaatgcagaagtggaaagccctcattctattcaaactgcaacagcacaaatggcacaaatcatcgccaacgttgcttcttctcaatatggtggttgttctgctgatagaattgatgaagttttagcaccatttgcgatgaagaattatcacaagcacttgaaggaaagtgaagaatttatcactgatgaggataaaatcaaggcttttgcagttaaaagaactaaaaaagatatttatgatgcgatgcaagcattagagtatgagattaatacactattttcatcacaaggtcaaacaccatttactactttaggttttggcttgggaacgtcatgggttgaaagagaaattcaaaaatcaattttgagaattagaattgctggattgggtaaagaaaagagaactgctatttttccaaagttggttttcacaatcaagaaagatgtaaatttgaagcctgaagatcctaactacgacatcaaagaattggcagttgaatgtgctactaagagaatgtatcctgatgttttaatgtacgacaagattaaagagttaacaggtagtttcaaagcgccaatgggttgtcgctcattcttgcaaggttggaaggatgaaaatggtcaagaagttaactctggacggatgaatttaggggtagtaacagttaatttaccaagaatagctttaaaagctaatggagataaagatctattttggcaaatttttgatgaggaaatgcaagttgctaaatccgcattagttttcaaggttaaacgagtattggatgctagtcctgaaaatgcacctattttgtatcaatttggtgctttcggcaagagattaaaaccagatggaaatgtagatgaacttttcaaaaatggtagagcaacagtttctttgggatacattggtttgtatgaagtcggaacaagtttctatggtcctgattgggaaaataatcaagaagctcatgactttactttacaaattgttaaagagttaaacttaagatgcaaagcttggtctaaggaatataattatcactttagtgtttattcaactccaagtgaatcattgacagatcgtttctgcaaattagatacagaaagatttggtaaggtaaaagacattacagacaaagaatactatacaaatagcttccactatgatgtaagaaagcatccatctccatttgaaaaattgacttttgaaatggattatcctaagtatgcttctggtggattcatccattactgcgaatatcctaacttgagacaaaaccctaaggcactcgaggctgtgtgggactgggcttatgataagataggttatttaggaactaatactccaattgataaatgttataagtgtggattccagggtgaatttaaaccaacagcacgtggttttgaatgtcctaagtgtggtaatcatgatcctaagacatgtgattgtgtaaagagaacttgtggttacttaggtaatcctctacaaagaccaatggtacatggtcgtcacgttgaaatagcatcacgtgctaaaaatttaatgaatggaatggcagaagatgaacaataa

SEQ ID NO: 631 - DNA, 1107 bp, Unknownn
  isolated from dental, unidentified
atgcaaggaaaaacaattggaattatcggtggaggacagttagggcaaatgttgtcattttctgcaaaaaaagctggaatgagagttataatcttggatcctaatccagattgctcagcgggacaagtttcagatgaacagattgtagcaccttatgatgatatagatgcaatagaggaactagctgataaggccgatgtattaacctatgaatttgaaaatgttgatcttaacgcattagagaatgttagtagcaaagtagaaatccctcaaggtacggaattattaagaattactaaagatagaataagagaaaaaacttttttgcaaaaaagtgggttaaaagtagccccatttgctgagataaataaattttcagatttagaaaaagagataaatgaaataggttatccagcaatcttaaaaacatgcgaaggagggtatgatggtaagggacaattagttctcaattcagaaaaagatttagttgaagctgatgaaattataaagttaggacaatgcattttagaaggaaaaataaattttcaaatggaatgttcggtaatggtaggaagaaaccttagaggtgagattactgtatttccagtaagcgaaaatatccatcgtaaccagatattacatgaaagtattgtaccagctagaatttcaagtgaattacaagaaaaagcaaaagaaacagctgtaaaagtagctgaaagtttgaatttgtgtggaatcttaggaattgaaatgtttataggcgaggataatgagatttacataaatgaattagcacctagaccacataattcgggacattactcaatagaagcatgtaatttttcacagtttgatattcataatagagctatatgtaattggccattacctaaaattgagctattaaagccagtagtgatggtgaatgttttaggacaacatgttgagaaaacacaagaattgatatcaaaaaaacctacatggcaattccatgattacggtaaaggtgaaattcgtgttgatagaaaaatgggacatgttacaatattaacagatgatataaataaaacacttgatgagattgtatcaactcatgtatgggattaa

SEQ ID NO: 632 - DNA, 993 bp, Unknownn
  isolated from dental, unidentified
atgtcagtattagttttaggtggtgctggatacattggttcccacaccgtagatcgcttagttgaagcgggtaaagacgtggtcgtggttgatagcttggttacaggtcatttggctgcggtacgtaaagaagcaaaattttatcaaggggatttagcagataaggattttatgcgtaaagttttcactgaaaatccagatattgatgcagtaattcactttgcagcattctcattagttgcagaatctatgaaagatcctttgaagtattttgataacaatacagcaggtatggttaaacttcttgaagttatgaatgagtttgatatcaagtatatcgtcttctcatccacagctgctacatatggtattcctgaaaaaatgccaatctatgaagatgatccacaacttccaatcaacccatacggtgaaagtaagttgatgatggaaaaaattatgcgttgggcagatgaagcttacggaattaagttcgttgctttacgttacttcaatgtagctggtgcaaagccagatggatctattggtgaagatcatcatccagaaacacacttattgccaatcgtgttgcaagtagcaatgggtgaacgtgaaaagttacaaatttttggcgatgattacaacactccagatggaactaatgtccgtgactacgtacatccatttgatttagcagatgcacacattttagcagtggattatctacgtaatggtaacgaatcaagtgcctttaacttaggttcttcaacaggtttctctaacttggaaatcgtgaaggctgctcgtgaagtaactggtaaagaaattccagctgaaatcgcagctcgtcgtggtggagatccagatacattgattgctgcttcagaaaaggcacgcaaagttctaggatggaaaccagaattcgatgatattcacaagattatcgaaactgcttggaaatggcatacaactcatccacaaggatataacgactaa

SEQ ID NO: 633 - DNA, 1722 bp, Unknownn
  isolated from dental, unidentified
atgactaaggttttaaacggtatcgcagctagtgatggtattgcagctgctaaagcttatatgctcgttcaacctgatttatcatttgaagaaaaaactattgataatccagatgctgaaatcgaacgtttaagtgcagctgttgaaacttccaaacaagaactcgaagtcattaagcaaaaagctactgaaaatctaggtgctgaagaagcacaagtttttgaagctcatttgacaattttatccgacccagaattatttggacaaattaacgataaaattaagaatgataaagtaaatgctgaagctgctttgaagagtgtaactgatatgttcattcaaatgtttgaagcaatggaagataatgcttatatgcaagaacgtgctggtgatattcgcgacgttactaagcgtgttatgggtcacttgttgggagtatctattcctaatcctgcattaattaatgaagaagtagttattgttgctcatgacttaactccttccgatacagctcaattggatcgtaattttgttaagggattcatcacagatattggtggacgtacttcccactctgctattatgtctcgtacattagaaattcctgcagttgtaggttctggtaatgctacaagtgaaatttctgaaggtcaaatggttattattgatggtttagatggacaagcattagtagaaccaactgacgaagaattagaagattacaaggctagagcaaaagcttttgctgatcaaaaagcagaatggaaattattgaaggatgctaagtcagttacagcagatggtaaagaagttaaattagctgcaaacattggtacacctaaagatgttgaaggtgcaaatgataatggtgcagaagcagtcggcttattccgttctgaatttctttacatggatgcttctgaattgccatctgaagaagatcaatttaaggcatacaaagctgctgttgaaggtatgaatggtaaacaagttgttgttcgtacaatggatattggtggagataaggaattaccataccttccattaccagaagaacaaaatcctttcttaggatatagagctattcgtatttctttagatcgccaagatattttccgcacacaattaagagctttgttgcgtgcatctcattatggtagcttagctatcatgttcccaatgattgctactgtccaagaatttaaggatgcaaaagcaatctttgaagaagaaaaagcaaaacttgttgcagatggtgttccagtatctgatgatatcgaagtaggtatgatgatggaagttccagctgctgcaatggttgcagataaattagctaagtacgttgacttcttcagtattggaacaaacgacttaatcggttattctatggctgctgaccgtggtaatgaaaagatttcttacctataccaaccatataacccttcaatcttgagattaattaagaatacaattgaagcatcacacaaagaaggtaaatggactggtatgtgtggtgaaatggctggagatcaagttgcagttcctatcttattaggattaggtttagatgaattctcaatgagtgctacttcaattttgaagacacgtagtttgttgaagacactagattctaagaagatggaagaattagctgataaagcagttaatgattgcgaaacagctgatgaagttgtagaacttgtaaatcaatacacaaaataa

SEQ ID NO: 634 - DNA, 1380 bp, Unknownn
  isolated from dental, unidentified
atgttttcgaaagtattagtggctaatcgtggagaaattgcagttcgtattattcgatcacttaaagaattgggcataaaatcggttgctatttattcaactgttgaccgagaaagtttacatgtacaattagcagatgaagctgtatgtgtaggaactgcccgtccacaagattcatatttaaacatgaaaaatattttagcagctgctattggaactggtgcggaagcaatccatcccggttttggtttcttatctgaaaatagtcaatttgttgagatgtgtgaagctgtaggtataacttttatcggccctaattctgaaataattgatttgatgggaaataaagctaatgcaagagaacaaatgcaaaaaagtggagttcccgtgattccaggaagtgaaggtttcatcgaaactgttgaagaagccaagaaagttgcaaataaggttggatatccggttttattaaaagcagcagccggtggtggtggcaaaggtattagaaaggttaatgacgataatgaattaacatcattatttgaagaggctaagcgcgaagctcaagtatctttcggtgataaaagaatgtatctagaaaaaataatgacaaatgtaaagcatattgaagttcaaatttttcgtgataagcaaggaaatgtagtttattttcctgaacgagattgttcagtacaaagaaacaaacaaaagatgatagaagaaagtccatgccttttaattactgaggagcaaagaaaagagctaggaaatatagcaataaaagcagcaaatgctattaactatgttaatactggaacaattgaatttttaatggatagtcaacataatttttattttatggaaatgaatacgcgtattcaagtagaacatacagtgacagaaatggttacaggaattgacttggtaaaagcccaagtaaaagtggcttctggagaaaatttaccatttaatcaaaatgatattcaaattaacggaagtgctattgaatgccgtatcaatgcagaagatccatctaagaattttatgccacaggttggtaaggtgcgttatttgtatttcccagtaggaaatttgggaatgagaatagattctgatttgtatgcaggttgggaaatcactccattttatgactcaatgattgctaaagtaatttctttaggtcaagacagacatgaggcgattgaaaaagtaaaacgcttattgagtgagatgttaattacaggagtaaaaaccaatcaatctttctacttagatattttaaaagataagaatttcttagatggtaaagttactactgaatatttagaacagaattttttacctaaatggaaggaagaacataaagatgcagctatttga

SEQ ID NO: 635 - DNA, 3102 bp, Unknownn
  isolated from dental, unidentified
atgaaaccattaaagttaagaatgaagtactttggaccatatattgatgaaacaatgaattttacagagtttgataatacacctctatttttaatcagtggaaaaacaggtagtgggaaaacaaccatttttgatgctatgagttttgctttattcgatcatacctctggtgatgaaagagacgctaagcagatgagatctgattttgctacacctaatgatgcaactgaagtgacatttatatttgagcataatggaatgaaatacacagttattcgtagtcccaaaatgaatttagctaaaaagagaggaaatggaactagggatgttgaggcttctgtaaaagtaaaatatatcaataaagaacaagaaaatatcgaaattactaaaaaaaatcaggcagataaatttttacgtgacttaatcggcttggatgcacagcagtttacacaaattgttttattaccacaggggaaattcagaaatttcttaaatgctaatagtgctgatagggaaaagatattaagaaaattatttggaacgagtctatatcaaaaatggactgagaaaatccaagaacaagcaaaaatcattgaaagtgaaaatgaaaagttaacgacacaaatacaaacaatccgacaacaagtagaaattgaagataatgatgaaattaatgatgaagaatggatagttaaagttagtaaccaaattgaagaaaaaaagaaaaaacaagaaaaagtaaataacgatataactattagtcaaaagcaacttgataacttggttgagacttatcaaaatgaaaaagtattagcagatagtattaagcaaaaagaggactatatacataaactacaatctctagaaaataatcaagataagattgaatcaaagaaaatttacgcttataaattggcttggtatcaaaaaaatcaacaaatatttaacaataaaactgatttagaattacagataaaagaaaaaagtgacaaattggtattactaaatcaagaaagtaaatttttaattcaaaaacatgaatctgcaaaaatagaagcccaagagctagaaaagcaacaagaaaatattgagaatctaaaaaataagatttcaacattagaagtaaaattaccaatttatcaagatgtaaaagtaaatcaagaaaaattggataatttggataagaatcatcaagatactaaaaataggcttgataattcagtaaaagaactagaaaaacaaaaagtaagctataatgatttagaaaaagaactagctaagttagaaaatttagatgagaaacaagttgagttggttaatgagaataataaattaactagactgagcgaaaaaatagatttagtagatcatttagatagtgagattgaatcaaagaaattacaaaaagaaaaattagaaaagaaatatcaagaacaggaagaattagtacaagaaagtacagatactgaagaaaagttaaatactttgtggataaaaaatcaaatttactttcttgctaaacaattagcaccaggagaaccttgtccagtatgcggatccaaagaacatccattaccagctaaaatagatgaattggaacaagtaactgaggaagatgtaaaattagcgaataagaaagctgaaattgaaagatctaaagcaaaagaatttaagttaagactaacatctataacagacgaaataacagaattagaacaaaataaaaaagaaagcatagataaaatattacttgattttgaactaggagaaaaacattctttattagaactacaagaaatatttcagattaaaaatgatgagtatcagaaaaaagcaaaagatcttgaaaataaagtcagcttgaaagaaaagttaaaaggtgacagtcaattaataaaaaatgaaatagctaatttagagaaagaaaaagataaattaaaagaacaatatgatgatgtatattatcgcttaaaaatgaccgaaactactctacaagaacaaagaaagcagttgagtcctgaatttgaagatgtaaaacaagttgaagaatatattacagatactaaaaagagagtggaagattatcaaataaataaggataaaatcactaaagaacttcaagatactaaagcagaattaattaaagttcaagctgatattgatagcaatcatcaagaattagaaagtaagaaaaaaggactaagtaaaattaataaggaaataactacattaatagaaaatagtgagattaatttagaagaaatagcttccttagctaaggatctagcacgattagattctattaataatgaaattaatagttatgaaaaacaaatattaatagtaaaaataaaaatatcggaattggacaaaacaattaataatagagaaatgccaaatttagttgaacgtaatagtgtgattgctgataaaagaaaagaacttctaacattccaagcagaatttagtgatattacaacggaaattaaccatatacaaaaaataaagcaagaagtagaacaattactgcaagaacaaaaaggaaattataagttaatggcagaatggaaacaattatcagatgtaatgactggtaaaagtgctactaagttaagtttggaaagatatgtgttacaaatgtaccttcaaagagtgttgaatgttgctaatggacgtttgaaagaattaactcaaggaagatatagtttccaaataaaagatgaaaaaggtagttatagtagtaatacaggattagagattaatatatacgatgacaatgctgggaaagttagaccagttcaaactttatcaggtggtgaaagttttattgctgctttagctctagcactagctttaggtgaggttatccaagctaatgttggtggaatatttgtggatgctttatttgtagacgaaggatttggttccttggatagcgatgcattgcagatagcattggaagccttgcagacgattgaaggaaaaaatagaatgatagggattatcagtcatgttaaagaattgcaagaacaaataccattccaagtaaaaatatctagcaattatggaaaaagtaagataagttatagaaaggacttctaa

SEQ ID NO: 636 - DNA, 996 bp, Unknownn
  isolated from dental, unidentified
atgaggtggtttaatttgaaaaacatattaatactacatactggtggaacgattgcaatgtctgaagatcaaaatggtgctgtatctcccgattcttctaatcctcttaatcaatttgccaatccttttgctggaaaattaaacttaattactgaagatattttcaattatccttctccacatattggacctaaacaaatgcttttactggaaaaaagaattttacgtgctgctgatgaaaacattgatggtgttgttatcactcacggtacagatactcttgaagaaactgcttattttttggatttaaccattcctagtaaattccccatcgttattactggtgcaatgcgatccgcaaatgaaattggatctgatggtctacataattttcaaactgctattcaaactgctgctagtgatgaagcacatggcaaaggtgttttagtagtaatgaatgatgaaattcatactgctagatatgttacaaaaactcatacaactaatgttgcaacttttagaactccaacttttggaccaattggtttagtatctaaacataaagtttcattttttgaagagttacttagacatactgccttacctatcaaagatgtcgtaaatcatgtgtatttattaaaggcatacgctggtatggataatgaactttttgatttcattgctagcgatacaagtaatgctaatggtttagttatagaagctcttggtgctggaaaccttccaccacacgtacttcctagtttaaagaaaatcattgataaaaatattcctgtcgttttagtttctagatgttttaatggcatcgctgaagatgtttattcttacgaaggtggcggtgttcagttaaaggaaatgggcgtcatattctgccaaggattaaatggtcaaaaagctcgaataaaattattagttggcattagtgccggcttgaaaggtaaagatttggctaattttgttagcgatgcaatctcataa

SEQ ID NO: 637 - DNA, 678 bp, Unknownn
  isolated from dental, unidentified
atgacactaactaataattattcagaaaaatatataacagacaaaattattcgctttggagctgagacactaactaataaagagttattgcaatttatattaactactaaagtttcacaaacatctgttaagaatgtgattaaggatttttttgatgagcaccaaagattaaatgaactacaattttttagtgatgagggactaaaaaatttgtgtaaggatgatgaaaaagtcgctataattagagcactaagagaattttcagaacgctataaggaaaaagaaggattagttttggggcaaatcttttcaagttgtatgtttggaaattatatgatagataaaattggtgatagtaagcaggaattgttggtatgtgtatgcttagatactaagaatcaagtattgagcgaaaaagtgatttttaaaggtacattaaattcggctacggtacatccaagagaaatttttaaacatgcattaaattttagttgtgccagaattttagtagcacataatcatccaagcgggaatgtcgaaccctcagaaaatgatattcaattaactaagagattgattaatgcaggaaagatgattggaattgaactaattgatcatgtaattgtaggttctgaagtgtatttaagcttagcagaagaaaaaatagtcgaattttaa

SEQ ID NO: 638 - DNA, 1356 bp, Unknownn
  isolated from dental, unidentified
atgaaagttattgttgtaggttcatcacacggtggttacgaagcggttgagggtttattaaaagattatcctgacgcagaaatccaatggtatgaacaaggcgacttcctttcattcctatcttgtggtatgcaaatgttcttagaaggcaaggtcgatagtgctgacaaagtacgttatatgacacctgaagccatcagagaacgtggtgtaagtttgttcgaacaaacacaagtatttgctttacacagtgcagatcacgaaattgaagttaaagatttacaaacaggtgaagttagaactgaaaattatgataaattaattctcagtcctggtgccgttccaatggaattagacgttcctggcaaaaaccttgaaaatgtctactatatgcgtggacatgattgggcagttaaacttaaagaaaaagttcttgataacaatgttaaaaatgttgttgttatcggaagtggatatattggtatcgaagctgccgaagtatttgccaaagcaggtaaatcggttgaagtcctagatatgttaccacgaccattagctacatatcttgataaagaattgactgacgtaattgaacctgaacttactcaaaacaatgtacacgttcatggcaatcaactcgttcaagaatatttaggcgaaaataccgttacaggtgtaaaaactgataagggtgaatatcctgcagatttagttattgttgcggctggtgttaaaccaaatacagcttggctgaaaggcgaacttgcaatgtatccaaatggaatcgttaagactgataactttatgcgttcaagtgcggatgatgtatttgtagttggcgatgcaaccttactcaaatacaatccaggaaatactttattgaatatcgctttagcaactaatgctcgtaagcaaggtagatttgcagttaagaatttagaagctcctctccatcctttccctggagtacaaggaacttctgcattatcagtatttgattataaatttgcttcaagtggattgaatgccacaaatgctcaaaaattaggtaagcaagtacgttcagtagtagtcgaagatgatttcagaatggactttgttcctgaagaagaaaatgctcatgtttggttcaaattgacttatgatccagatacaaaagctattttaggtggccaaattctttccaagcatgacttaacagcttacatcaatgttatctcacttgcaattaaaactaagcaaacaatttatgatctagcttacgaagatttcttcttccaacctggtttcgataaaccttggaacattttgaacttagctggtttagctgctgaaaaacaagaagatgaagactaa

SEQ ID NO: 639 - DNA, 1275 bp, Unknownn
  isolated from dental, unidentified
ttgaaacaattaattgttctaggaaacggatttgatattgcctgcggattgaaaagctcttattctgacttctttttaatgcgttttaatgagctcttaggcactcaatgcaaagattttaaggagatgacgcctcacctagagaacaaaagaaaccatattattcagagcattgaacggacaaagaatagcattaatttttcaccagacgaaaatagagattgtgactactttaaggtgaactcaagtaagtggtcggaaaaagttgatttaaatagatgggatatattcttcttatttgctgaatcatgggtaggtaaggatgttggcttatacgaatggcaagatgtggaatcaataatttatgaagtcatatcgattgcattgggctgtaaatatgaatcgaagatatcatataaagacgaagtagatcttattgggggttcacagcatgggaaagaagcttttgcaaagctggtttacaacatctcttatgtagattataataggcattctgaaatttccgtggaactgtttagtgaattaaagaaatttgaaaccatattcagcagatatattgctaatcagtttagtattgatgattgtaatagcgagtatatcaaatcagcaatcagtctatatgaaggtatttctcagtattcggagaataaaaaaattactgagaatgaccagatagatgttctaagctttaactattcgttggatgaaggatttataaaaactatagataaaaaaataaacgatgttcgattaaaatcttggtctaatatccatggaattgcgcatcatagtgtgacaccgtactatccttctccaatttttggaattgataatcatggtattgtatctcaaacaaatcaggatgagtatagaatcttatttactaagccctatagagttattgatgaaggaataaatgaaattagatattcaaatggttatgtggctaaggatctaatttcaatatatggacattccttaggtagagcggattactcctattttgaaaccatatttgatgaaaataatttgtattcttctgattgtaaaatcaaatactattattatcctggaaaagatgaaattgaaaaagtgatgaaacgtagggaagcaattactaaattatataatttgcttactgactatggacgaacattgagtgcagcacatggtgctaatatcataaataggcttaatttggaaaatcgaattagcgtaattccgtctgatatttttcaaaagaagaataggtaa

SEQ ID NO: 640 - DNA, 2010 bp, Unknownn
  isolated from dental, unidentified
ttggtatatgcagataatataaaagttaacggagatttactgacattaacaggaagatggttagaaggaaaacaacagatatgtacttattattatttaaaatctaaagcagagcagaattatttcaaaaaacaaataaatagtgatgtatatactgtaacaggaaaaattaaaggaatttctcctcctactaatgaaaatgaatttgattataaaaaattttgtcaaagtaaaaagatatataatggtttaactgttaaacatataagtttagaaaataataaagttccctctaaatataaacttttatgtaaattacatgatttaagaaaaagtataatatgttatctacaattatttcctaagtatttacgaggatattcaacagccttagtagtaggatatagggatgatggatttgatgatataaatagtagtatcaaagaattaggcttattatatcttttcagtttatcaggaatgcatgttttttatttagtgaaaattctgcaaaaattagcacaaatactacggataacagcagagacggtagatatgtggttgattatttgtctgcccatatatatgattttagcaggttcttcatcaagtattatacgtgcagtatttatggtatggatacctatatttagtagatattttttatcaataaagatagataaattaacttcatggtcattgatgataattataaacctattatattcaccaatgatattattcactatggggatgcagttaagctatttgttgacgttagttttaattctaaatgaggaagaaaatagcataaagattggtataaagatgagtggatatagtataccattaatgttatggcatacatatcaatggaatgtactaactacttttctatctatatgcattattccaatttttgaatatataattctaccatttacaataataggagtactattaaatgtcttctcaaaaattagtaatactattttgtttttaatttcgatcttctttgagaaattagcagatagttcacctatgataatttttgggaaaccgtatctaacggtagttatactattgctatcacttatgatctgtttagaagttagcaggagaaaaaatgtaattatttatctacaagtattggtatatattttttcatatagtcaaatacatcgaaataaagacgaattagtttactttgacatcgggcaaggtgatgctactctaatcagagaaaaaaataataatcaagtaattttagtagatacaggtggaaaagttagttttaagcatgaaaaatggagaagtaggacaagccagactagtggcgaaaggattatagtcaattatctgttaagtaaaggaattaattcgatagataagctttatttaacacatcaagatgcagatcatgttggtaattttccaagtattagtcaaaaaataaagatcaaaaaaattttggttcctttaggaatggagaaattatcaagttttaataaaagattgaatgaatcgaatatctgtaataataaagtggtagagcctattactgatactagtgatttttctaaagaaagaatagatattttacatccatttgttgaaggaaaagggaaaaatgaagattccatagttctaaaatataacatgaacaaactaatttttttaattacgggtgatttagatcaagaaaatgaaataaaagtaatagaaaagtaccctgatttacggtgtgatattttaaaagtagggcaccacgggagtaaaacatcaactgcagatcaatttgtaaaaagtttaaaacctcaatatgctattatttcggtaggtcttaataataggtatggacatcctaatattgaaacattgaggacattaaatgcaaatggtattccatatttaatgacttccgataagggaatgataaaagtagtaaatatgtctaaagacaaattttgtatgagtactaaatatggaaaaatattaattagaaagtga

SEQ ID NO: 641 - DNA, 2019 bp, Unknownn
  isolated from dental, unidentified
atgtcacaaaaagatatagagatggaattaaaagagcttcgtgataagttaaatcgctggagtaatgaatattatgtgttggatactccatctgttgaagatagcgtgtatgacaaacattatcaacgtttattagagctcgaacaggctaatcctgatttagtgactgcggactctcctagtcaaagagtaggtggtaaagttctaagtggctttactaaagtaagtcatgatattccaatgttgtcattaggcgatgtattttctaaagaggaattaatagaatttttagagcgtttagaaaatagtgtagagcagaagttggattatagttgtgagttaaagattgatggtttggctatttccttaacttatgagaatggtaagtttatcaaggggtcaactcgtggtaatggggtaatcggtgaagatattactgaaaatctcaaaactatcaaggcaatccctatggaattaaatgaacctgtgtcaattgaagttcgtggagaatgttacatgcctaagaaatcttttgtggaattgaatactaaacgtgaagcagaaggacaagctgtttttgctaacccacgtaatgcagcagcaggatctttgcgtcaattagatacaaaaataacagctagtcgaaacttgagtacttttatttattatttaatggaacctgaaaagttggggataaaaactcaaactgaagccttaaacaaattagagagctggggtttcaaagttaataatgaatctaagcaagttaaaacaaaagaagaaatatttgcttatattgataaggctactgaccaaagagctaatcttccatacgacattgatggaatagttctaaaagccgaatcctttgcagttcagtctcaagttggaaacacagttaaagttcctagatgggcaatagcttataagtttccaccagatgaacaggaaacaaaagttttagatattgagtggacagtcggaagaactggagtggtaaccccaactgctgttatggaaccagtaacgttagcaggaacaactgtggcaagagcttcgctacataaccctgattatttaagggaaaaagatattcgtataggcgatacggtgaaacttcataaagctggagatattattcctgaaatttctgaagtagttttagctaaaagatcagaagattcagtagagtatcaaattccaacagaatgtccagaatgtggtgctaagttagttcatttagatgatgaagtagctctaagatgtatcaatccacaatgtccagctttggtaaaagaaagcttaactcatttcgcttcaagaaatgcgatggatattagaggattaggacctagaataattgaacagctttataaccgtgaaatgattaaagatgttgctggaatttatagcttaacttttgaacagttgataactttagataagtttaaagaaaaatctgcgaataacctattgacagcaatcgataatagtcgtaataattctattgaacgtttaatttttggactaggaatccgccatgttggtgctaaagtagctagaatattagctgaaaattataaatcaatggataacttagctaaagcaaaaagtgatgaaatttcaacgattgattcattaggaaaaattataggtgatagtgttgaaatgtattttgcagatgaacacgtgatggaattattagatgaattgcgacaagctggagtaaacttggaattcttagggaaaactcgtgaagaacagcttgaaagcagcaccgatagtagtttcaacggtttacgtgttgttctaactggaactttggatactttgaagagatccgaagctaaatcatggcttgaagcacatggtgcaaaagttacaggaagtgtgtctaagaaaactgatttacttattgcaggtcatgatgctggtagcaaattgacaaaagctcaagaattaaatgttagagtaatgaatgaagcagaatttattcagcagatggaggaagaatcttga

SEQ ID NO: 642 - DNA, 1026 bp, Unknownn
  isolated from dental, unidentified
atgagcgagatgacagaaaaaattgcagttcttggtgctggatcttggggaagtatcttggctggtgttttagatgaaaataaaaacgaagtatggttgtggactaataaagaatcacaagccaaagaattaaatgaaaaccatactaatgaacattacataccaggacacaagtattcagaaacaattaaggctacaacaaatcttaaagaggccgttgatggagcttcagcagttttattcgtagtacctactaaagtaataagactagttgctcaacaattagttgaagttttaaaagaactaggacaaaagccattaattattcatgcaagtaaagggcttgaattaggttctcacaaacgaatttctgaagtaatagaagaagaaattccaagtgaatatcgtaaagatgtagtagtcttatctggaccaagtcatgctgaagaagtagcatgtaaagatattactttaattacggcagcttgtgaaaacttagattcagctaagaaggtacaatctttatttatgaatgattatttaagaatttatacaaataaagatgtaataggtgttgaaacaggtgcagcatttaagaatgttattgcgattggtgcaggtgctttgcatggtttaggttatggtgatgacgctaaagctgctttaatgacacgtggtttggctgaaattagtagattaggtgttgcttttggtgctgatccactaacatttatcggtttatcaggtgtaggtgatctaatcgttacatgtactagtgttcattcaagaaactggcgtgcaggtaatcaactaggtaagggtaaggcccttgatgaagttattcaagatatgggcatggttattgaaggtatcaatacttgtaaagcagcctatgaattagctcaacaaaaaaatattgaaatgccaataactgaagctatctataatgttctttataatggtaaagatattaaagatgaaattagtttattgatgcaacgcgaaggaaaagaagaaattaaataa

SEQ ID NO: 643 - DNA, 1401 bp, Unknownn
  isolated from dental, unidentified
atgagcaaaaataaggataatataaatgggggcctgaataggtcgctatcatcaggacagatggagatgatagctttaggtggaacaattggtgttggattattcatgggatctacatctacaattaaatggactggtccttcagtattattggcttatgcagtagtaggtgtattattatatgctgttatgcgagctttaggagaaatgatctatataacaccaggaacgggatcatttgctgactatgcgactgattacattcatccactggctgggtatttaacaaaatggagcaatattttccaatatattgttgtaggaattagtgaagttatcgctgttactcaatatttgaatttttggtggccacatttaccagattggatttcaggattagtagttgttataacattgactttggcaaatcttgcatctgccaaggcgtatgggacattggaattttattttgcgatgataaaagttgttacgattatcttaatgataattattggattaatggttatcttccttggattaggaaataactggcatgcaattggtttatctaacctttggaaacatggtggatttttcacaggtggatttaaaggatttatgttttctctatctattattgttggttcttatcaagggattgagttactaggaattacagctggtgaagcagaaaatcctaaacatgcaattgtagcatctgtaaaatcaattgtatggagaattttgattttctatattggagcgatctttgtaattgtgacaatttatccatggaatcaattagcttctgtaggttcaccatttgttgaaacatttactaaagtaggtattgctggtgcagctggaattattaactttgttgttcttacagctgcaatgtctggggctaactcaggaatttatagttctagtagaatgttatttaagttatcagtagataaggaagcaccaagcattttcagtaagttgtctaaacatgtggtacctaatgtcgctattttgacgatttcaagtggaattttgattggatttattttgaacattgttctttctatctttagtaaatcctcggctaacttatttgtaattgtatatagttccagtgtattacctggattagtaccatggtttgtaattctattatcagaattgcgtttccgtcgtcaaaatgcacatatgctagaagaacatccatttaagatgccattctatccattatctaattatctggcaatcattgcattggtaataatagttctctttatgtttgttaaccctgatacacgagtttcagtatcagtcggagcagtatttctattattattgtcattgattttctttattagacatggaaaagatggacaaaaaggaaagaattaa

SEQ ID NO: 644 - DNA, 1239 bp, Unknownn
  isolated from dental, unidentified
atgactaacagagttgttattacaggaatgggaatagtaggtcctgtcggaaatgacagagaaactttcttaaagaacatatttgatagcaaagtaggaatagaaaagattactaagtttgacgctacacagactggaatttcagttgctggagaagtgaaagactttgatcctaaaaattctattggtaaaaaagctgctaaaagaatggatgtattttctcaatatgcagttcatagtgcgattgaagctgttgaacaagcaggaataaatgaagagaatacagattcatatgacatgggagtaatttacggatcaggtattggaggacttactactattcaagagcaagttataaagatgcatgaaaaaggtcctaaaagagtttctccaatgtttgtacctacttccatagttaatatggctgctggaaatattgcgatgcattttggagctaaaaatatttgtacagcagttgtaacagcatgttcatctgcaactaatgcaattggggaagcttatcgacaaattaaagaaggtagagcacaggtgatgttaactgggggctctgaagcatcggttaacgaaataggaattgctggatttgcggctctaactgctctttcacctgagaaagatcctttaaaggcttcactaccatttgatagaaatcgttctggatttgtaatgggtgaaggtggagctaccttagttttagaaaacttagaacatgcacaaaaacgaaatgctacgatattaggagaagttgtaggttatggtagtacgtgtgatgcttttcatataacgtctccagatcctactggtgaaggggcagctagggctatgaaacaagccattgatgaagctggtataactcccgataaagtaggttatattaatgctcacggaactgctacacatgcaaatgatagtggtgaatcattagcaattaataaagtatttggaaaaaatagctcagtaatggtaagtagtactaaaagtatgacaggtcatttgttaggagctgctggcgcaattgaggcagctattacggtaagagctcttcagatgcaacaattacctgaaaatgtaggtttgaatgaattagatgaagaatgtaatattaatatagttacaaaagacaagactaccacttctaatttagaatatgctatcagtaattcattaggatttggtggtcataatgcggtattagcgttaagaaaatggagtgaataa

SEQ ID NO: 645 - DNA, 1014 bp, Unknownn
  isolated from dental, unidentified
atgacaactaaagtaggtattaatggttttggccgtatcggtcgtttagcattccgtcgtattgctgaaacatctaaggacttggaagttgttgctatcaacgacttaacatctccagcaatgttagcacacttattgaaatatgatacagctcatggtcaatttgacggtgaagtttctgctacagacaacgcacttatcgtaaatggtaaggaaattcctgtttatgctgaagctgatgctaagaacattccttgggttaagaacgatggcgtagacttagttcttgaatcaacaggtttctacacatctaaagaaaaggcatctgctcaccttgaagctggtgcaaaacgtgtattagtttctgctcctgcaggtgacatgacaacaatcgtttacggtgtaaacgacgatgcaatcacagctgatgacaagattgtttctgctgcttcatgtacaacaaattgcttggcaccacttgcaaaagctgttaacgatgcatttggtatcaaagctggtacaatgacaacaatccatgcttacacagctacacaaaaattacaagatggtccagatcgcaagggtaatgttcgtaacgctcgtgctgctgctcaaaacacaattcctcactcaactggtgctgcaaaagctatcggtttagttgttccagaattgaacggtaagttagatggacatgcacaacgtgttcctgtaattacaggttccttaacagaattagttgcaactcttgacaaagaagttacagctgaagaagttaacgaagcagttaagaaagttacagaaaacaacccatcattcggttacaacgcagatggcattgtttcttctgacattatcggtacaacatttggttctgtatttgacccaactcaaacacaagttgtaggtaagggtgacggccaagttgttaaagttgttgcatggtacgacaacgaatacggtttcacatctcaaatgatccgtacattagaaaaatttgctagcatgatctaa

SEQ ID NO: 646 - DNA, 1113 bp, Unknownn
  isolated from dental, unidentified
atgaagactttagtgattgctaaaaaagttgttatagaattaattagagataagcgtacagtattgctgatgtttgttgcaccattattaatcttgtgtttgttaaatttgatgttttctgcaagtgcaaaaactaaagtaacaataggaacagtagatgttaacaatcaaattaatcgaaaaatggatcaagtagatgggactaccgtaaaaaaatatgaaagtgaaaaacatgctaaaaaagatttagatgctaatagcttagacggagtaatcagttataaaagtaagcagtatgatgtaacttatgccaatctagatgtttctaaaactgtgatgacaaagaaagtattagaaagtgcccttatgaaggataatgtttccaaattacaatcaatggtggttaaacaaggacaagtaatagcgaaattaactgggcaacaagagtctgttaaaatgaataaatcaaaaataagtataaaaaatcattataattatggaaatagtaaaactaatttttttgataagatggccccaatactaataggattttttgtgtttttctttgtatttttaatttcaggaatggcgctattaaaagaacgaataagtggtactctagaaagattattagctacacctgtaaagagaagcgaaatagtttatggatatatgctaggttatggcttaatggcattggcgcaagcaagtctgataacagttgtgggaattaaattattagacattgagataataggctcaatatttagtgtaataattattgcagttttattgggatttgtcgcgctagcctttggtattttgctatcaacatttgcttcatcagaatttcaaatgatgcaattcattccattagtagttgttcctcagattttcttttcaggtatcattccattggattcaatggctgattgggcacaaagaattgggaaaattttaccattaacttatgctggtgaagccttatctgcaatcataatgcaaggagctggcttaatagatgtaggaaaagatatactagtattgatgatctttttagtagttctattaattttgaatattttaggcctaaaaagatacagaaaagtttaa

SEQ ID NO: 647 - DNA, 960 bp, Unknownn
  isolated from dental, unidentified
atgttattgattatagcaccggctgtatgtgcatttattttgacagtgatttttgtaccaatgttcatcagctactttagaaaaagaaaagaaggacaaatgattcgtgaagaaggtccaaaatggcatcagaaaaaatctggtacaccaacaatgggtggatttgtttttaacctagcaattcttgcagttgttttggtttttggactactgactaaaaatttacatgctaaattattaataatcacctttatcttagttttatatggctttttaggtttctgggatgattctattaaactatggaagaaacagaatgaaggtttgaaagcttggcaaaaatttcttggccaagtagtaggtgcgcttctttttgtatttgtttttgtgcatgaaaaacttccattatccttagcgttatttggacatgaattgcatttaggattagtgttgtatacactatttgctattttctggttagtaggtttttctaatgcagttaacttaactgatggaattgacggactagtttcaggacaagcaataatagcttttgcaacctatggaattatagcttattatcaaggccaatttgatgtattactattctgtgctacagtaattggtgcattacttggctttattatcttcaatcataaaccagctaaaatttttatgggtgacatgggttcattagcgttaggtggtgcgttagctgctgtttctctaatgacacatcatgaattagctttattagttataggtttcgtctttgttatggaaacagcaagtgtgattttacaagttgcctcattcaagttaactggtaaaagaatttttaaaatgagtccaattcatcatcactttgaaatgtgtggctggagtgaatggagaattgatattactttttggtgtataggaattatttgttcagcaatcgcattagcgtttattctataa

SEQ ID NO: 648 - DNA, 543 bp, Unknownn
  isolated from dental, unidentified
atggttaaccgtttaaaagaaaaatatgataatgagatcgttccatctttgatggaaaaattcaattacacatcaatcatgcaagcaccaaaggttgataagattgttatcaacatgggtgttggtgatgctgtaagtaacgcaaagcgtttagatgaagctgttgatgaattaactttgattgcaggtcaaaaacctgttattacaaaagctaagaaatctatcgctggtttccgtttacgtgaaggtatggctattggtgctaaagttacattacgtggtcaacgtatgtacgaattcttagataaattagtatccgtatcactacctcgtgttcgtgacttccatggtgtaagcaagcgtgcctttgatggtcgtggtaactacacattgggtattcgtgaacaattaatcttccctgaaattgattttgatgatgttaacaaagttcgcggtatggacattgttatcgttacaacagctaatacagacgaagaatcaagagaattattaacacaacttggaatgccattcgctaaataa

SEQ ID NO: 649 - DNA, 255 bp, Unknownn
  isolated from dental, unidentified
aatatgaaaaaatttgaaatccccctatactattatcataaaaagtataggaggattttttatacaatggaagaaactgaaattgttgaagtaaaaccaactaaaaaacggaaaacagcaactaaaattaaaacaaccaaattgaatttagatgctgaaattaaatttgataaggtgaaaattttgttgtgtcacggagttgatactgaagtaatgaatgacgtctgggagttgataaagaaatatgttagttaa

SEQ ID NO: 650 - DNA, 774 bp, Unknownn
  isolated from dental, unidentified
atggatttagaaaagtataaaggatacctgatagatttagatggaacaatgtacaaaggaaagataaaaattcctgcagccaagagatttatagaaagattacaagagaaagatattccatttctatttttaaccaataatagtactcaaactccggaagctgtagtagaaaatttaggaatgaattttgatattcatgttggtgtagaaaatgtatatactacagcattggcaacagctgattatgtagctgatttagatgaaaataaaagaaaagtatatgcaattggagaacttggtttaaagcaagcattgatggataaaggattccgctttgaagaggttactcctgattatgttgtagtaggtttagactatgatgttacatatcataaattcgaattagctacattggctattaagagaggagcaaaatttataggtactaatcctgatactaatttgccaaatgaaagaggcttagtgccaggagcaggttccgtcattgctttagttgaaagagcaacacagcaagtggcgacttatgttggaaaacctgaaaaaataattatggaaaaagcattgaaaaagatgaatatgaaagctgatgatgtaattatggttggggataattataatactgatattaaagcaggaatagcttcggatatagatacattattggtatatacgggagtctctactagagaagatgtagcaaaagaaaaaattaagccaacatatgaaattaatagcttagatgagtggcaataa

SEQ ID NO: 651 - DNA, 1350 bp, Unknownn
  isolated from dental, unidentified
atggataaatttaaaaatattattattggatttggtaaggcgggtaagacattagctaagtacttggcgcagcatgatgagaccgtgcttctgatcgaacggtctaaacaaatgtacggaggaacttgtatcaatgttggctgcctaccatctaaaaatttaattttaaatggtcaacgtggcttagactttactacggcagttaataagcgtggtgagatgactagacagttgcgaaacaaaaactatcacatggtggctgatgagccactagcaacggtttgggatgggtcagcccgttttatcgacaattatgttttggcagtcgtaatgagtgatggaacgactaagaaggtgagaggtgaacgcatcttcattaatactggagcggttccaaattggccatcaatcccagggctagaattcggtcagcggatttttacgtctaaagaagctatggaattgaagaaacaaccgaaacgactagcaattattggcggcggttatattggccttgaatttgctggaatgtttaattcctttggtacacatgtaacgattttcgaccaacataccagattgttagagcgcgaagatcctgatattgcgaccgaggtcgtaacagatctgactaacgcagggatcgagattaaactggagactcaactaacgcaagtaaaagataatggtgagaaggttacattatattatcaacaaggtgatcaaactaacactgcagaatttgatgcggtgttagttgcagtcggtcggcggcctaatgtaagtagtttaggactagaaaatactgatattgctttaaccaatcgcggtgctattcaggtcgatgatcatttaagaaccacagtacaaaacatttgggctttaggtgacgttaatggtggtcctatgttcacttatgtctcattggatgattttcgtattatcatagatcaattgtttggtaagggggatcgctcaacagctgatcgaatggtgataccgactgcttcgttcctaaatccaccgctggccaacgttggcttaaatgaacatcaggccaagagtgtaggttataactttcaaactttcaagctatcagttaaggcgattccaaaggcccgggtcttggaggatcaacgcgggctttataaggtaatcgttgatcaaaaaacacaccttattttaggggcaacattgtatgccgctgaggctcatgaaaccatcaatctaattgcattggcaatgaaggccaaattaccttacgaaagattacgcgacatgatctatactcatccaacaatgtctgaagccttgaatgatctttttaagaccccggttgtgaaaagctaa

SEQ ID NO: 652 - DNA, 1350 bp, Unknownn
  isolated from dental, unidentified
atgaaatatatcaaaaaagaattacaaagtaaaaaggattacaagaaggcgccattttcagatgttcactggcgtgtctacatttcaatcttgttaggacagattgcttgtggatatgcacttggaataagtggtattgctttagatcaagcaggatcatatttaccattgactaacttttggactggtttgatcggtgctggtggtcttattgggttattcggtagtatttttatgggacgtttagctgataaagtcggaagaaaagggcttttgatgttgaatatgtacatttttacaatcctatcgttagcacacctatttgtaacaaatttatttttaatttttcttttgcgattaggtttaggattaatgatggctattgattatacagtaggtaatgcgttgttaattgaatggttaccaactggtgaaagtggtaaaaagcaaagtagattattaatttactggtcaataggtttcattttagcgtacttaataggttcttatttaggtggattttctcaaggttggaagtatagttttacctcatcatttatttttggattaatagctgctatattccgctcatttgcaaagattccagcttctccaagttggttagcaagtcgtggtaaaaatgctaaggctcaaaaagtaattcaacgtaatttaggaagtaaatggggattatcagaaagacttctatccattaaagttaaaaacatttcatggctacatctttttagtaagaaatatcgtcgccaaacattagttggtggattattctatgctagtcaggcattctcattttttggtataagtattttcttaccaatcttgctaaagagtatgggagttactaatgccaatatgtcaggtattctttataacggaagtatgttaattggtgtagttattgggatttggatttttaacaaaattagtcgtcgctcatttttagttgtcagctttttaagttcagcgattgctttagctgcaatggtattcttagatatatcactgtgggctaaattaggtatcttttctctattttctgtgatcttatcttcatcattgatattggattatccatatccttcagagttatttgatgttaaggttcgtgcaacagggatgggtatctgtatagctatcagtcgaattggagctgcatgtggtacattcttattacctattttaactgatatgggtggatctcaattagcgatgttagtatgtgctctagtcctatttataggaagtatgatttgtttagtatgggcaccagaaacatcacctaagtttatgaaaaagaatgaaattcttgaaaatgaagtaacagaataa

SEQ ID NO: 653 - DNA, 705 bp, Unknownn
  isolated from dental, unidentified
atggcaaaacttgacgctcatgatattattagaacaatagctgaatcaaaaaagaagacgccagttaaggtttatgtaaaaggagatttaaattctttagacgtaccttcaaatgttgaaacatattttactaataatgttggtgttatgtttggtgattgggcagatgtagaacctatcttgaaggattcctctgttgaaagttatcatctagaaaatgatggtcgaaatactggggtagcgatggtagataagaagaaattcaatgcaagaattgaaccaggcgcaattatccgtgaccaagttgaaattggtgataatgctgttgttatgatgggagctgtaatcaatattggcgctgaaataggtgaaggctcaatgatagacatgggagctgtattaggtggtcgtgcgattgtcggcaagaactgtcatatcggtgctggaacagtgttagcaggtgtggtagaaccaccttctgcacaaccagttgtaattgaagatgatgttttaatcggagctaatgcagtagtccttgaaggtgtacgtgttggtaaaggtgcagtggtaggtgctggcgctgttgttactaaagatgtagaaccttacactgtagttatgggaatgcctgctaagaaagttaaagatgtttcccaagtggatgattctaaaactgaaattgttgatgacttacgtaaattataa

SEQ ID NO: 654 - DNA, 603 bp, Unknownn
  isolated from dental, unidentified
atggaatcaaaatttaacgaattacaaaaaaaacgtcgctcaatttacgctattggtgaaaatgttactgctgataaaaatgacatctttaacttagtaaaaacaactattcaacaatctcctacagctttccacagccaaacagtaagagctgttgtattatttggtgaaaaatcaaataaagtatgggacatcgttgaagctaacttacgtaaagttgttgacgatgacgaagcattcaagaatactcaagcaaaaatcgctagcttccgtgcaggttttggtacaatcctttactttacaaacacacctaaagttcatgaattagaagaaacattcccattatatgctgataacttcgcaacatgggcagaacaaggtattggtggtgctcaacaagctgtatggactgctttagcagaacaaggtattggtgctagcttacaacactataacccactaattgatgatgatatcaagaaagaatttgatcttccagcagaatggacattacgtgcacaaatgccattcggttctatcgaagctccagctggtgataaagaattcttagacgaagctgaacaattcaaattaatcgactaa

SEQ ID NO: 655 - DNA, 1326 bp, Unknownn
  isolated from dental, unidentified
atgtctgcaattacagaaatttatgcacgcgaagttttagattcacgtggtaacccaacagttgaagctgaagtatatacacaagatggtggtttcggtcgtggaatcgttccttctggtgcatctacaggtgaacatgaagctgttgaattacgcgatggtgacaaagatcgttacatgggtaaaggtgtaacaaaagctgttgctaacgttaatgatatcattgctaaggaaatcgttggttacgaagttactgatcaagttgctatcgataaagcaatgattgctttagatggtacaccaaataaaggtaagttaggtgctaacgcaatcttagcagtttctattgctgttgctcgtgcagctgctgacgaattacaagttccattgtacaactatattggtggtttcaatgctcacgtattgccaacacctatgatgaacgttatcaatggtggtgctcactctgataacaaggttgacttccaagaatttatgattatgcctgttggtgctccaacagttaaggaagcaatccgtatgggttcagaaacattccatcacttacaaaaattattagctgctgatggtaaagtaacatccgttggtgatgaaggtggttttgctcctgactttgcaaacaacgaagaaccattagaataccttatcaaagctattgaagctgcaggttacaagccaggtaaggatattgctattgctgttgacgttgcttcttctgaactttgggacaatgattccaagaagtacaagttacgctggtcaacaggtgaagaattcacaactgaagaattcatcaaatatcttgaaggcttagttgctaagtacccaattatttctatcgaagatcctatcgatgaaaacaactgggatgactgggtaacaattacttctgaacttggtaagaaagttcaattagttggtgacgacttcttcgttacaaacacagaatacctacgtaaaggtatcaagatgggtgctgcaaactctatcttaatcaaggttaaccaaatcggtacattaacagaaacaatggaagctatcgaaatggctaaagaagctggctacacagctattgtttcacaccgttctggtgaaactgaagatacaacaattgctgacttagttgttgctacaaatgcaggtcaaattaagactggttctatgagccgtacagaccgtcttgctaagtacaaccaattaatgcgtattgaagatcaattaacagacttggttgctaagtacaagggtatcaactcattctacaacttgagtgaacaagctcgtcaagacatcattaacaagtaa

SEQ ID NO: 656 - DNA, 957 bp, Unknownn
  isolated from dental, unidentified
atgtctatagtagaagaaccgtatttacagttaattcgtgatattttagaaaaaggtcatgaaaagagcgatagaactggaacagggacaaagagtctctttggttatcaaatgagatttaatttagcagaaggcttcccattattaacgactaaaaaagttccattcggcttaataaagagtgagttgttatggtttttaagaggagatactaacattagattcttattggaacataataatcatatttgggatgaatgggcatttaagaattgggttgaaagtgatgaatatcatggaccagatatgactaattttggtttaagagcccaagaggatgataactttaataaggtttatcaagatgaaaagaaaaagttctgtcagaaaattgttgaagatcaagaatttgctaataaatttggcaatttgggagatgtatacggtgctcaatggcgtcattggcaaacaagaaatggtgaaactatagatcaaataaaagatgttattgagactattaaaaataatccagactcacgtcgcatgattgtaacagcatggaatccagaagatgttccattaagtgctttaccaccttgtcatacattgttccaattttatgtaaatgatggaaaactgagttgtcaattatatcaacgttctgcagatgtatttttaggtgtaccttttaatatagcaagttatgcattgttgacacatatgattgctagagaaactgggcttgaagtaggagaatttgttcatactcttggcgatgcacatatttacttaaaccatctagatcaggttaatgaacaattgcaaagaaagcctaatgatgctccaacattatggttaaatccagaaaagaaaaatattatggattttgaaatggaagatattaaggtaaaaaattatcattcacattcagcaattaaagcgccagttgctgtttag

SEQ ID NO: 657 - DNA, 1272 bp, Unknownn
  isolated from dental, unidentified
atgggaatttatatttttggaatgctttcaactttgatgatagaggtaattacattatcttattcaagcaaagtaaagtttgattttttgcatatagttgcatttattttgttaatgattatttgcataccaattaaaattagtaatttaattatgattatcggtggagtattgattacctatcatcaagataatggaagagacagttggttgagatacataatttttgtgatgtattcttttatcacaacttggattttacaagtagttttgaatttttatggaagtaaaatctacgattggtttaactataataattatttaggaactttggtttgtcaaagtataatttttttaatgcagataggaattatctattggtttaaagatagtttggaaattttatcaatgtcggattcaagtaaaaagagaaaaatggaattagtggctattgcatttttagcaatctatttaatttatggatcaacatttaatgataattacaatagttggtggataagcgtttatgtgataggattgattttattttggggatatataagagcgattgccttattggaaactaaacgagaacttgatgaactaaaagattttgaattacagaatattgaaaattatgcgaacaagattgaagaaatgtatcaaggtcttagaagattcagacatgattatttaaatattttacttagcatggatcaagcaataaaaagtgggaatttagagttgatagaagaaacatatactaaaattatggaaccaagtaaagaaaagattaacgcagcttactatgatttgggtaaattgaaacatgtaaaaacttcagcaattaaaagtattctttataataaatttagttatgcggctcgtgaaggaattgaattggaaattgaaataaatgatgatgttacggttcaatacacaagattgctagatgcagttagaatactatctatattgttggataatgcaattgaagcggcgttggaaagtaaggaaccacgattattagtggcatatattaaagatgctgatattgaaagagtaattattgagaatagtactaaagtagaaagagtagagatagccccactgttcaaagaaaattatacaactaagagtggaaatagagggcaaggattagcgactgttaaaaggttgatcggtcattatcccaatgtatccttaaaaacaagtagtagtgactatacatttactcaggagttagttttaaataaggaagaaaaaagatga

SEQ ID NO: 658 - DNA, 1026 bp, Unknownn
  isolated from dental, unidentified
atgagtaaaattaagaaacatttacaagaagaatttgaagattgggaaagagaacaactaaaacaactacacagtttaaatgctgcctggcgtcatttaattctgaatgttttagcatatctttcaatttctatcattgaatattttttagctgaaattagtaactctcaaactttacgtgctgatgcttttaataatatttctggaatcgtatctacaatgttattaatgataggaattcacattgctagagacattgatgacgatgacattgctggaatggctcccttgcctaaattgaatatgtcgcaaagaggaaatgatcaaagagttcaatttacacgtttccgatatgaaacagtctttacccttgtaactggagttgttatgattgggattgccatcagtgttatctccactggtatcattaatctttggaaaccagataaacgtgtcattcctgaaccaattgctcttgttggggctggtatcgctactgtaatcatgttaattgtttggtatcttaatcgcagagctggtagaaaattgcaaaatgcagctttaagtgcttctgctcaagatagtttaagcgatgcttttactagtattggtactctaatctctatttccggtgctttaatatttaagatcacctggcttgatggtgctactagtattttagttggtttattcattttatattctgggtttaaaatcttcatggatagcagtcttaatttagtagattattttgatccggaagttgaagaagaatatcgaaatgttgttttaagcgttccaggtgtagctcatctttctgaactgaaggcgcactataatggcaatattgttagtttggatattgttgttatggttgatgctaaaatgtccgttttagatagttatcgtattgcagaaaatattgaaagaattatgcatcatagatttggaattatggatactgatgttgcttttattcctgatccgagttcaattgatgacgatgaaattaaggataaattttaa

SEQ ID NO: 659 - DNA, 900 bp, Unknownn
  isolated from dental, unidentified
atgaatcgaattacagaaatgttaggaattaaatatccaattattcaaggagcgatgcaagatgtagctaaagtcggattggtggcagctgtttctaatgctggtggtttaggggtgctagcttcagggcaagatacacctgaacaggtacgcgaagaaatccataaagtaaaagaattaactgataagccatttgctgtcaacttgatgtttttaaataagagggctccagaaatcgttgatgttgtcattgaagaaggagtaaaaattgtaacaactggtgctggtacacctaaattatatatgcctaaactaaaggaagcaggaataaaagtaatgcctgtaattccaaatgtaaaaattgctaaaaagatggaagatctaggtgtagatgctgttattgctgaaggtatggaaagtggaggacatatcggaactatggcatcgcaaactctttggcctcaagttgttgatgccgtaaatattcctgttattgcagccggaggaattgctgataatcgtggagtgaaggcagcaatggcgatgggagctgaaggtgtacaatgtggtacaattttctcgatttctaaggaaagtcccgttggtgataattggaagaaaacgattattgaatcaaaggacacttctattggtgtaattggtacaaaaatgggagtagccagtcgaacggttgtaaataagaaagctaaagagctatatgagttggaagacaaaatgactgataagttaaaattcaatcaattgttagatgaggcatatcagaaagctgtttatcaagatgatgtagaaaatggaataatatttgctggttcagttgctggaatgattcatgagagtaaaagtgctgcggaaattatttctgatttaatgaaggaatag

SEQ ID NO: 660 - DNA, 2280 bp, Unknownn
  isolated from dental, unidentified
gtggctagaagaaagaaaacaaaaagaaagacaaaaaagaaaatacaaaaacaaacttctgagcgagttgtcggtggttgctttattctatttggaattttagggttattaaatctgggatacctgggtattttactggcaaatgtctttaggatatttgttggtgatagttataaagtagcggtagtgttactcataggatatggaacatatttattatcaatgggagaacagccgataattcctaggaagaaaataggcggtgtattattagcttatttaggagtactactttttttagaagtactactatttcaaaaacttgatttacatgctaattttgttgatataacttggcaatatttaagttcagatattatttctggtagtgttggtagtgctgttggtggtggaattacaggagctttattatatagcgcaacttcgtttttggtagcgcagataggctcttatattgttgcagttttaatttttatagctggcttatgtttattattcaatattgcatatcgacaagtcttcgagtatttaggtaagactctatattggataatttctgagacaaaaaaagtgatagttgctttttcacattcaattagtaagggaaatgacaaagttaagcaaattaaaaaagcacgtcaagaaaaggcaattgagaaagctaaagaaaatgaaatcactcatagcgatgatgaagaaagagatttacctacaccagtagcagatatggaaaaatctgaagtagataatgatagtaaagatagtttaactgattggaatcaaccggttgaagataaaagtgaggatgagcaagaaattgtagtaaagaatcatccaactttagaaaattatcaattaccatcagttaatttattacaggatgtgcctcctactgatcagagtgaagaaaaagcagagattcaacgaaataagaagatattaaaagagacctttaagagttttggtgtagatgtagaactaaaaaacacaattttaggtccatcggttacaaaatatgaacttcatccagcaattggagttaaagttagcaagatcgttaatttagccgatgatctggccttggcattagcagctaaagatattcgtattgaagcaccaattcctggcaaatcattaattggtatagaagtacctaataaaaaagtggcaacaatatcatttaaagacattatttcttcacaaaagaaagattctagtaagcctttggaagtgccgattggtcgcgatgtttcaggtagcttaatcactgctgatttagctaagatgccacatttattaattgctggttcgacaggtagtggtaagtcagtcgcaattaatggcatcattacaagcctattgatgaattgtccgccagatgaagtgaaattaatgttagttgaccctaaaaaagtagagcttggtgtttataatggaattccacatttattaacaccggttgtaaccgatccgaaaaaagcatcgcgagctttgcataagctagtttcggaaatggaaagacgctacgaattatttgctaatacgggacaacgtaatatttctggatataatgcgatgattcaaagacaaaatcatgataataattctaaagaacctttaatgccatacattgtggcaattgttgatgaattatcagatctaatgatggtagcttctaatgaagttgaagatgcaattattagattagctcaaatggcccgtgcggctgggatccatatgatcttagctacacaaagaccatcagtagatgttattactggtttgatcaaggcaaacgtaccttcaagaatggcatttgctgtatcaagtggaactgattcgcgtacaatcattgatcagtccggagctgaaaaattacttggacgtggggatatgttattcttaccaatgggaatgaataaacctgtacgtgtacaaggtgcgtttatttcagattctgatgttgagaatgtggtcaactttgttcgtgaacaacttccagctgagtatgatgagtcgatggaagtatctgatgaagaattacaacatgaagctgatggagaagctgaagatgagctatttagcgaagcggttgaatttgtcagacaagaacagaaatgtagtgtgtcgatgcttcaaagacgatttaggattggatataatcgctcagctagaattgtcgatgaaatggaaaaacgtggaattgttggccctcaagaaggtagtaaaccacgcaaggtgtatagtcaagataattag

SEQ ID NO: 661 - DNA, 966 bp, Unknownn
  isolated from dental, unidentified
atgaacactgaaaaagctgttttaaattattttattcaaaatctaggaaattatacatctggagaagaattatccaatcaactaaatatttctcgaacagcagtctggaaagctgttaaacaattaaaagaacaaggctatgaaatttccagtaaaacaagaaaaggatattgtctagttgataatggagtattgaatactgcgcttattaacaaatatttacatactgataatcttgatttacacgtttatgaaactattggttcaactaactctgaagctaaaaacatcagtagtcaacgtcattctactgaaccactggtaatcattagtgatcaacaaacggccggttatggacgctatggcagaaaattcgaatcacccaagaataccggtatttatatgagcatcttgcttgaaaatcaacatcaaaacgatttaaatcctggtttgttgactactgctgtcgctattgcagttagtcgtactatcaaaaagttattccacaaagatacagaaattaaatgggttaatgatgtattacttgatggtaagaaaatttgcggcattttaactgaaggtgttgctaaccttgaaactcaaagtatctcacaagttattatcggaattggtataaactatactactcccctagaagtgttccctgctgaacttagggaaagagttggttcacttaaagatttagcagaagaataccatgtatccagaaatatttttattgcatgttgcttggatgaattttttgccatttatcgtaactatacttctgctgattttatggatgaataccgcaaattatctgttgttatcggtaaagaagttcgcattaaacaaggaaataaaataataactggtgtagtttctaccattgatgacctaggaagaattgttcttactgacggacaaattttcagttctggcgaagttaccaaaattagatattaa

SEQ ID NO: 662 - DNA, 987 bp, Unknownn
  isolated from dental, unidentified
atggcattcaatttatggttacagtaccctgaattggcaaaagatatcgaaaaagttaaacataatcttcaagataaaatctctgtcgactatcctgatttacaagctgctctatcaaaaatggcaagcaatggcggtaaatttttacgtccagcctttttcttactatttaccaaattaacagcagactcacaaaatcgtgtagacgataaaaaactcattgatatagctacttcacttgaagttttacatatgtccacacttattcatgatgatattattgatgattctcctaaacggcgtggtgaagttagtgtccaaagccaatttggtaaggatattgcagtctatgctggtgattatttatttacagtcttctttgatttaatcactgataatgttttagacacaccattttttaagatcaattcaagaactatgaagaaaattttattaggcgaattaaatcagatgaaacatcgctacaatacccaacaaactttcttgaattatttgcgtaatgtaaatggtaagaccgcctatctttttcgcttagcaagtgctgaaggagcatattttggtggagcttcttcacaaaccgttagcttagctactagaatcggacaaaatatcggaattagtttccagattttagatgatattcttgattattctgacgcatcaagacttaataaaccaactctcgaagatttggcaactggggtttattctttaccattattgctagttcttaatgaagattcagatgaattacatactttattagctaaaaagcaagacctaactttacctgaaattcaacgtatccaagctttagtcgttgaattaggtggtgtagaaaaagctaaagatttagctgctaaatttactaataaagcacttattgatatcgataaattacctgattctacagctaaaaagaaacttgctaaacttactaaagtcttattaaaacgtacaaattaa

SEQ ID NO: 663 - DNA, 1116 bp, Oribacterium sinus
  isolated from dental, Oribacterium sinus
atgaaattcttacatactgcagactggcatataggaaaaaaactacacaattttgacttgaaatatgaagaagatgacgcttttaaacaaattgaaagaattgcagaagaagaaaaggttgatgcaattattatagctggtgatttatatgatagatcattaccaagtgaagaagcggtaaaaagtgtaaacgaaaaattaaagaggctaaatctagttgataagcatcctttattaattataagtgggaaccatgattcagcaacaagattaaatactggtagtgaatggtttaaagctacaaacttatttttaaatacaaaaatttctggagcatttgaaccagtagaaatagaagatacacaattttttctcttaccatattttgaaccacaagaggtaagaaattattttgacaggcaagatttgaaaaatgttcaagaagcgatgcaacttattgtagaaaaaataaaagaaaagtttaagcctaacatgaaacatgtgttggttgcacatttttttgctgctggaagtacacaaactgattctgagactaatgttatggtcggtggtttagacgctattccaacttcttatttgaatgattttgactatgttgcgttaggacatttacatgatgcaagagcaagtcaagcagagattataaaatatagtgggtcacctgtaaaattttcagtgtcagaagcgacatcgcaaaagggtgtttggattgtagatactgaaaaaatatcacctaaattcgttccattagttccagttcatgaaataaatgtattagaagattcatttgacaatttaatttctccatcggtatatgaaaagtattccaaggaagactattatgctattagattgactgacactaaggtcattccagatgtgattaataaattaagaaattactaccctaagatcttagaattgagacgtgttggtgaaattcaagagctgaaagcagaagagaataaagaaagggatttaactgatcccatgaaattagttagtgacttttttactgaagttacaggtgagaaattaacttcaaatcagcaaaaatgggtaaaaaatgcattaaaggatgtgaataaaaaatga

SEQ ID NO: 664 - DNA, 1443 bp, Unknownn
  isolated from dental, unidentified
gaaatcgattctctatttgatccggctattgtttatgcaaaaggttcacgtttattagtaatggttcgtgctttaattggcgatgatgctctacgttctggactaaaagcttacttcaagtcacacaaatacaataatgcagttggttctgacttatggaaagcacttggtgaagcttcaaatcttgatattggctctattatgaactcatggctagaacaacctggttatccagtccttaatgtcaatgttaaaaatggtcatttagtagttgaacaaaatcagttcttcattggtgaaggtacagaagtagatcgtttatggcaagttcctctacatgcagactttgctcaagctcctaagttacttacacaaaaagaattagacttaggtgactatcaagaattgagaaaagtagctgacaaacctctacgctttaatgtgggaaatacttctcatgttgtagttaattactctcctgaactattagaagacattttagttaactcacaaaatctaacacatattgataaattacaattattgcaagatttacgtctccttgctgatagtggtttaacttcttattccaaggttattccattattaaaagaattttcaaatagtgattcagctattgttaatgaaactttatatagcattgttaataatttgaaattctttgttactccatattccactgatgaaacaaacttaaagaaatttgttaatactttaagtgctgaccaagttcaacgtttatcttggttaccaaaggatactgatagcaatgacgatcaactagttcgtccacttgttttgaacgctgctttatatgctgaaaatccttctgcagaatctgaagcacatgaaatctttactcaaaatcaagataaattattaagtttgtcttctgacattcgtgctcttgtattacaaaatgaagttaaaaattataactcttcccaattatttgaatccttactagaagattatcgtaaaactagtgatagttcatataagcaagacatcttgttcgcattaacttcaacaaaaaatgctgaccaaattcaacaaattgtatcttatttcgaagatgcagataccatcaagcctcaagatttgcgcacttggtacttcagaactctttcaaacaatctaggcgaacaagcagcttgggattggattcgcaacgaatggcaatggcttgaagatacagttggtggtgatatggaatttacatcttatatcacagttactgcacgtgcattgcataccgaaccacgattagttgaatttaaagatttctttgaacctaagcttaatactccagggttaacacgcgaaattgtcatggatactaaagttatcgaaagtcgtgttgctatgattgaacgtgaaagagatcatgtaaatgctgctatttcggatattcttaattaa

SEQ ID NO: 665 - DNA, 1068 bp, Unknownn
  isolated from dental, unidentified
ttgatttctgtcaaagctccaggaaaattatacattgctggtgaatatgctgttgttgaaactggacaaccagctattctagtggctttagatcaatttgtatatgtaaatttagaaaagagtaatgatttagggtcaatcatttctaaacaatataaagaaaattctttatattggaaacgagaaggtaatcaaattatttttgataatcgagacaatccatttcattatattttatctgctattaatttagtcgaagaatatgcccaaagtctaggtaaaaaaatggaattctatcatctaaaaattgatagtgaattagatagtcctgatggaaagaaatatggacttggttcttctgctgcagtcactgtagcaactattaaagctctatctgaattttatgaactaaatttatcaaaagagcatctttttaaactagcttctattgctcatttaaatgttcaaggaaacggttctttaggggatatcgctgctagtgtttacggtggttggatagcttatcattctttcgataaagaatggcttaaagtcgctcaaagatcctatacaatttccgaacttttagatttaaattggcctaatttgaaagttactcaattgactccacctgataacttaaaccttctaataggttggactggatctcctgcatcaacttcacatctagtagatgcagttgcccttcataaggctaataatcaaaataaatacaatcatttcttagaaaatagttggaaatgtatcgatacaatgattactggttttaaggaaaattctctatccaaaattcaaaaatcattaatatataatcgtgaattactccgaaatttagctagtttgagttctgtagaaatcgagactcccctactaactaaacttatcacttctgcagaaaaatttggtggagcagcaaaaacttctggtgctggtggaggagattgtggtattgttctaattgataaatctatgaatgttgagccattatttgcttattggaaagaaaatggaatagtcccattatcattacacgtttatcaagattaa

SEQ ID NO: 666 - DNA, 1377 bp, Unknownn
  isolated from dental, unidentified
atgaaaatgatagagaaatatcgtggaaaaaaagtattagtattaggattaggtaagagtggtgtgaatgcagctaagttactgaaaaagttaggtgcagaagttactgtaaatgataaaaatacaccgtctgatttaactcaagtaaatgaactaaaaaatgaaggaattgaagttattactggtagtcatcctttagaattattagagaatattgatttaatggttaaaaatcctggtataccatacacaaatgttttagttagtggtgctaaagataagggaataaagataattactgaacctgaactagcttttgaaattagtgatgcaagatttgtaggagtaacaggtacaaatggtaagacaacaactacaacaatgatttctttgatgctaaatcaaggtcaaactgaaggtaaggcttacgttgctggtaatataggtgttcctgctagtcaagtagcacaagaagcaacaagtaaagatacaattgttacagaattatctagtttccaattattaggaattacagaatatcatcctaaagttgctgtattaacaaacatatatgaagcacatattgattatcatggtacaagagaaaattatgttaatgccaagatgcgtatcgtcatgaatcaaactgaaaatgattactttgtggtaaattgggataacgaagaatggcaagagttaagccaacgttctaaagcaaaaattgttccattttctcgtctaggtaaatctaaggacggtgcatatgtagcagatggatatctattctataaagaagataaaataatgccagttgataatattaaagtacctggtactcataatgtagaaaatgcattagctgctattgctgttgcaaagatatttggtaaatcaaatgaagatattaaagaagttttaacaacattctcaggtgtacgtcatcgtactcaatatgtaacaactctaaatggtagaaaattctataatgattctaaggctactaatatggaagcgactgaaaaagcattagctggtttcaataatccagtagtattattagctggtggattagatagaggatttacatttgaaaaattagaaccttcattgaagaataaagttcatgcgatgattgtatttggtgaaacagctgatctgatggcaaaggctggtaaagaagctggtgttgaaaagattattaaaactaaagatgcagtttctgcagtccctgaagcttataaagtaagtaatgaaggcgatgttatcttactatctccagcttgtgctagctgggatcaatggccaacatttgaagtacgtggggataaatttattgaagctgtagaaaaattgacagaagagttggaggaaaagtaa

SEQ ID NO: 667 - DNA, 1182 bp, Unknownn
  isolated from dental, unidentified
gatttcaataatcctttaaaacgtcaagcatatatattattgatgctgattaaatctaaaggatatatgttacttgatgatttatctgaatatttgatggtaagtaaaggtacaatcaatcgtgatattaaagaaataaaacttctattaaaagattacgatactactattcgatcggtaagtaacaacggagtaatgttagaaagtaaggaagactgtcagattgctttcattctacgtaactttgtttgtgactactatgatttgggtgagaaactagcaattgaagaaaagcaggaaataaccaaattagttagaaagtacgataaaagtaaaacagtacgtaatttaataataagacatttgaaaatacttaacttcttacatgagcatggtagaaaaatttcaacgacgccagattgttattatgaattaactagttctgaagtaaatgacgaaattctatctatattaaagaagtatttacattcaaaggaaataacagaagcagaaaaaagcttcctattaataccactgaatatcaattatagtaatagaaatactgaacgaataaataaacgcttgatgtggatagatgaattatttgcagaaatttttagtcaagttaaggaaaatatcagtctagatattgattacaatcgagtctttgaacagataaagtatcattcaattttcatgataaatagaagtgccacatatatgagaaatgatgatctattcagtcgagaaattgttgaaaaatatccagtggcagtagatttagctattatgacagttaatttattagaaagtaaactgcatattaagatttcagataaagaattgggttatttagcactttattatcaaatggaaatagaagatgaaaaaagagggaatcctcaatatcataaagttgcgattgttggtgaagtaagtaaaagtattcaaaatttgattattagtaggttaaatgaaacttttcaaggaacaactgaagcagatgttttcaagagtagtgaaagtttcaagaaatcgtccgaacgttacttgattgtattttcaactttaccacttgaaagtaaagatgttacaactccaattgttagaattcagagtatctttaagaatgacgaattagttagcaaagtaactctatcgcaagttatggcgggaattagt

SEQ ID NO: 668 - DNA, 864 bp, Unknownn
  isolated from dental, unidentified
atgaaaattggttttattggtactggtgttatgggaaatgctatctctgttaatttgttaaaagccggatatgaaatggttgtatataatcgaactaaatccaaaactgataatttagtttctttaggtgctagttgggctgactcaccaaaagaagtagctcaacaaagtgatattatctttacaatggttggatttccaccagatgttgaagatgtatatttcaattctgaaactggaatttttgcaggagctaaaccacaatctatcctagttgatatgactactagtcgtccttctcttgctcaaaaaatttatcaagaaggtcaaaaaagaaatctctttgttttagatgcccctgtatctggcggtgatgttggagcaaaaaatggtactttaactgttatggttggaggagataaagaatcattcgataagcttacagatatttttgaagttatttctcagagttatcacttatttggcccagctggttctggacaacatgctaaaatggcaaatcaaattatgattgctgggacaatgactggattaactgaaatgctcgtctacgctaaaaaagctggactagacttagattctattcttactacagtaggagctggatcagcagccaactggagtctaagtaattacggtcctagaattttagcatctgactatactcctggattttttgctaagcattttctcaaagatttacgtattgctttagattctgctaaagacatgggtatccatcttcctgcgacagaaaaagctgaagaactttatcaaacaatggttgatgaatttaaattaggtaatgatggtactcagggattaatcaagatatatgattaa

SEQ ID NO: 669 - DNA, 657 bp, Prevotella veroralis
  isolated from dental, Prevotella veroralis
atgaaaaaatttaattggtcatttgacataattatgctaatatttattgaaatttcaatgctggtatcattagtttcaagttttattgaacataaaagtatgttatacatagcagaaacaattgcagggattttactagctttggctcctgtgattgcctcaagcctttttagatttaacttgcctaaattcctaaatgcgttttatttattatttatatatggttcagtttatctaggtacattgttacatttttatagcgtaccttattgggataagggacttcatttaataagtggagctttattggctagttttggattttcactatatggcatgattgttcctaagcacttaagagaacatatgccagctggattcttagtactttatgcattatcgtttgcaattttttgtggagtgtgttgggaattttatgagtttacttgcgatggtttatttggaatgaacttacagcgttatgctagcagtgcaggaaaagcttttgtaggtcgagtagcattgatggatactatgggagatctaattgctgatactatcggtgcaggattgctatgtatttatgcatattttaatattaaacgttcatcacgatggttacagggattttattttcataaatcatttagattctaa

SEQ ID NO: 670 - DNA, 381 bp, Unknownn
  isolated from dental, unidentified
atggattttagtaaggttcatcacattgcgattattggaacagattttgaagagatgaaagaattttatgtagataaattgggtttcacgttgttagataaacatgttagaccagaaaaaaatgacatcttatttaatgttggatttggagaaatggtattggaaatcttcattaaagaagatgctccagttcgtccaacctatccagaagctaaaggattacgtcatctagcttttagggttgatagtgtagaagaaactgtcaaagaattaacggccaaaggggtagaatgtgaaccaattcgtaatgatacctttaatggtaaggcgatgacatttttctatgatccagcaggaacaccattggaaatacacgaataa

SEQ ID NO: 671 - DNA, 918 bp, Oribacterium sp.
  isolated from dental, Oribacterium sp.
atgagaagaaaaagaattttattttacaactattttgaagattggattaatatttataaagttggtgctgttagtgaacgcacaattgataaatattggcttgcacatcgtcatttaaaaaagcttgctccagatttagaattaggtcaaattacaagaattgagtatcaaaaaattattaatgaatttgctgaaactcatgaaaaagcaacgacaatggattttcatcatcaattaaaaagttctattttagatgcttttgatgacggattaatcgatcgtgatcctacaagaaaaacagttgttaaagctaaaaagcctgggaagaagaaacaaaaatacttaagtgagtttgaattaaaaatgctacttagacatttacatttgggcactgaacctaacttagattggttaatattattggtcgcaaagacaggtttacgttttggagaagctttgggactaactaaagaagattttgattttgaaaatcagatcattaatatctctaagacctgggattataaagctgcacgaggtggttttaaatctactaaaaacaaatcatctattagaaaggttcaattagattggaaattatgtatgcaatttaatactttattacgtgattttcctaatggaactcctatttttgtaaagaaacgtgtgtttaattcaacagtaaataatagattaaaacaatattgcgaagaattagctattccaattatctctatacatggcttacgacatacacatgcttctatgctattatttgcaggagtttcaatcgcaagtgtagccaagagattaggtcacgccgatatgacaacaactcaacaaacatacttgcatattattcaagaattggagaataaagataatacaaaaattatgcaacatttagcaacgttataa

SEQ ID NO: 672 - DNA, 660 bp, Unknownn
  isolated from dental, unidentified
atggcaatgaatttaatgttgatggggttaccaggagctggtaaaggaacacaagctgaaagaatcgttgatgaatataagattccacatatttctactggtgatattttccgcgctgctatgaagaatgaaactccaatgggattagaagctaagaaatatatcaacaaaggtgaattagttccagatgaagtaacaaacggaattgtaaaagaacgtttggcacaagatgatactaatgtaggtttcttattagatggattcccaagaaatatggctcaagcagaagcattaactgaaatgggaaaagaattaggaaaagaattaaacggtgttatcaatattcatgttgatcctgaatcattaatggaaagattaacaggtagatatatttgtcgtaattgtggtgctacatatcataaagtatttaatccaactaaagtagaaggtacatgtgatcgttgtggtgaacacgaattttaccaacgtgatgatgacaagccagaaacagttaagaatcgtttggatgtaaatatcaaaatgaatacaccattacttgattactataaagaaaatggtttattacatgaagttgatggtaatcaagatattgacaaagtatttgctgatattaaggcaattttagataacttgaaataa

SEQ ID NO: 673 - DNA, 939 bp, Unknownn
  isolated from dental, unidentified
atgaaattagctatcttatttagtggtcaaggatcccaatttacagatatgggattggatttttaccaggaaagtccaatttttaaggactgtgtagataaagctagtgagattgcagattttaaaattacttcagtatttgctaacgatggagataaactttctgaaacaaaatatattcaacctgcaatagttgctatgagtataggtatctggaaaatgttacagaatactctaggtgataagttagctgttgaaggcatggttggtttatctctaggagaatatagtgctttaattgcaagtcagaaattatcttttagcgatggaatgtcagtacttaaagatcgtgctatttacatgcaagatgatgctaataaagttgatagtaaaatggcagcaattattgaccctcaaatagaagtaattgaaaaattatgtaccgattatccaaatgtatatgtggctaattataatacacctaaacaattagtaataggtggagatggcgaagaattagtagatgttgtagataagatagatagtctaaatgcagctaagaaaatagtagagttaaaagtaagtggagcttttcatactccactttttactaatgcaagtcaaaagatgaaaaagagattatcaaatgtgacatttactgaaggaagtaacttagttgtaagtaatactacaatgcgtccttttgaaaaagattctttagcagaaatattagctaaacaaatcattaaaccaacacattttggtgaatgtgttcaatatttaattgataataaaaaaatagatacggtacttgaaataggtcctgggaaaacattaagtaaatttactaagcaaattgataaaagtattaaaagatatcacattagtaaattaagtgattttaaaaaattcatagatagtgtgaaagaaagtgaataa

SEQ ID NO: 674 - DNA, 1302 bp, Unknownn
  isolated from dental, unidentified
gtgttagaaaagaaggaatacacacaatttggagaaactatttatagtgaagaattggataacggattaaaagttaagcttctaccaaagaaaagttttcataaagtgtatggtatcatgtctactaattatggctcagctgataatgaatttgttccttatggagaaaaggatatgaaagtttatccagcaggaattgcacattttttagagcataaattgtttgaaaagaaagattacgatgcttttgaattatttggaaagtatggagcagattccaatgcttttacaagttttacaagaacaagttatttattttcagctacacagaatatagaaaaatgtgtagaaattctgctagattttgttcaagagccttatttttctgaagagtctgtgaaaaaagagcagggtattattgggcaagaaataaagatgtatgatgatgattcaagctggcagttatattttggattaatagagaatttatatcctaatactccaattagccaagatatcgcaggtacaattgagtcgattagtaaaataacagcgcaagatttatatgattgttataatacattctatcaacctagtaatatgaccttgtttttagtgggaaattttgatgaaacggcgatgatttcactaattaagaaaaatcaagctaaaaaaactttctctaatacagaaaggattgtacgagctccattttctaaaggagatgaagataagataataatttcttcaagaaccagaaaaatggatttacaattacctaaagttgcaattggtataaagggattaggtaaacaattgcgcggatatgaagcaataagttataaattgaaagttcaattattactagatattttgtttggtgaaagttctaaagaatatctacaatggtacaacgaaaatattattgatgatagttttggatatgattttcaatttgaacgtggatttaattttgcgatgataagtggaagtacaagtaaacctgaggaattcaaaaagagaattaaggatttaatagtccgagcaactgatttattagaagatagggcagaagaatttgaattatctaaaaaagaattcttaggcagtattattcgttcaatgaattcactagaaagtattgctaatcgctatgaaggtagattgtatgatgatgcaacaatttttgatatggtggaaattttaaaaaagctaactttagaagatgttgtaaaaactgctgaagaatttctcaatcaagatgctattagcatttatgaattattaccagagagtaggtga

SEQ ID NO: 675 - DNA, 645 bp, Unknownn
  isolated from dental, unidentified
atggattggcaattatttttgaatccctacgaacaaaccgtaaatgaattaaaattaaaattaagagaaatgagaaagcagtatcgtcaaactgataatcatgcaccgatagaatttgtaactggacgaattaaatcagtagatagtattaaagagaaaatggtgagacgacagttaacagaagatagattagatgagatggaagacatcgctggtgtaagaataatgtgtcagttcgttgaagatatttatcaagttgtatcagatttacgtaaacgaaaagatatgacaattattgaagaacgagattacattacaaataacaagtctagtggatatcgttcttatcacatcgtaattaattatcctctacaacaaattgatggtgaaaagattatcaaggctgaaattcaaatcagaactttggcgatgaacttttgggcaacaattgagcattcacttaattacaagtatcaaggaaaatttcctgatgagatagcagctagactgcgtagagcagctgaggcggcttttcaattagatacagaaatgtctagtattaatggtgatattaaagaagctcaacagattttttcacaaaaaaaaggttatacagatagttcgctggatgatatagacaactaa

SEQ ID NO: 676 - DNA, 807 bp, Unknownn
  isolated from dental, unidentified
atgagagtcggaatcttttcaaataatgttcgtcgttctttagaagtaaaagctgccttgactagacgctttttggaaaggcattttataattgatgatgaaaatccagaagtggtagttacgattggtggcgatggtacacttttgtcagcctttcataaatacattgatatgctagataagataagatttgtaggtgtacatactggacatttgggattttatacagattggcgtgacgatgaaatagatgacttagttatcagtctacagtctgataatggacagtcagttagttatcctctcctagatgtgtttgttacttataaggattcaaataaacgagatatatttactgctttaaatgaagctactattcgtcgtattagtagtactatggtaactgatatttttattggtggcgaattttttgaacgttttcgtggcgatggtttgtgtgtatcaactccaactggttctactgcttataataaatctttaggtggtgcggtagtgcatccaactttagatgtattacaattaactgaagtaagttcgattaataatcgtgtctttagaacattaagttcaccaatgattattgctcctaaagattggataacaattgaacctgaaggagctgcagattttattttaactgtggattccgatagttatcataaattgaaaataaaagaaatcaagtttaagatttcgaagaagaaaattcatttcgccaagtatcgccatacacatttctggcatcgtgttcaaactgcgttcattggtgatgaagatgcagattaa

SEQ ID NO: 677 - DNA, 573 bp, Unknownn
  isolated from dental, unidentified
atgactgaaaataaggctactcaagaaagaacaccccaagaaagattgcaagaagaacaagaacacaaggaacatgttcatcatacgaaaattaatgcagcggccattgcagatcatcttttaggcaacatgcatacattacatgtgaaactgcaccaatatcactggtatgtaaaaggagccaatttctttacgttgcatgaaaaatttgaagagttgtataacgaaaatgaaaaatggttcgacaaacttgcggagcgtctaattacttctgggcataaacctgcttcgacaacggttgaatttgaaaaatattcgatactttcggaagatgcagttaataaatactctaaagcagaagacatggttgaaaatattatcgaggacttcagaagcaatcgtgacctaactattcgcgcgattcgtttagctcaagacgagggtgacgatgctttagaagatacattgattgcttttaaaaatgacttagacaagaacatttggatgctgcaagcgttcattggtaaagaagcattagaagatgatgacgctcttgatgaggatggagattaa

SEQ ID NO: 678 - DNA, 906 bp, Unknownn
  isolated from dental, unidentified
atgaaaaagatgagtgattataaagtattagcagataagactggtagattggataaagttgttactaatatttttacagattatactcgatctcaattaaagaagatgattgacgatggaaatatcaaggtaaatggagatgtgaaaaaagctaattataaagttaatttaggcgatgaaataacttttgataagccagaagtaaagaaattatctttagaacctgaaaatattccgttagatattgtttatgaagatgatgatgtaattgttgtaaataagcctcaaggaatggttgttcatccatctcctggacattttgaacatactctagtaaatgcattattgtaccattcaccattatctactattaacggtacttatcgtccaggtattgtccatagaatagataaggatacttcaggattattaatggttgctaaaaatgatatggcacatcaaagcctagcaaagcaattaaaagataagactaatacacgtgagtatgtagctttagttcacggaaacatcaaagaagatagtggtactattgatgcaccactagggagaagtaaagttgatcgtaagaagcaagcagtagttaaggatggaagaaatgcagtaacccactttgaagttttgaaacgttatggtgattatactttagttaaatgtgtcttagaaactggacgaacacatcagattagagttcatatgaaatatatagggcatcctttagttggagatcaattgtatggtccgagaaagacattaggaaatagtggccaatttttacatgctgagaaactaggttttgttcatccaagaacaaatgaatacttagaattcacagcgccactgccagaaaacttcaaaaagctattagaatcgcttgacaaacggtag

SEQ ID NO: 679 - DNA, 954 bp, Unknownn
  isolated from dental, unidentified
tttttattaactaaaattaatttggaagtgatgataatgattgtaaaaagtgtctatgagttgataggacagacgcctttaatagagttagatgtgccagtagctaaaggaagtaggattttagctaagttagagtcttttaatcctggtggtagtgttaaggatagattgggaatatctttgattgaagcagcattaaagagaggcgatattgataaagatacgacaattatagaacccacagctggtaatactggaattggcttggctttagcaactcaaaagtatcatttaaagacaattttggtagtaccagagcatttctcagctgaaaaacaaactttaatgagagcgttgggtgctgaaattattaatactcctagagctgaaggcatgcagggagctttgagaaaaagtcgcgaattagctaatcagatcgctaatagttatatacctaatcaatttgaaaatagtgataatcctgatgcttatactagaggattgggacaagaaattatagatgacttacaagcaattaatttgaaattagatgcttttgtggcaggtgcaggaacagggggaacctttgctggaacggccgaaacattacaagcagagtatccagagttaacttcagtagtagttcaaccagagggatcaattttggataatcaacctgaacatcctcatcggacagaaggaattggcgttgagaaagttccaccttttttcaaaaaagtaaaggttgatgaagttcaaaccatcagtgatgatgaagcttttaattatgttaaacaaatggcacaagatcaaggcttgtttattggctcttcatctggtgcagcattagcagcaagcatgcatatggcagaaaaattgccagcaaattcaactattgtgacaatttttccagattctagtgaaagatatttaagtgaaaatatatacgattaa

SEQ ID NO: 680 - DNA, 957 bp, Unknownn
  isolated from dental, unidentified
atgaaaatcgtaaaattgaaggaaccttatgataaaaatgcaattgttgattctccaattgtattagctttaggtttttttgatggagttcatcgtggacatcaagaagtaataaaaagagctatagaaaaaggaaaaagtttaggtgtaaaagttgcagtaatgacttttgacagacatccaaaaatcatctttcaaaatattgatggtgaaaagtttaaatatctaacaatgttggatgaaaaactagaacattttaaaaatttaggtgtagatatagcttatgttgttaagtttgatgaaaatttagcttatctttcaccacaagattttatagataagtatgtagtagggttacatgcaatatgtgttgttgcaggtcaagactatacttatggaaaacatgatattgctaatatggatactatttcggattttgcaaaaggaaggtttgaaataataactgtagaccacttacaacgcaataatcaaaaaattagttctactcagataagaaaagatttagatagcgggaatgtggaagctgctaatttgctattaggatatcaatatgaaaatcatggaactgttgaacatggttttaagagaggaagaaaaataggatttccaactttaaatgtttctatccctaagaatgaacgtattttaggagagggtgtatatgctgttaaagtgaaaatagataaagataattcatggtatgaaggaatggcatctatagggcataatgaaacatttggtgatgatttagaaaaaacagttgagataaacctatttaattttgataaaagtgtttatggagaaaaagttattgttaaatggtataaatttttaagagaaatggtgaaatttgatagtgttgaggaactaatagatcaattaaataaagataaaagagatactgaggtcttttttggagacttgaaaaaaaattag

SEQ ID NO: 681 - DNA, 1323 bp, Unknownn
  isolated from dental, unidentified
atggcaaattttagaggatttaattttaaagagtatatttatcaagcattagacgaaattaattttaaagaacctactgaagttcaagctcgtttaattccgactattttaaagggcaagagcgtggtaggacaatcacaaactggtagtggtaaaactcatacgtttttattacctatctttcaaaatcttaatgcacaaaaagatgaagttcaggcagtgatcacaacaccaagtagggaattagcataccaaatttatgaagcagcaaagcaactagcaaagttttctcctgaaaatatttggattcaaaactatgttggtggaacagataagcaaagacaaattgagaagctgaaatctcatcaaccacaattagtaattggaacaccaggacgtatattggatttagtgagagaaaatgcacttgatatccataatgctcactatttagtagtggatgaagcagatatgacattggatttaggatttttaaaagaaacagatgcaatagcatcgacgttacctaaagacttacaaatgctagtcttttcagctactattccagaaaaattacgtccgtttttaagaaaatatatgtacaatccagttattgaagttgttgctaacaaacatgtaattagtccaacaattgataattggttagtttcaactaaaggtagagacagaaataagcttatttatgacttgctaacaatgggtgaaccttatttagcattagtatttgcaaatactaaagaacgagctgatgagttaacaaattatcttcgttctcaagggttgaaagtagctaaagttcatggtggtattcaacctcgtcaacgtaagcgaattatgcgtgaaattcaaaatcttgattatcaatttgtggtagctacagatttagcggctcgtggaattgatattgaaggtgtttcacatgttatcaatgacgacatccctgaagatttagaattctttgtgcatcgtgtaggtagaactggacgtaatggaatgaaaggtacagcaattacactttatgaaccaagtgaagaaaaattaattgatgaacttgaaagtatgggagttcattttgtaccgaaagcagttaaaaatggtgaaatagttgattcatatgatcgtaatcgtcgtgaaaagcgccaaacacgtaaagaatcaatggatcctaaattacgtggatttgtgaagaaagaaaagaaaaaacgtaaacctggttataaaaagaaaattaagcgagcaataaaacgtgatgaacaacaaaagcgtcgaattgcacgtcgtcaagcaagaaaaatgaagtaa

SEQ ID NO: 682 - DNA, 666 bp, Unknownn
  isolated from dental, unidentified
atgagaagtataataaaaaaagaatttactttaagtaatgaagaacaggagattttagcaagagcttgtcgtataaaaaaattcaagtatgcagaaactatttacaatgaagttgatgatcgtacacactattactatttattaaatggaaatattgaaattacaaagttatacggtgatagggaggttcctttttataaaggtaggggaagatttttccctaattttagtcaaaatgaagagttatgttgtgaaagagtaacagttgcttctaaaatagcgactgtattggttattaaacatgatgttatggagaaattagttagagcaggtaaagaattttgtaatctagtttgggatgatattattgaggaactggattttttaaagagtttatctcaagaaattggtaatcgcaataaactagaagcattagataggacatgtagactatatgcgatatttatagatgagaaagataagcatggacattatgaattaccccgatcattaaatcaagagaaattatctaaaatattaggtactacacgtgtaacagtcaacaaaaaaataaaagaattaagacagaaaagagttcttcttcagaaggaaagaaatatgagaatagctaacaaagcaattgaagaatttaaaaatttcctatga

SEQ ID NO: 683 - DNA, 882 bp, Unknownn
  isolated from dental, unidentified
atggatacgaaaagtttagaatattatcacaaattagttgaagaaaaaaatttttcaaaagttgcggaattttttgaggttagtcaacctactattacgttagctatcaaacgtctagaaaatgaatatcaaacaaaattttttctacgtgatcgatcacataaagaacttattttgactaaagatggtaagcagtttgatagacatgtagtcacaattcttaatgaattagaaattgcacgtaaagaaatttctcgaaatcaggaacaaatgatccgtctaggactgccccctattattagtcagttctatttcccacaaattactccaggtttaacagaaaacaaacttttaagacgaatcgaaccctatgaagaaaaaggatctgctattctattgaaaatgttaaaagatggtactttggacatgtctttgcttagttcaactactccattaactgataagaacttgaaagcacatattatttcaaaagctaattttaaaattattgttagtcctcaacatcgcttagcaaatagaaaaagtgtaactttcaatgaattagtaaacgaaaactttattaatttaaattcaagctttattcatgcagaagtttttaaacactttgcccacgaggcacattttcgtccaactattatcttccagaccagcgatgtcccgttactaaaaagtttggtatctcaaaatactggaatatctttattaacggacttggctttgaaaaacactgacgatctagttgcactagatattgaaactaatattccactaaatttcattgtttcaattgcataccgtcgttctcatattttaactcctaaccaaagtaaactaatttctttattaacagataaaaaatag

SEQ ID NO: 684 - DNA, 588 bp, Unknownn
  isolated from dental, unidentified
gtgaaaatattgaaaggttgggttcttcccattgcaatcggcttattagttggattgttaataaaaacttttgtatttacagttgttcgagtagatggtatctcgatgtttcctaatttacaaaacaaagaattagttatggaaattcaccatgctaaaataaaacgtgattcagtgattgtatttgacgcgtatggagtagataaacgcccagatgttgctaaaaacgcgcgttatgttaaaagagttattgctttacctggagataaggtagaatacaagaatgacggtacattatatgtaaatggtaaaaaagaatcccaaagctacatatctaagaaacagcaaaaacaaggcacattaaatattcaagaagctgctgttgaagaacaaggtgtagcattgggtacaggaaaaataattacagttcctaaaaattcatattttgtcttaggtgataatcgagctgtttcaaacgacagtcgttactatggatttgttcctaaagataaagttaatggtgttgcaaaagttccattttggaatgacaaaaaagatttgataaattcgtatgataaaaatgattaa

SEQ ID NO: 685 - DNA, 1200 bp, Unknownn
  isolated from dental, unidentified
atgaagaataagttaaaagaaaagttaaaatatttcgactatggattatttataccgtatttaattttatgtcttattggcattgtaatggtttactctgctagtgcgattaaccttacttatgtcggagttaaagcaacttcttatctctttaagcaaataatttttgttggaatagggattacattaactttaatttttagtcatatgaatccaaaattttgggttggtaaaaatgttctaagatttggatattggactgtaataattctcctgatgatggctaaatttttatttagtgctattaatggtgctaacggttggattacattaggttcatttagtattcagccagcagagatagccaaactttacttgatagttgcgatttctaaagctttttcaaaaagagaagctgatatttatttaggaaaacataaacgtacgactacgcgaaaaaatttagcagtaaatatcttaccaattttgggcttgattgcaattgaacctgatactggtggcgctacaatttgtgctgcaatttgtttagttcttattttggccaattctaaaaattggagagcaagcatagggattttgggagtagcaatttcaataatagcacttacagttatggctatccatgcaattaatccatttaagggaagtaaagttgagtatatgtataagcgttttgagggttattttgatccatttacatatgcaactacaagtggtaaacagttagttaattctttttacgctatcagtaacggaggattgtttggagtaggactgggaaatagtattcaaaaaagaggatatttaccagaaccctatacagattttatattagcaatcattgcagaagaactaggatttataggagttctagtggttttagggttactattctttataatcttaagaataattttgattggtataagatccaataatactttcaataccttagtttgttacggagtagcgacattttttacagtagaatcaatatttaatattggcgctgttaatggactactacctattacaggtgttacattgccttttatttcttatggtggttcaagtatggtggtattgtctatggctttagggatggtaatgaacatttcagcaaatgagaagagacatacagcaagaaacatgtttttaaatatggagttgaagaaatag

SEQ ID NO: 686 - DNA, 1002 bp, Unknownn
  isolated from dental, unidentified
atgtttgaaagaacttgtgatttaatagaaaatttatataaagataacattgttcctggtgtatcatatgctgtaataaagcccggagaagtattaactaaagtcatagggaacagtcaggtgattcctaaagtagaaaaactaaaagcaggcatgttatatgatatggcttctttaactaaagttgtaggaactacgactgtaattttaaagttagttgaagataacaagatatcaattgatgacaaagtgatggattatctaccattatttaaagatgatagagttacaattagacatttattaactcatacttcagcattaaatgggtatataccacaccgaaatgagctaaatgcacaagagttaattaaggcgatgtacactctaaaagtaggagactggttaggaaaaaaagtgatatacacagatacaggattaatattattaggagaaataattcaaaaaatatataataaacctgtacagacagttataacgcaagaagtgttacaaccattgcagctatttgaaagtacattcaatccggatccgagattgtgtgttcctactgaggttcaaaaaaatggtaaagtcttgaaaggggttgtacatgatcctaaagctagaattttaggtaaatattgtggatcagctggtctatttatgtcgttaaatgatttgattaagttttctaattggattatagataattcaaaaaacaaagtattaaaagacaagacaatatctaaattgtttaatgattggactcctaacgggactttggggcgatcgctaggctgggatttaaggtatagaaacgatagagttccatgtatttatcatacaggatatactggtacattcattttaatagatagagatagtggatgtggattaatagtattgagtaatagggttcatccaagttctaataatcaaatctttttagatagaagagatataattatatctacttttcttgatgaaattattaattaa

SEQ ID NO: 687 - DNA, 1029 bp, Unknownn
  isolated from dental, unidentified
atgcgcgaggaagtagagttgattgagtcaatcgttccagatttaattgatgttctaaggaaaagattcattatcttaagaaatattgattggtctgaaccagttggcagaagagtattagcacaaaccttgggcatgagtgaacgagttttgcggactgaaacagattatttgaggaagcaagaattaattgcttcaacaaagtctggtatgattttgactgctaaaggtaaaagaacaatacaaggcctttccaagttgatggactctttattagggttacaacaaatggagaaagaattatctcgatacctaggtataagaaactgtttaattgtttcgggagatagtgatagacagcctttgattattgaggacatgggcaagttagtaaataatattctaggtaaggaattgcctaagggtaaaaatgtcattgctgcaatgggtggtactacgatggccaaagttgctacctgtttgactcccgaaattgcagtagatagagatttgactttcgtgcctgcccgtggtggtataggcgaaaggttagatattcaggcgaataatgtatgtggcttaatggccgaaaaaactggtggtaatcacaggacattgtatgtgcctgaacaggttagcgaagatacttatcgtccgcttcttaatgaacccgtagtacaagaagttgtgaatttaattagacagagtaatgctgctgttcatagtataggtgaagcaattagtatggcagagagacgttcgatgcctaaaaatgtgttagcaatgctaaaagagcgtaaggctgtgtctgagacttttggttatttctttgacgataaggggaaagttgtttacaagattcctagaattggattgcaacttgaagatctcgcaaatatggattgtataatcgctgttgctggtggcagttctaaggcacgagcaatagcagcatacatgaagaacgctcctgagaaaacatacttgattactgacgaaggagctgctaagatgattttaaaagggtag

SEQ ID NO: 688 - DNA, 1695 bp, Unknownn
  isolated from dental, unidentified
atgttgaagaaaaaagctataatgataggtgctggtctagcaaatatggctggtgcagtttatttgattcaagaaggaaattggaatggtaaagatattactttctatgctttagatacacatggtgctaatgacggatctactgcttctgaagctgctgaagaatattggaataaaaatcatccaatggaaaatacaaagggatttattgctcgtggtggacgtatgttaaactatcgtacatacgttgatttgatggatttattggacagaattccttcagttacagaaccaggcatgacggctgctgaagatacacgtgattttgatagtaaacatcgtacctatgataaagctcgtttgcttcaaggaggcaagggaatcgttgatggtcacaagcttggtttaaataacctagatagaatattactttcacgtttagttatgatgcctgataatcaagaagaaaaattagataatgtgacaattgcagaatattttgaagattcaccacatattttccaaactaatttctggtacatgtgggaaacaacttttgcatttagaacacaatcatcagctcaagaattaagacgttacatgcatcagatgatttatgaatttactcaaattgaacatttagtaggggtaaatcgtacacgttacaaccaatatgaaagtattatgttaccactaattaagtatcttgaaggacaaggatgtaattttgttatgaacagacgagttacagattttgaatttaaaaatacaccaatgcaagatgaaattactgtaactggtttagaaatggaaaacatcgaacaaggcacagtagaacacgtaactgtagatgatgaaacagttgtcttctttactaacggatctatcacagattctgcaactttaggtgatttcaacacgccagctcctgaaaatatggattatggggcagcttcatcattatggaagaaagcatgcgaaagattttataacctgggaaatcctgataaattcttcaatgatagagatgcatcagaatgggtaagttttactttaacaactaagaatcatattttattaaatgaaatcactagaattacaacacaagttccaggaaatgctttaaattcattcattttaactgaacctattacaccattaggacataaagatgttaatatgtcgattgttgtacatcatcaaccacactttacaacacaaaaagctaatgaatctgtaatttggggatacttcttatatccacgtcgtcgaggagaatttgttgataaacaatatatcaagatgacaggtaaagaaatgttgcaagaattgataggacaattatctaaagtagatcctggtccacacaatatcatggacttagaagatgaaattatggacagtgttatcaattgtatcccagtatacatgccatatgcttcagcattatttaacaatcgtgctaagagtgatcgtccagaagtaattccaaagcattctacaaacttagcatttactggagaatttgtagaacaaccatatcaaatggtatttactgaacaaagtgcagttcgttcaggtgaagttgctgcattccattttgcaggagtgtcagaggctaaactagttaagaatccacgctttgataaagatccaagagtattgcttagagcaacgaagagaatgtttgaatag

SEQ ID NO: 689 - DNA, 1227 bp, Unknownn
  isolated from dental, unidentified
gtgagaagtaatcgatatgttgttgccttagcgggtgttatctttcatttaatgattggttcagtttatgcttggagtgtttatgcaaagcctattgcaagtcaaacttcttggtcagaatcagctatttcatttgcttttagcttggctattttcttcttgggaatgtctgcagctttcatgggtcgcttagttgaaaaattcggtcctacagtgacaggaactatttcagctctcttatttggaacaggtatcattttgacaggtgtttcaattcatttgaatcaattatggatgctttacttgtcatatggggtaatcggaggattaggattaggttctggttatgtaactcctgtttctacaattatcaaatggttcccagataagcgaggattagcaacaggtttggctatcatgggattcggatttgctgctttacttacaagtccaattgcacaaagattaatgagtgtagtagggttagaaacaacattttacattttaggtgcattttacatgattgttatgcttattgcagcacaatttattaagcgtcctaaagaaggcgatgttccagaagtagcagttgctaaaggtaataaagttagtttaggtgctcaacttacagctaaccaagctttaaaaactaaagcattctactccttatggtttatgttattcatcaacattacttgtggaattggtttagtatctgcagcttcacctatggctcaagaaatgactgctatgaatgcaggtgcagcagctgttatggtaggtgttatcggattatttaacggttttggtcgtcttatctgggcgacattatctgactatatcggtagacctttaacatttagtttgatcttcattgtagatattatcatgttagcaacattactaattttccacgtaccaatggtatttgtcgtagcattatgcttgttaatgtcatgctacggcgctggtttctcagtaatccctgcttatttaggtgatgtatttggtacaaaagaattaggtgctatccacggttacatcttaactgcatgggcaatggcaggtatggttggtccagttttactatcctacactcaccaaatgttacatagttatgcaacaacaattataactttcattattgttgatatggtagcattgtttgtctccttctgggtacaacgtgacattttgaaaattaagaaacaagtatttgaaaaataa

SEQ ID NO: 690 - DNA, 1278 bp, Unknownn
  isolated from dental, unidentified
atgctagatattaaagatattcgattaaatacagaagaatataaacgtcgcttgggaacaagaggcgtaaaaccagaagaaattgatgaattagtagctgaagacaagaaacgtagagagttacttgttgaaactgaaaatttaaagaaagaacgtaatgaagtttctgaagctattgctcaagcaaaacgaaataaagaagatgctagtgaacaaattcaagcaatgcgcaaagttggtactaagatcaaagaacttgatgaaaaactagctaaagtagaagaaaatgtaaaatctatggctgctcacttgcctaacttaccaaatcctactattccagtaggaccagatgaagattcaaatgttgagctttataaagtaggtacaccacgtaaatttgattttgaacctaaagcacactgggatattggtgaagacctaggaattttagatttcgatcgcgcagctaaagtttctggggcaagatttgttttctacaaaggattaggagcaaagcttgaacgtgcggtttataactttatgttagatgaacatgctaaagaaggttatacagaagtaattcctccatatattgttaaagctaaatcaatgtatggaactggccaattccctaaatttaaggatcaagtataccaagttaatggggaagatatgactttaattccaacagctgaagtacctctaactaattattatcgtgaagaagtaatcccaacagaagacttaccagtttactttacagctttatcaccatccttccgctctgaagcaggaagtgcaggtcgagatactcgtggcttgatacgtatgcaccaatttaataaagttgaaatggttaaatatactaagccagaagattcatataatgaattggaaaaaatgacaaaaaatgctggtaacattatggaaaaactaggattaccataccatgtaattactctatctactggagatatgggattcagtgcagctatgacacatgacttagaagtatggatgccagcacaagatacttatagagaaatctcaagctgttctaattgtgaagatttccaagctagaagagcaagaattcaatatcgtgatgaaaatggtaaactacaatatgttcatacattaaacggctctggtttagctgtaggtagaactgtagctgctattttagaaaactaccaaaatgaagatggatcagtaacaattccagaagcattacgtccatatatgcaaggtttagaagttatcaagaaagaaaaataa

SEQ ID NO: 691 - DNA, 2085 bp, Unknownn; identical to SEQ ID NO: 167
  isolated from dental, unidentified

SEQ ID NO: 692 - DNA, 1146 bp, Unknownn
  isolated from dental, unidentified
atgactttacaagaaaatgaattaataaaaatccgaagagatcttcatcaaataccagaaatcggtttggaggaatatgaaacttctgattatttgttaaaaataattaacggcttaccacaagagaatttagagataaaaagatggaagacagctatcttggttcatcttaatggtgaaaataagaattataccataggttatagaactgatattgatggattaccagttgaggaaaaaacaggtttgccattttcatcaaagcatgaggggagaatgcatgcatgtggacacgatattcatatgacggttgctttaggtgtattaagttattttgctagtcatcgtcctaaatataatatgacatttattttccaacctgcggaagaaaatgcaagcggtggaatgaaactttatcaaagtggtgaattagacgaatggatgccagatgaaatctatgcattacatgataatccacaacttcctgctggtacaattggttgtcgtaaaggtactttgtttgcaggtacatgtgaaatacatgtgaaatttattggtaaaagtgggcatgctgcatatccacatcaagctaatgatatggtagttgcaggagctcaattcgttaaccaaattcaaactattgtaagtagaaatgtcgatccgattcaatcaggtgtagttactttaggtcatttttctgcaggaacaacaggaaatgtaatttctggtgtttgtcaaatagatggaacaatcagagctttaactcaagaaaataatttgcttattcaaaagcgtgtacgtacaattgctgaaggaatagcacatagttttgattgtgaattggaaatcgatttacatcaaggtgggtattatcctgttgaaaatgatgataatacaacagaagctttcattaattatatgaaaaatgaagatgatgtagattttgttgaaacattacctgcgatgacgggagaagactttggttatttaatttcaaaaattccaggaacaatgttttggttaggagtagatagtccttattctctacattctgaatatttagcacctaaagaagaatcaattatgttaggtataaatgcaatcacaggttatcttaaaaatagacaagaaagtttaaataaatag

SEQ ID NO: 693 - DNA, 2268 bp, Unknownn
  isolated from dental, unidentified
ttggataatgaaaaagctctggaacaaaaaagagtagatgatgtaatgaatgaaattcaaaagcaattagatgctactcaaattgaatatgataaagctcacaaggaaactacttcggttgaaagaaattatgttcaaaatgctagagtcaatacatatgaagttgatgatcagatggaaacaaacgccgaaattcaacagcaaaagaacttggttgcaaaaacgattgaaaacgaaacaattttaaagaaacaattatccactctaaaaattctacaagattctgcttacttcggtagaattgatattcatgagaacggagaagaagattccgaaactctttatatcggaacatcttcattagtagatgaagatcaagattttctcatctatgattggcgtgcccctatttcttctatttactacaatggtacacttggccctgtatcctatgaaacacctatgggagaacaatttgctgaattaaaaaagaaacgtcaatttactataaaaaaaggtgtcattactaatatgtttgatactaatgaaacaattggtgatgaaattttacagagtgttttgggagaacattctgacgaatacatgcgtaatatcgttgctactattcaggctgaacaaaatgatattatccgcgatgttaaacatgacttgcttctagttcaaggagttgcgggttctggaaaaacttctgctatcttgcaaagaattgcttttcttttatatcatagtcgtgacaaacttaacgctgaacaaattgtgcttttctcacctaatcttttattcagtcactatatttctgaagtgttgcctagtttaggtgagaaaaacatgcgccaaattactttggcagaatttcttaataatcgttttgagggattacaagttgaaagtctctttgataaatatgaaaagaagatcacttcttctaaaaaaacaaattcaattgaaagtattaaggaagatccacaatttatgcatacagttgaagaatatgtccaaaatgttagctcatcccaactaagatttactgacattatgctagattccgagattttctttagtcataatgaaattcatgatatctattcccaacttccacaggctatgaaacctagtcaaaaatttgctgaaactaaaaacttacttattaaacaattaaacagaaaaattaaagaaaatgctcaagctgattgggttcgtagtgaaatcgaaaacttatcagatgaagaatactatgatttacttggtactaaaagacgtcatgcctttcaagcaattgatgatgaagaattttacattggtagaaaaatcgtaaaaaaacgctttgcccccgtatatgacgctttatataacaattattttattgactactatgctcaatattctgattttttagccaataaattaccagaagctgttgacctttttaatcaaaatttggagtttcataaaatagatttagtcgatgctgctcctctgttatatttacgtgatttactaacaggtagtggacgtaatcaagctattgcacatctatttattgatgagatgcaagattacacattaccacaattaatgtatttaaagtatattttccctaatgctaaactcactcttttaggtgatagtgaacaagcattgttcaacgaatttagaacaccacaagaattactagattactttaacaaacatctcaatgtcaaaaaatcacgcatcatcaagttaaataaaagttatcgttcaacacaacaaataactaattttatgaaagctttattaccagatggcaatgaaattcaagcttttacacgccaaggtaaaaagcctgaattaattatcgcttctaaagaaaatggattacatgcattgaaacttgaattaaagcaacgtgatttaagttctccagttgctttaataactaaaaaccaagctgaaagtgacttcttatatcaaaaacttcgtaaaagtttcgattctgtcactttactagaagataaagatcgttcattgcctaagggtatcgttattttaccaatttatcttgctaaaggattggaatttgatgatgttatagcttatgatatttcacatgataattattctggaataaatgatactggaattttatacacaatttgttctcgtgcgatgcacagactaactttaatttcatgtggaaagccatcatctttaattatgagtattccatctgatttatacactactaagtcaaccgttactttataa

SEQ ID NO: 694 - DNA, 1647 bp, Unknownn
  isolated from dental, unidentified
atgaatgataataatgaacaaataaaaaaagatttagaagaaacttcttctaaagaaaaaatgttgaaaggctcagcttggatgacagctgggagtattttttctagaattttgggagcaatttacattattccatgggcaacttggtttggagttaattatctacaagcaaatgccttatttactaagggatacactgtttatgcattatttttgatgctgtctactgccggaattccatctgcagtgggtaaacaagttgcacattataattctctcaatgaatatggaatcggtaggcgattatttaagcgaagtttaggtgtgatgatgtttttaggaattatcagtgcaatgattttgtggtttattgcaccattaatttctcaaggggatgcagcagttattcctgtatatcgttctttagcggttacattgctattgattccagtaatgagtttaactagaggattttttcaaggatattttgatatggctccttttgctatatcacaattagtagaacaagttgctagaattgtttatatgttagcagcaacctatttaattactcaggtgttacatggaagttaccaaagcgcagtagttcaatcaacttttgcagcatttataggagctgttggtggcttattagttttattatggcattattggcgaaaacgaccaactatgaattatcttttagcccacagtaataataaactagaagtctctgataagagattaataaaggaaatattgtatcaatcgatacctttcatcattattgggtcaactacaactttgtataatttatttgatcaatttagttttccaacaattatgagttttgttactgattatagtactaaagaaattaatgcattatatgctttatttgcgggaaatgccaataaattgataatgattactatttcagttgctgctgcgatggctgacactgcaattccattattgtctcaagctgttacaaaaaatgataatgaagaagtttcagctgctttattagattcggtagaattattcttttttgtaatgttaccttgttcttttggaatggctgcagtctctagaccactatatgttttattctatccatatgattatacaggtatctttgtattagctttttcatcatatatagctttagcattaggcttatttatggttttagcagctttacttcaaggaatatatgaaaatacaatagcaattaaatttgcggtaattggaatgattgtcaaagttataatacaattcccattaacagcatttttacatgtatatggtcctttagcagctacaggtataggaatgaccgtaagtaatgtattaatttttagatacttgtatttcaaatataatttaaatattaataaattacagaaaaatactaatatgatgatgttatttagtttatttatgtttattgtagtactcgttatatcatttgctttaggaaaagtaacaaatacatatagtaaattccaatccaccattgtgctaataattggagccggaattggaggatatatttatgctttcttaagtttgaaggcaagactagctgatgatattttaggtgctagagctaactttttaagaagaatattgagaattaaatag

SEQ ID NO: 695 - DNA, 1902 bp, Unknownn
  isolated from dental, unidentified
atggttaataacgaattaataaaagatgacttatatatggctgtcaacggcgactggttaaagactgctaaaattccagctgataaagctgctacaggtggcttttatgatttagccgatgatatcgaaaaaactttaatggaagatttcgctaattttatgacaggtgaagcaatatctgatgataaatgcttaaatgaattcattaaatattatcgtctcgtttccaattttgaaaaacgtaatgctgatggatttaaacctgctaaacaatactttgataagattacttccctaaaagacattaatgattggcaagaaaagctctatgatttaactatgatgggactacctaatcctttcccattatatgttgaacctgatatgaaggatactcaacactatgccctatatgcatctgtacctagcttaattttgccagataaaacctactatgaagaaaatcaccctcaagctgaagcatttctcaatgtttatcgtcaaatggttcttgctctatttgaacgtgctggctatgacaatgactttgcacaagtaactttagaaaaggctcttgcttttgataaatcacttgctcctgttcaaaaagatagtactgaacgtgctgattatgctaaatcctataataaatacagttttgaagattatacagcatttagtaagagtgtagatttaggcgcttttgctaagaaattaatcgatcaaactcctgatcaagtcattgtagatgaacctaaatattatgaagcattagaaactctgattaatcctgatactttcgaaaacttcaagagttggcttttagtaaaaactctcatcagtgtaagtaccctattagatgatgatactcgtgttacagctggcacatattctcgtgctttgtctggttctaaagaagctatgaaagctcaaaaagctgccttttaccttgctactggtcaatttagtcaagtagttggattatattatgcacataaatattttggtgctaaagctaaggctgatgttcatcatatggtagaaaagatgattgatgtttataaaaatcgtcttgcttccaatgattggttgagtgatgatactcaccaaaaagctattgttaagcttaatactttgggaatcaatgtaggttatcctgataagttagatccactttatactaagtttgttgtcgatgaagatgcagatttagttactaatgacttaaactttactcaaattagccttaaggaacactatggtcattggggtaaagatgttgacagaagtcgttgggaaatgccagctcacatggtaaatgcttattataatccttcatttaatatcattgttttcccagcagctattcttcaagcaccattttatagcttagatcaatcttcaagtgaaaactttggtggaattggtgcagtaattgctcatgaaatttcacacgcatttgacaacaatggtgctcaatttgatgagtttggtaatttgcacaattggtggactgatgaagatttgaaacatttccaaggactcgctcaagatatgattgctgaatttgatggtttagaaactgaagcaggtaaagttaacggaaagcttgtagtttcagaaaatatcgctgatgctggtggtctaagttgtgcgctagaagctgctaagagtgaaccagatgttgatctaaaggccttcttcattaactgggctcgcatttggagaatgaagtcttcaattgaacgtcaaaaattattattatcaattgatgttcatgctcctcacgtattacgtgctaatgttcaacctaagaatctagctgatttttatacaacatttgggatcacatcagatgacaagatgtacctcgctcctgaaaaacgtgtaaatatttggtag

SEQ ID NO: 696 - DNA, 885 bp, Unknownn
  isolated from dental, unidentified
tttattagctatcttaggcatattatcactaaggtggctttttgttttaaggaggattttattatgcaaaaaataacagaaaagatcacagttgcaggtcatacagctgaattaatgggatatacaattgaaaagaaaaacgactggggagtacaagataagcatgctacaattatcatttgtcctggtgggggttaccattttgtttcagatcgagaagctgatccagttgctttgaaattaataactatgggatataatgcatttgtattaaactatacttgccaagttagatatcctgtagccttggaacaattagcccaaagtgtaaaattagttagagataatgctgatgagtggaatgttcgtgaagataagattattattatgggaatgtcagctggtggtcacttagctgctagtttaggtgttaaatggaatagcgatgaattaaaacaaatgggatataagccagaagaaattaagccaaatggtttagtattatcctatcctgtcatcacaactaataaagatttttggcatcaaggttcctttgaacaaattttaggtaaagatggaattgaagatgaaaaagctttagctaaccaatcacttgaaaagttagttactgaggatgtaccaccagtatttatgtggcatacatttgaagataaggctgttcctatggaaaatagtttattatttgcctcagcattgagaaaagctggagtatcaacagaatatcatatcttcccacatggccctcatggtttggcattagctaacgaagaaacagctcgtgtaggtcgtccagaagatattgaaccacaagctgcacaatgggtagatttattccatagttggatgcaagcacttcttaagtag

SEQ ID NO: 697 - DNA, 996 bp, Unknownn
  isolated from dental, unidentified
atggtttcaatcaaaatgtttggtgttcgtgatgaagaacgtccaatggctgaaaactgggcaaaggaacacaacgttaaaattgatatgactagtgacatccttacatctgatactatcgatgaagttaagggttttgacggtctaactttaatgcaagtagcagaagttacagatgacttatatcctaaattgaaagaatttggtatcaaacaaatcgcacaacgtagtgctggttatgatatgtacaatttagatgctgctaaagaaaatggcattattattactaatgtgcctagctactccccagaatcaattgctgaatatactgtaactacagcattgaacttagtacgtaaattcccactaattgaaaaacgtgttaaggaacataatttctcatgggaacctgaaatcagaggtcgtgttatcggtgacatgacagttgctgttatcggaactggccgtattggttaccatgtagctaaaatcttccatggttttggtgctaaagttgtcggatatgatctatatcctagtgacaaattagacggtatcttggaatatcgtgattctgtagaagatgcaatccgcgatgcagacattatttctttacatatgcctgctttcaaggaaaaccaccacatgtttaactacgaaatgttcaagaaattcaaatctgacgctgtattagttaacatggctcgtggtgctttaattgatacagaagatttattgaaagctttagatgatggccttttggctggagctggtcttgacgtttacgaacacgaaggtccattagttcctattgacctaactggaaaagatattgaagacgaaacattcaagaaagtacttgaatctgataagattatctactcaccacacgtagcatactacactgatgaagctgttagaaacttagttgaaggtggcttaaatgctactttggaagtattggaaactggcgatgcttcaacacgtgtaaactaa

SEQ ID NO: 698 - DNA, 1395 bp, Unknownn; identical to SEQ ID NO: 250
  isolated from dental, unidentified

SEQ ID NO: 699 - DNA, 1614 bp, Unknownn
  isolated from dental, unidentified
atgaagtttaaaaagctattagcagttggcgctactttagcagtgtcagcattcacattagctgcttgtggatcaaagagcggcgattccggcaaaactcttcactgggaagacagtgctgaaatttccacattagacccttctaaagtaacagacgttgttggttttaaccaattaaacaatgttactgaaggtttatatcgtttaggaaaagacagtaagatcacaccaggtcttgctacaaagacaaccgtaagtaaagacggccttacatatacatttactttacgtaaggatgcaaaatggtctaacggtgataaagtaaccgcaaaagactttgtatattcctggcaacgtacagtaaatcctaagacaggttcacaatatgcttacctattcagtggtattaagaacgctgacgctattatggaaggtaagaagtcagtttctgaattaggtgttaaagcagacggtgactacaagttagttgttacattagataagaagattccatacttcaagttattgatgggattcccattattcttcccacaaaaccaaaaagttgttgaaaaatatggtagcaagtatggtacagcttctaagtacttcgtttatgacggacctttcaagcaagaaggttggacaggttctaacttaagctggaaattagttaagaacgatgattactgggataagaaagctgttaaattagacaagattacttaccaagtagttaaggatactaatacaggttacaacttattccaatctggtaagttagatggtacattattaagtgctgaacaaacaaagcaattaaagggacaaaagaactacacagtcttccacgaaagtacaacattctacttacaatacaaccaaacaaaagaagaatttaagaacgctaatatccgtaaagcaatttctctagctatcaatcgtaaggactacttaaaagttcttggtggtgaaaatacagctgctacatctgtaacaccagttggattgacaaaagttaatggaaaagacttccaaagcattgtatctgacaagacagatatgacatacaacaaagctaaagctaaagaattgttcaacaaaggtttacaagaattaggtaaagataaattagaatttgctattttgacagatgatacagacaccgctaagaagtctgttgaagctcttcaaagtcaattgaaagaagcatttggtgataaggtaacagttaatacacaaacagttccatttaagacacgtctatcccgttcaacaaacggtgatttcgatgtagtattatcagcttggggtgcagacttcgctgatcctatttcattcttagacttgtttacatcaaacaacgaacaaaataatggtaagtggagcaatgctgaatatgacaagttgatcgctgcttctaagaatgctaattctgcaagtgatcgttggagtgatctagaaaaagctgaaaagatcttacttcaagatcaaggtgtaacaccactttactacagaaaccaagcatggatggtaaatgataaagttaaaggtatcatctacaatacagcaggtgctaacttgaacttcaaggatacctacatcgcaaaataa

SEQ ID NO: 700 - DNA, 1143 bp, Rothia mucilaginosa
  isolated from dental, Rothia mucilaginosa
gtgaaagaaatggttgcttggcaagctgcttggtattatgagaatattgatttttcggcgatgccatttaagatgagagaattatcgcaattaataaaaattacgtcttttttatcaggtaaagaattacgactaaaattaaccaattactatggcaaagaagaactcatttttgatgaaatttatgtagctctaacagctgatatgaaagaaaagcaaagagtaacagctttgtatcaagatacgattgtaattccacaaggagaagtaatttggacagattcaatagacttagatattaaagttggacaaacaatctatgtctatatgaagtcttcgcaggaacaagaatactgtgattttaagtgtacttatgaaacatcattaaccaatgcctcttttgctcgtagtgctaatttcttacctaaattaagtgatacttggcaaagtaggaaaggttggttttgtttagaagaagtagacgtatggacgaaagcaaatcctaaatatttagaaattacaggtgattctctaatggaaatgggaatgataacggctcccctaatgcaatatttgatgaccgtacatcctgacgaagtaacagtgctaaataccgctatttctggaagtcgcttaattcatgatgcccctcatgatcaacccatttatgaaacttttggagagagtttattaagtagaatggttagaaacaggagtggctttaaacctgaattgacgattgtttcaattggggcaaatgatttgatgctaccattgatcagtgaagtagctgcaagacaaaaaataactaaggataatttttttaatgctgtccagaggctaaatgaaattttagaaaagcgcaatagtgaattaatcttgctagatataccaccatttacacttagtcacactggtcggccagatgataaagagctacaagcacaaaaatttagaaaagaattaaatagcaaacttgctacaattcctgaaacagtgcccacatcacttcttttagaaatgttaccatgtggcgtacaaagtgcatatgattttggtgaccatatgcatatcaatcaggctggtggtagggttgtagccactaaactaatccctaagatagaacaagaactatttcattaa

SEQ ID NO: 701 - DNA, 882 bp, Unknownn
  isolated from dental, unidentified
atggcggattcaaaccaatttaatttatcagaccatgactatgcgacaaaagagttatctaactcattgataagcaaaatagaatatttaaaggttttaaacgatgctattgacgagcaagacgaccgattagtttatcaattaatagacggtcaacgctactccaaagaaattttaaaagcaaaacatagcgtagcagatatagaaaatgaaagtttaattttagatgttcatgataaaataagtgcttttttgagtaaaaagttaattacttatttacgtgaaatgtatcctttcttttattttgaagagataggtgtagggcgttttcaattttattttggaaattggtggggacgacgcttatttggtgaattagatgtattgaatgtcgaattcaaatttaatgctgaagaatacgaaaagttatctcgagcatttgaattagaagtagagaataaaagatataatacagatgaaattaataaaatttctgaagagacagattctttacaagagttaatagacggacaagacagtcgtgatcaacgtaaagatgaaataagaaaagaattgaagagacaatctcaggaaaaagtaagtttctgggagcaatctaaacaaaaggaacaaagacaaaagttaatgtcggagttatcaaaactaactgatttagatgaagcagcaaataatgcgtatcaaaagattcgtgaaaatgaagaaaaagttttgaatttgtcgaaagaagatacattattaggctatgaaaagcaaagtattattacaaagtttggtacatttgaaaactttattgaccataataattctctatatcgtgattatattgctgatttaattgcaagaaaagggagagtagattag

SEQ ID NO: 702 - DNA, 1458 bp, Unknownn
  isolated from dental, unidentified
atgaagaagtttattacatttttaagtattattagtagtttaatctttctttcattttttgttaaaccacagttagttcatgcggatgaaaaaacatatacaatagctactgatgtaacatttccaccatttgaatatgcgaatgatagtaataaatatgtcggcattgatattgacttgatgaatgctatagctaaagaagaaggatttaaagtggatctgaagccaattggttttaacgctgctttgcaatctgttagtgctggacaagttgatggaatgatcgcaggaatgacaattacagatgaacgtaagcaaaaatttgatttttcgaaaccatattattcatctggtattgttatggctgtaaaacctgacagtaatattaaaagtttaaaacagctacgcggaaagaaagtagctataaaaacagggacttcaggtgcggattatgctaattctataaaagataaatatggattcaagactgtaacttttgatgattcagataatatgtataatgatgtgaaaaatgggaattctgttgcatgttttgaagatagtgctgttttagaatatggtattagcacaggtttaggattaaaaatagtaactaaaccagctaattctggtgattttggttttgctgtaaaaaaaggaacacaccaggaattaatgaataaattcaatgatggtttagataaacttaagaaaaatggaaaataccaaaagataattgaaaaatatacaggtaaaagtgcaatttcagctactaaagaggctaatgaaaagaaaagtaaagatagtcatactgtcttaggactattaaaacaaaataaaaaggccttcttagatggaatagtagaaactttaaagttgacagtagttgggattataggtgcaactatttttgggattctaataggaatgttaggtgttgtgccaaacaagtttgctcaaggtatttctacaacaataatttatatttttagaggacttccattgttagttctagctttgtttatttacaatggtattcctagtttaacaggatcaaaaattccagcatttatcgccggaattattacattaactttaaacgaaggtgcatatactgcagcctttgtgaagggtggaattgaggccgtagataaaggtcaaatggaagcagctagaagtttgggactttcatttggcaaatccatgagaaaagttatcttacctcaaggtgttaaaattatgattccatctttcattaatcagtttataattacattaaaggatacttcaattttatctattataggtatattagaattaactcaaactggtaaaatcattattgccagaaacttagaaggttttagaatttggggtattatagcaataatgtacctattaataattacaattttgactttattatccaaatggattgaacggaggataaataactaa

SEQ ID NO: 703 - DNA, 807 bp, Lachnospiraceae bacterium
  isolated from dental, Lachnospiraceae bacterium
atgaaaattattacttttactgctatcaagggtggtgtcggtaaaacaaccttgactttaaattatggtgattggttagccaaacatggcaagaaggttctattaatcgatttagatcatcagtgtaatttaacaaccgtttttgaaaagacacgacgcaacaataccatcgctgaagcatttaaagaaaacgataatgctcaaaaagtaaaaattgacagtgtcggaccaaatctagatttaatcgccggttttatagacctagatgttttgggaagttatctagaaaataacagtaacaaagaaatgatgttattcatgtggtttaaaaacaactccgattcattaaacttaaccgactatgactatatcttaattgatacacacccagattttagtaccatcactaaaaatgctattgctatcagtaattaccttcttagtcccatcacacccagtgagcatggttacaatgctaagtttgacctagaaacacgactcgaaaaattcagaaaatcactttttgattatcgaactggcgaaacttacgtagacgcaaaacttttctttatcgttaatatgattagacataatacaagtatgtctcgcgatttgctaaaacatatagaaggtgatgaaacagtcgcaactataattccagaaagagagctctttaataaagctactgcaaggcacgcttcgatatttgaattagccaatcatgataaatccgttttaaagcaaaatcaaaagttcataaaaaaagccgatcatctttttcaagaattagcaagtaaaaccaagtaa

SEQ ID NO: 704 - DNA, 933 bp, Unknownn
  isolated from dental, unidentified
atgaagtcttcatctaaagttatgaagggtatcttctggtcagctgtcgcttcagcaacatggggtatttcagggaccacaatccaatttatctcacagaatcaacatattccgacagattggttcctttcgacacgtacattaggttcaggaaccattcttctaataattagttttattttatatggtaagaaaacatttaatgtattttcaacatggaaaagttttggtcacttgtttgcttatgcaactttagggttaatggcaaacttattgacattctacttagcaatccaaagtggtaatgcttctgcagcaacaatcttacaatacttaagtccactttttatagttctaggtggtatttttattaaacatcaaagacctttatcaacagacttgatagcatttatcatttcactgttgggtgttttactggcaattacaaagggtgatttaacccaaatgtctatcccaatgaattcatttttatggggactaggttcaggtattactgctgctttctatgttgttttacctagaccaattgctcaagataatccaccattggtagtattgggctggggtacattcatcgctggagtattattcaatttataccatccagtttggataaatacaccacacattacatcaactgtggtcttatctatttccactgttattttagtaggaacaatcattccatttggattacttttatatagttctagatttgctccttctgatgttattagtattatggatgccttacaaccagtaacaacttcaatcttgagtgtgattttcttaggattagaaatgaactgggtagaaatagtaggtattatcttggtaattgttgcaatttatattttgcaacgtggccgtcgaaatatggaaaaaatcaattatcgtgaagatgaattttaa

SEQ ID NO: 705 - DNA, 435 bp, Unknownn
  isolated from dental, unidentified
atgttagtaccaaagcgtgttaagcatcgtcgtgaattccgtggtaagatgcgtggcgaagctaagggtggtaaagaagttacttttggtaaatatggtttgaaggcattagattctcactggatcactaaccgtcaaatcgaagctgctcgtattgctatgactcgttacatgaaacgtggtgggaaagtttggattaagattttccctcacaagtcttatacagctaaagctattggtgttcgtatgggttccgggaaaggtgctccagaaggttgggtagcacctgtaaagcgtggtaaagttttatttgaaatcgatggagtttctgaagaagtagctcgcgaagctttacgtttagcttcccacaagctcccagttaaaaccaagtttgtacaacgtgaggaagtaggtggcgaatcaaatgaaggctaa

SEQ ID NO: 706 - DNA, 1905 bp, Streptococcus mitis
  isolated from dental, Streptococcus mitis
atgcaacaatatatattaagcaagaaaaatgttatcaccgtcatcagtggattgttaatcgcactcggtttcttcagtcactttgttttagaaaacgtaggactttcagagtggtctttgatcatcgcctctgtctttgggattacgccaattgccattcaagcgtttcaagcaatgaaagtcaaagttatcagtattgatgtcttagtcagtattgcagcgattggtgcgctttttattcaaaattatgaagagtcggctattgtcacgttcttattcctattcggacactacttggaacaacgaacattgaaccaaacgcgatctgctatcaaagaattgactgaaatggcacccgaaagcgccttgaaacaaatggataatggcaaatttgaagaagtagaagtggatgatgtagatgaaggggatatcttgctcgttaaaacgggtgcgaaagttccagtagatggcacagtccttacgggcgaagggcatatcaatgaagctagcattacaggggaagctgttccggtcaacaagctagctgatgcagaagtttttgcaggaaccattttagaaaacggaacgattcaaatcagagctgaccgagttggtgaggacaccacatttggaaaaattattgaactcgtggaagaagcacaagattctaaatccgaagcggaacggttcattgatcgcttttctaaatactacacaccagctgtcttggttctggcaattgttgtatgggcgttcagtcaaaatattgagttagcaatcaccatcttggttctaggttgcccaggcgcattagttatcggagtgcctgtctcaaacgttgccggtatcgggaatggtgcttgtaacggtgttcttttaaaagggagtgaagtcattcaagacttcagcaatgtggatacaattgtatttgataagacaggtactttaactgtcggaaacccaaccgttgcagcgactgaactgtatgaaaaagattctgctgaaacgcttggctatctggccagtgtggaacgggaatcagatcatccattagcaaaagcagtcttaaaccaaattggagaaacaaatttttatcctgttgaaggaactgaagtcgtgaaaggcggcggaatcgtttcaagcgtagctggacatagagtggctgttgggaatgtggccttgatggaaaaagaaaatgtcactctcagcaaaaaagtgcaaaaagatgtcaaacggtttgaacaacaagggaactctctcgttttgacagcggtcgatggtgaattaaaagtactgatgggcattcgcgatcaagtccgtccgggtgtgaaagctaatttgcaggaattaaaagacttgggcgtgaaaaatctagtcgttctttcaggagataaccaaggaaccgttgatgtggtcgccggcgaacttggtttgaccgaagctcacggccacatgttgccggaagacaaagcggcttatatcggaaaactacaacaacgtggtcaaattgtagcctttgttggagatggcgttaacgatagtccgtccttagctttagcagacattggaatcgcaatgggaagcggaacggacgtagtgattgaaacatccgatgtcgttttaatgaactcgaacttcagcaacttgcctcacgcattaggattagtaaaagccaccgcaaataatatgaaacaaaatatcgtgatttcaattggagtagtgttggtcttgttgactagcgtcttcttcagtgaatggataaatatgtctatcggaatgttggttcatgaaggtagtatcttggtggtaattttcaatggcatgagattaatgaagtataagttgaaaggtcgaaaagaacaaaaagaagtatcaacacctgtagagaaagtaaaaatatcttaa

SEQ ID NO: 707 - DNA, 576 bp, Unknownn
  isolated from dental, unidentified
atgaatgagaacgacaaaatgaagataaaagaagtaattgttgttgaaggaaaagatgatacaaaacgaattcaaatggcagttaatgctgatactttagaaacaagaggatcggcaataagtgacgaaactttagatcaaattgaagatttatatgataaacgtggagtaattgtttttacagatcctgatttttctggagaaaagatacgtaagataattacagaagctgttccaggagtaaaacatgcatttctgacaaagcatgatgcagctcctagtcataaaggtagtttaggtgtagaacatgctagccctgaagcgataagagaggctcttgcccatttatatacagaagtacctgatggagagccactaatctcaagagaagatttagcagtagcaggattaacatctggaccacaagctaaagaatatcgcagaagattaggtgaatatttaagaataggctatacaaatgggaaacaattgtataagcgcttgaaattattccaaataacaccagatgagttaaaaaaagcactagaatatataaagaatgaagataactattaa

SEQ ID NO: 708 - DNA, 1311 bp, Unknownn
  isolated from dental, unidentified
atgacagcaagtgtaaatgttatcggtgctggccttgcaggaagtgaagctgcatggcaaattgcaaatcaaggagttaaggtaagattatatgaaatgagaccacaaaaattaactccagcacatcatactgaaaatttcgcagaattagtatgtaccaattctttaagagcaaatcgtttaaccaatgctgctggtttgcttaaagaagaaatgcgaactttcaattctattattatggagtctgcagataagcattctgtaccagctggtggtgcgcttgctgttgaccgtgaaactttttcgaaagaagtaacagaaaagttacacaatcatccaaatgttgagattataaatgaagaaattgatgagataccagagggattaactgtaattgctacaggtccacttacatctgatgctttagctaaggatattactaaatttactggtagcgatggattgttcttcttcgatgctgctgctcctattttagaaaaatcttctttagatatggataaagtttatttgaagtctcgttatgataagggcgaagctgcttatctaaatgcacctatgactaaggatgaattttataatttttacaatgagttaattaaagcagaaacagcagaattacatgacttcgaagacgataaattctttgaaggatgtatgccaattgaagaaattgcttctcgtggtgcacaaacaatgctgtatggtcctttaaaaccagttggattggaagatccacgaacagggaaagaaccttttgcagtagttcaattgcgtcaagataacgctgctggagatctatataatattgttggtttccaaactcatttgaaatggggcgaacaaaagagagtattttccatgattccaggcctagaaaatgcacgttttgtaagatatggtgtaatgcatcgcaacacattcttatgttccccagaagttatgcaagcaacatatcaaacaaagaaacgtccagacttattctttgctggtcaaatgacaggtgtagaaggttatgttgaaagtgctgctagtggattatacgcaggtttgaatgcggctagaattgctcaaggaaaggatccagttatttttcctgaagaaacaatgatgggagcaatggctcattatattacgcatgcttctgtgaagaatttccaacctattaacgcaaactttggaattgtaccaaaattacaagaaagaattagaaataagcaagaacgtaatttgaagatttcagagagagctattgacagaattaagaagtttaaaaatttaaattttgactaa

SEQ ID NO: 709 - DNA, 1392 bp, Unknownn
  isolated from dental, unidentified
gtgaagttggtgcgacaatcgcagaaaacagaaatacaagttggccgcttgtcgaggatagatttggaaaatcaaaagtacacaagggtgcgtagcaccaattttggtgaaaataaaggtatgagtgtcactattcaagacgaagtcttagaccgcaacaacctaaataaggcatacttgcgtgtcaaaagtaacagaggagcagctggcattgatgaaatgacagttgacgaattattccaataccttagagaaaataaagaggaacttaccacaagtttgcgagaaggaagttataaaccacttccagttaaacgtgtagaaattcctaagctaaatgggggaacgagaaagttaggaataccgacagtaattgaccgtatggtccaacaagcagtagctcaagtactaacacccatatttgaagaaattttctctgaaaacagttttggttttcgaccaaacagaggagctcaagatgcgatagataaggtaattagttattataatcaaggatataaacgagtagtagatttggatcttaaatcctacttcgataatgttaatcatgatttaatgataaaatacttacagcaatatatagatgatgaatggacgttaaaactcatacgtaaatttctaacaagtggaatattagacaatgggttattcgtcaaaagtgagaaaggaactccacaaggaggaccgttatcaccactattagccaacatctatcttaatgagctagataaggaattaactaaacgtggacatcgtttcgttagatacgcagatgactgtaatatctacgttaaaagtcagcgagcaggtgaaagggtaatgcgtagcattacgaagtttctagaaaaacaactaaaagttaaggtaaacacagataaaacacgagtaggcagtcctataaaactgaaattcttaggtttctctttgggagtagataataaaggaggatatgctcgatcatcaaaagaatctcagaaacgcgtgagacgagcacttaaaatgacaaccaagcgaaatagaggaatttctctgaacgatatgttcaaagaaatataccagaaaatgcgtggttggttacagtattactcaatagggagaatgactacttttatcagacgtcttgaccaatggctaaggtcaagaataaggcaatatatctggaaacaatggaagaaacctaaaacaagatttgttaacttgaagaagttagggttgtcacaacaagatgcatatacatttgccatgacccgtaagggttactggcgaactgcacatagtaagacattaacgtataccctaactaatagaaaactggagcaactaggactaataaatatgtccaaagtactccagtcaatacaaagtgattaa

SEQ ID NO: 710 - DNA, 408 bp, Unknownn
  isolated from dental, unidentified
atgattaaagaagatgtagactataatcaaatgaatgggattgcattagcatatatgggcgatgcaatttatgaaatttatattcgaagacatttactagccaagggtttaactaaaccaacaaagctacatcacaaggctactcattatgtatctgcaaaggcacaagcttttttaattgaaaaaatgcaagagcaaaatgttttgaatgatgaagagttagaattctttaagcgtggtagaaatgccaaaagtcatacttctgcaaaaaacacttcagttgtaacttacagaatttctacaggcttcgaagcattatttggttatctatatctaagtgatcaaatcgaaagattagaggaattggcagattggtgtattaatacagtagagaaagaaggaaagtaa

SEQ ID NO: 711 - DNA, 798 bp, Unknownn
  isolated from dental, unidentified
atggcagttattaccatgaaacaattactagaagctggtgtacattttggtcaccaaacacgtcgttggaaccctaagatgaagaagtatatctttacagaacgtaacggtatctacatcattgacttacaaaaaacagttaagttaattgatgatgcatatgacttcattaaagatgctgcaagtgatggcggcgtagtattatttgttggtacaaagaagcaagcacaagaagctatcgaagaagaagcaaagcgtgcaggtcaatactatgttaaccatcgttggttaggtggtactttgactaactggaatacaattcaaaagcgtattaagaagttaaaagaaatcaaagcaatggctgaagatggtacttttgatcgcttacctaagaaggaagttgctttgttaattaaacaaagagatcgtttagaaaaattccttggtggtattgaagatatgccacgtattcctgatgtattgttcatcgttgatcctcgtaaagaacgtatcgctgttaaggaagctcaaaagttgaacattcctattgttgctatggttgatacaaacgctgatcctgatgaaattgatgttaagattccatcaaacgatgatgcaattcgtgcagttcgtttaatcacttctaagatggcagatgctatcattgaaggtcgtcaaggtgaagatgatgcacctgttactgaagatacatttgaaaatacagatgatcaagttgattcaatcgaagatatcgttgaagctgtagaaggcgacaatgatagcacagatgctgaatag

SEQ ID NO: 712 - DNA, 1716 bp, Unknownn; identical to SEQ ID NO: 121
  isolated from dental, unidentified

SEQ ID NO: 713 - DNA, 396 bp, Unknownn
  isolated from dental, unidentified
atgagcttgagtagacacgatattagaaaaatagcatttcaaactttgtttgcattaggaagtaatccagatgcgaatagtgaagatatttatcaagaattactaggtgaagatagcaatgattctgatttatcatatttgaatgaacttgtagatggtgttctagatcatcaaagtgaaattgatatggaaattactaaatatttgagaaaaaattggaacattggacgccttaataaaactgatttgattatcttgagaatagctatatttgaaattaagtatagtgatgttgctggtaaaattgctgttaatgaagctgttgaattggcaaaggaattcagtgatgataagtcatataaatttgtaaatgctattctacaaaacttaatataa

SEQ ID NO: 714 - DNA, 783 bp, Unknownn; identical to SEQ ID NO: 573
  isolated from dental, unidentified

SEQ ID NO: 715 - DNA, 1407 bp, Unknownn
  isolated from dental, unidentified
atggtagttggagattttgcaatagatttagatacagttgttgtaggtgctggacctggtggatatgtagctgcaattcatgctgcagaattaggtcaaaaagttactgtaattgaacgtgaatacattggtggtgtatgtttaaatgttggatgtattccttctaaagctttgattgaagctgcacatcattaccaacatgcaatggattctcaagaaatgggacttcaagttacagctgctaagctagacttcgataaaacaattgaatggaagaataacgttgtagctcgtctaacaggtggggttgcttccttattcaagaaacataagattgatgttatctggggaaatgcatatttgaaagatagtcatagtttacgagtaatttctgatgatgataaggctcaaacatatacattcaataacttgattattgcaacaggtagtcatccaattgaaattcctaacttcaagtttgaaggacgtgtacttgattctactggtgctttgaacttaacagaagttcctaaggaattagttgttgtaggtggtggctacattggttctgaattagcatctgcttacgctaacttaggctctcatgtaaccatccttgaaggtggagatatgattttagctaactatgaaaaagacttagttaaagttgtagaacatcacttcagtgaacaaggtgtagatatttacactaatgctatagctaagaatgcagaacaaacagataaagatgtaactgttactttcgaagtagatggcgaagaaaagaaaattacagctgattatgtcattgtttctgttggtcgtcgtccaaacacttcaaatatgggcttagaacaagctggtgtaagtgttgatgaacgtggtttaattcctgttgatgcacaaagtcgttcaaatattcctaacatttacgctattggtgacgtaacgaagggatacgcattagctcataaagcttcttacgaaggaaaggttgcagcagaagctatttctggcaaaccaacagttattgattaccatgcaatgccagctgtatgttatacagatacatccattgcaacaacaggtttgacattagctgaagcaaaggaaaaaggctttgacgctaagaaagcacaattcccatttgcagctaatggtcgtgcaatttcaatgggtgaaacagatggatttatccgtttagtatttgaaaaggaaacaggtgtcttattaggtgctcaaatggttggtagcaacgctagtgatttaattagtgaattaactttggctattgaatgtggttcaacagttgaagatgttgcattaacaattcatccacatccttccttaagtgaagctgttatggatactgctgatgttgccattggattcccaacaaatatttaa

SEQ ID NO: 716 - DNA, 351 bp, Oribacterium sp.
  isolated from dental, Oribacterium sp.
atgaaccagtttaacaaagatattatcgcagcgctatcttcagacaaagatattaccctgaatgaagtcttacgtcgtcaaatcgaagtggccgctaatcagttccttcaaaatgaactgactgcggtgctaggctacgaaccacatactcggatcgaccgatcaaaagacgacgtgaactaccggaacgggacgtacacccgcactatcgacactaagtacggtgaaattaatctgacgatcccacgggaccggttaaacaagtttcaaaacgcccgctttcctccttacgtgcgtcgaatcaagcgtacaatagcctcaaaagtcatcactttttatttcttaaagtga

SEQ ID NO: 717 - DNA, 501 bp, Unknownn
  isolated from dental, unidentified
atggcttttattgatccagctcaattagatttagaagatcgcgttgttgcgattaaccgtatcactaaagttgtaaaaggtggacgtcgtctacgtttcgctgctttagttgttgttggtgaccacaacggccacgtaggttttggtactggtaaagctcaagaagtaccagaagctattcgtaaggctgttgacgctgctcgtaagaacttaatcgaagttcctactgttggaacgacacttcctcacgaagttattggtcaatacagtggtagtcgtattatgttgaaaccagctattgccggttccggagttgcagcaggtggtgctgttcgtgccgttatggaacttgcaggtattgctgatgttacaagtaaatcattaggttcaaatacaccagttaatgttgtacgtgctacatttgatggtttagtaaatatgaaggacgctgaaagtgtcgcaaaattacgcggcgtttccgttcaacatttagcagaataa

SEQ ID NO: 718 - DNA, 807 bp, Unknownn
  isolated from dental, unidentified
atgctagaattaacttgtgaggtgatgaaaatgctttctcaagagcaaagattagaagaaattaaagagatgttagcaaaaaaacataaattaacaacacatgaattagctgatcattttgggattgcatttgatacggctagaagagatgtattgagattgacatctacggggcaagcagcccgaattcatggtgggttgatggaaattaaatttaataatgtaccgggatttgtaacgcgttcccacattcagtccccaattaaagctaaaatggctcgattagctagagaagaatttaatccaagtggcttatattttgtaggtgcctctacaacattgatgcagatgtgtgagcaattagggcaagtgaatactacaattatgactaattcaattgataatgctgtgagattaatgctaaataagctgccagaagtggaattattaggtggaaaaattgataaggggaatcgttatacatattcaatggaaacattgtcccaattagataatattacttttgatgctgcatttatcggaacttccaagattcaaccagatggagttatggtagtggattcttatgatgcagcgattgctaaaaaagttgttgaacgatcaagaaaagttattttgattgctcagaagtataagtttgtaactaataattcctcaccatataagtctgccaatttaaaggatattgatgtattaattacagatgtgccactagaggaaaaatatcgtaagtattttaaaccagatataaagataaagtacgtgaaagaggatgagacaaaatga

SEQ ID NO: 719 - DNA, 1203 bp, Unknownn
  isolated from dental, unidentified
atgttaaatttgcaaccatatcaaaacccaacttattttggttacttagcagtcgctttattaccaataatgataggcatattatatggtcgtcgctttagatggtatgaaactctggtaacacttgcttttctagtattaacctttggcggtgataaatggtggcaagggttaatgttgatctgttacatcatttatgaaatgatactaacttttggttatttcaattatcggaaaaagaaaaatagtggtgttatctttgttttagcagttattttatctattctgccactagttattgtaaaaataacacctgcaatagatgcaggtaaggaatcaatcattggatttttaggtattagttacttaacctttaaaactgttggtatgattatggaaatcagagatggaattatcaaagaattagggttatgggaaacattgcattttcttttatttttcccaacaatctcttcaggtcctattgatcgttttagaagatttaaaaaagattacgatgccgttccagaaagagataagtatttatcacttttagaaaaaggtgtgcattatatctttttaggattcctatataaattcttgttagcttatttctggggatcatacttattaccaatagtaagaattcatgctttaggacatggtggcatttcttggtggttagttgcttatacttatgtatattccatggacttattctttgactttgcaggatacagtttatttgcagttggtacgagttacatcatgggatacgagactccaatgaactttaatcaaccatttaaatctaagaatattaaagatttctggaatagatggcatatgactttatcattttggttccgtgattacatttatatgagactagttttcttcatgatgaagaataaacttgttaaaagtagaatagcaatggccaacattggttacctaactttattcttaattatgggattctggcatggtgtaacctggtactatattgtttatggtattttccatgcgtgtgcaatcattattaatgatgcttggctaagatttaaaaagaaacatcgcaagtcaattccaagtaataaattcactgaatactttgcaatgttcctaacattcaatgttgtttgttttagtttcttaattttctcaggatttttaaatgaactattttttatgaataaataa

SEQ ID NO: 720 - DNA, 846 bp, Selenomonas sputigena
  isolated from dental, Selenomonas sputigena
atgattacatctacattattaatgctggcagtcggtttattcgccggtattatgggcgccattctgggaattggtggcggtatgattattacacctatcatcactttagctttgggtttagatatcaaatatgctatcggtgccagtatcattgccgttattgcaactagctctggttctacaattgcattcttaaaagatgatgtcttaaacttacgtgtagcaatgtttttagaaattgctactactatcggagctattgttggagctatcttaactggtattttccatccagcaattttatattttttatttggttccttacttattttttcaagttggaatatgtacagaaaactccgcagtggtaaagaaatcttaaaaagagccaagcctgacaagtggacacaaaaatttaatcttaacagttcatattttgacaagaacttaaacaaacaaattgattatcaagttgaaaatattcctggtggcttatccatcatgtttggggcaggtattgcctctggaatgttaggaatcggttccggtgcttttaaggttatggctatggataatgctatgaaaatgcccctaaaaccatctagtgctaccagcaatttaatgatgggagtaactgctgcagccagtgcctctgtatacttcttcaatggctctattaagcctggtattgctgttccactcgctttagggattttagttggagccgcaattggaagtagaatcatgcaacatcttccttcaagagttattagaatgattttcattcctattctattatatctaggattacaaatgatttttaaggcgtttggggtgacaatataa

SEQ ID NO: 721 - DNA, 1431 bp, Unknownn
  isolated from dental, unidentified
atgaaacttttatttgccggtagtgaatgtgcacctttctttaaaacaggtggcttaggcgatgtaatgggggcattacctaaaacaattgctaaaacaactgataatgacgtaagagtggtacttccattctttacaggaatggctgaagaatacaagagccaactatcatttgtaacaagtttttatgtaaaagttggctggcgtgatcaatattgtggtgtgctaaagttagaaatggataacgttacttactactttattgataacttgtattattttgatagaccaggcttgtatggttactatgatgaaggcgaacgttgggccttcttccaacaagcaattattgaaatgttagaaaaaattggatttattccagatattttacatgtaaatgattatcatacagcatttattccatttttattaaaagaaaaatatggttggattaatgcatatcaaaacattaaaacagttttgacaattcataacttacaattccaaggtgagtatggtcgtgaagtattgggagaattatttaatttagatgcttcatattacgatgatggaactgttcgttttgatactgctgttaatttcatgaagactggtattctgtatgctgataaggtaaatacagttagtccaacttatgcaagtgaaattcaaactgaagcctttgggcaagggttagatgaaattttgagaatgcataattggaagttaagaggaattctaaacggtattgattacgaaagaaataatcctgccacagataaaaatcttgttgcaaattattctgctaaaaaattaaagggcaaagttaaagataagttagctttgcaaaaggaatttggtttacctcaacgtaaagatgttccagtgattgcaatggttagtcgtttaacagctcaaaaaggattccaactagttgtttcagaaatgcaaaacttagttcaatttgatgttcaagtgatagttttaggaactggcgatgctaattttgaacatgactttagatactttgcagatacttatcctgacaaagttggagctgctattacatttgatgttggattggcccaaagaatatatgcaggggcagatatgttcttaatgccatcagcatttgaaccttgtggattatcgcaaatgatttcaatgcgttatggtacattgccaattgttcatcaaattggtggcttgcaagacagtgttcaaccatttaatcctgtaactggtgaaggaacaggatttggtttccacgatttttctggcttctatatgatgcaagaaatccaagaagcattacgtttgtatgcagagccagtagcatggacaaaagttgtaaagcaagctatgtcacaagattttagttgggaaacagcgagtcaagaatatctaaatatgtataatgaattagtctaa

SEQ ID NO: 722 - DNA, 969 bp, Unknownn
  isolated from dental, unidentified
atgattaaaaatttagttaatcataaaaattttagtaactatcactgttatattggagaatccgttatgagttttgaaattaatcatattaaatatatccaagccattgttgaaaatgacttcaatattactgcagcggctcataaaatacatatcagtcaacccgctctcagtaaatcaattaatttaattgaaagcaaatatcatgtgcatatttttacaagagataagcatcgattagttggactaagtcaacaaggtaaaattctctatgccatgatgttagatattctagagaaatacgaagaattagaaaatgaattgcatcaacttggaactgaaccttcgcttattaaatttggagccattgctagtaccccacagattttatttcctggtctctttattgattttgaaagtacacatcctaacatccacattgaaattattgaggatggtggtgtaaatatcttacatgatttcttacaaaaaaaatttgattttgctttactagttaatccttttgaattaccacctgatttagctgatgtgcatttagttgctgaagatgagattgttgcctttcttcccctaggacatcctctcacttcaaaagcaatactaacttgggaagatctagctgaatatccgcttgtctctttatcagacaaatatcagacctactttaaagtaatggaacaatttagaatacgtggactagagcctcattttgcatatacatcatcttcatggcaatatctaacagatgctattcaacgcaattttgtaattactttaatgccatcgctagtcccaacattttcctctactgataacattattattaaacgaattaaaaatcctgcatcatttaatttgtttttagctagattaaataagaaacactattcaaaagaaaataaacttttctacaactttcttaatcaacatttaccaaaattaaaataa

SEQ ID NO: 723 - DNA, 2379 bp, Unknownn
  isolated from dental, unidentified
atgcaaactaataaaccatttacttataaaatacctgaaaatttgcagggacaactagaaaaaggaatgagggtagtagttccctttggaaagggaaacagattgattcagggatttattataaattttaagtctagtagtgaaaatatagataatataaaagaaattgatagtgtattagatttagaacctgtattgaatgaagaaatgttggaaattgcagattggttgtcaaagtatactttttcattcaaaattaggtgccttcaagtaatgcttccaagtattatgaaagctaaatatgagcgaaagtttacttatattggagagcaagatgaaaaagttaaagagctattttcaggcaaatctgatttattagatagtgataaaaaagtaaattctagtacgataaataaattattacagttaagaaagcaaggaaaaataaaagtagactacattgtaaaaaataaggctaaagcaaagttggtctcagtggttaagacaaaattatctttacaagagtatgagaatgagttaggaagtatttcccctaatgccagcaaacaaaaaaagttactaaatacattaaaagagtttcctgtggggtcaaaaatacggcaaagtgaattgagggaaaaatacaattttactaatgctgatataaaaaatgctagtaaaaaaggatggatagatgtagtaaaagttgaaaaatatcgcgatccatttgctaactataagagttattatgaaaaaaagcataagcttacacaagaacaaagtaaagttgtgaaaaaattagataatgatatcgaaaacgataaagcgcgagtatctttgcttcaaggggtaacaggaagtggaaaaacagaggtatatttacaagtaatagatactgctcttaatcaagggaaaacagctattgtattggttcctgaaatatcgttaacaccgcaaatggtaaaaagatttagagctaggtttggcaccaaagttgcagttttgcatagtgggctttctataggagaaaaatacgatgaatggagaagaatagagagagaagaagcacaggtagttgtaggagcgcgatctgctatttttgctcctttgaaaaatttaggagtcataatagtggatgaggaacatgaatctagttacaagcaagatgaaatgcctagatataatgcaaaagatgttgctaaatggcgtggaatataccactcatgtccagttatttttgggagtgcaaccccatcactagagtctagagctagggcacaaaaaggagtatatgattggttaagattaactaaaagagttaacaatcaaaagctacctaaagtgcaaattattgatatgagagaggcagtaaaaacctctccaattccagatttttctcttaaaatggttaattcaattcaggaaaaattagataaaaaggaacaaatagtgcttctattaaatcgtagagggtattcgacgtttatgatgtgtagagagtgtggttatgtaataaagtgtcctaactgtgatatttctttgacagttcatttagatagcagatctttaaagtgtcattattgtggatatgaaacgagaataccatatgaatgtcctagttgtagtagcaaaaaaataagatattatggtactggaacacaaaaaattgaaaaagagctaaaaggtctatttccacaagcccgaattttgagaatggatgtagatacaactagaaaaaaaggagcacatgagaaactattaagaacatttggagatggaaaggctgatattttacttggaacgcaaatgatagctaaaggactagattttccaaatgtaacttttgttggagttttaaatgcagatacatcacttggaatatcggattttagagcaagtgagagaacttttcaacttttaacacaagttagtggacgtgctggacgtgctgataaagatggagaggttattattcaaacttttaatcctgatcattatgctataaaactagctcagaatcacgattatgaaaattttttctataaagaaatggaacttagacataatttaaattatccaccgtattactatacattaaagataacagtaagttctaattcagagtcattgacggctagaactatttttaaaataaataatgaagtaaggatgaatgtctctaaaggaactattatattgggtccaactccacagacggttactaaaataaataatcgttattattatcaaattgttattaaatataaaaaagaaacaaaattaattaactatttacaagatttacttctttcaagtcaaagaattgaaagagaaggtatacaaattgtgatagatagagaaccattgaaatttaattaa

SEQ ID NO: 724 - DNA, 759 bp, Unknownn
  isolated from dental, unidentified
atgaacctttatccagaatttgaaggaaaagtagttgttatgacaggtgtcagctctggaatagggctagaacaagctaaagcatttttacaagcaggagcaatagtttatggagctgatattaaagaaagtgcagaaattaaggaagtagagcaaaaatttccgactttaagttttcaacaagtggatataagaaagaaaaaagatattcacatgtggacagaaaagataaaaaaagaattatcaactgtggatattttattaaatacagcaggtattctagataattatgcaccaactttagatactagtgaagaacaatgggacaatatttttaataccaatttaaaaagtatgttcttgttgactaatgaaattttaccagtaatgttgaaacagaaacatggagttattgtaaatatggcttctattgcaggattggttgctggtggcggtggagcagcctatacagcggcgaaacacggaattattggatacactaaacaattagcttatgattacgctgataagggaattcgagttaattgtatagctccaggagcaattaatacaccgatgaatgcagctgattttgctggagatggggcgatggctaaagaagtagccagactcacaccagctaaacgatgggcaaaacctaaagaaatagcagaaatgacactttacttggcaagtccaagagctgattatgttcacggaactgtttttacaattgatggtggatggacagttaaatag

SEQ ID NO: 725 - DNA, 2058 bp, Unknownn
  isolated from dental, unidentified
gcaattaaattgttgaaacaatatggtactttagatggaatctataaaaatatagatgaaatgaaaaagtctaagatgaaagaaaatttaatcagagaaaaggaaattgcttatttatgtcaagatttagcagaaattaggaaagacgctccagttgaaatagatttagaagaaactgaatggactgggaaaaatattgagaaactagtaacgttatatcaaaaattagattttcgaaagtttttatcacaattaaaggctgaaagtagtgaacaattagatatttttgaatctaaaagtaatatagaatttactgaattaacagaagaaaatttagatgatataaatgttagtgataatgacgaaatagtatttaatttagaaatagatggagaaaattatcatacagctgaaattattggtttttctattaaaataggtgataaatatttagtgtcggatgatatagatttactaaagaaaaaacaaatcaagaatttgttggaatcagatgaagttgaagtagatttatttgatggcaaaagacaatatgttggcttaaatagattaggtgttactttatcgaaaattaattttgatttgttacttgtatcatacttgctagataatagtgaaaatagtaatgatctaggtctgttggcacaacagcacgaatattatgatgtagaatctgatgagcaaatatatggtaaaggtgctaaacatgctgtgccaaaagataaagaagttttatttgaacatttagtgagaaaagtaaaagcgataaataatttaaaagaaaaattatttaatgagttagaagaaaatcagcaactagatctatatacaaaaatagaacgtccattgtcgattgtattagcaaatatggaaattgcgggcgtaaaagtggatagtaatagactagaaactatgcaaagtgaattgaaagaacgattaagtgaactagagcaggaaatatataatgaagctggagaagaatttaacttaaattcaccaaaacaattaggtgttatattgtttgaaaaattaaagttaccagttattaaaaagacaaaaacaggatattcaacagcagtaggtgtattagagcaacttagaggtatgtccccaattgttgataatatcttacaatatcgtcaattagctaaaatacaatctacatatattgagggattgttaaaagtagtttctaagaaagatgggaaggcccatacaagatatactcaaaccttaacttcaacgggaagactatcttcagttgatccaaatttacaaaatattccagttcgtttagaagaaggtcgaaaaatacgtcaagcttttgttccaagtcatccaggatgggaaatattttcttctgattattcacagattgaattacgtgtattggcacatatttcaaaagacaaaaatatgcaagaggcttttaaggaaggcatggatattcacgcaagtacagcgatgagaatttttaatgtagatagtccagatgaagtaactcctaatatgagaagacaagctaaagctgttaattttggaattgtatatggtattagcgattacggtttatcacaaaatataggaatatcaagaaaacaggctaaacaatttatagatacctatttagatacattttcaggtgtaaaagattatatggaaaaaattgttgaatttgctaaagaaaatggatatgtagaaactatttttaacagaagaagatatctacctgatataaagagtcgtaattttaatttacgctcttttgctgaaagaacagctatgaattcaccaattcagggtagcgcggctgatattattaaggttgcgatgattaatatgcaagaaatgttaaaagaaaagaatttgcaagcaaaaatgctacttcaagtacatgacgaattaatctttgaagcaccaacaaaagaaattccattattagaggatatggttccaaaagttatggattcagcagttaagctagatgtaccgttaaaagttgaaagtaagcatggacaaacttggtttgatacgaagtag

SEQ ID NO: 726 - DNA, 834 bp, Oribacterium sp.
  isolated from dental, Oribacterium sp.
atgaatagttttgttgctaatgatgaagagataagaaactttctttatcgtcctaacatgaagaagcaagatggaataatgtttgcctatgtaacttcagctgagaagttagctgaattggtgcctaaacctttgaaagttgtcgcacctgtcatcatgggttacgttacccatatgggagatccaacttttgctgctccatatgatgaagctgtattgtatgcgtttgttagttatcaagataagataatgggagcctacccatttgtcttatatctaagtggtgaaggtgcagaggaggcgatgattgccggtcgcgaaggtgcatgtatgcctaagaaattggcagatgatattaaaatagaaaaatcagaaaataaagtacaagctaaaataatcagacatggtacagaaattttgaacttaaagtggaaagctggagtacctaatgatgttgaaacagttaagaaaatgtttagtagccaagtgaaattaggtgaaccatcagaaatggcaagtttcttcattaattacgatattgaacaacaagatgatggatctaataagtttgtaaatactgagttaattgcaactcaaagtacaggcttaactactgatatggaaatgggaaaaatagatatgaaacttacttccagcgaagatgatcctttagctgaattagaagtacttaagccagttggtggcgcacattacgagatggactattccgttatgcataagactctaaagttagactctcttaatccagaagaaattgctccatacttgattactggacactacgatagaactttcgtaactaagcaagattaa

SEQ ID NO: 727 - DNA, 1434 bp, Selenomonas sputigena
  isolated from dental, Selenomonas sputigena
atggaaaattggttaaagaaacgagttctactttctccaaataaaatagccattcaagctggtaataccaaattaacttttaaagaagtaagtgatagggtggcagtattggcagcacgtttagctaataagtctcgtaaagagatgagagtagcattgcttaccaataacacgattgatggttatttgatgattctatcattacaacaattagggtgtgaaattgtctttttaaataaaagattatcgcatgaagagctacaatatcagctggaagatgctgcagtttcgttgttgatatatgatgagtcattgttacatgaagaatttgtagggattgaaagcttaacctttaatcaaataaaaggtttagaggaaaatcaaaattttcaattagtatcagaattcaatgatgatgaagttacgactattatgtatacttcaggtacaactggtaaacctaaaggagtacagcagacttttaaaaatcatttttattctgcaatcagttcggccttaaacctaggtttaacagataaggataactggctatgtgcagtgcctattttccatattagtggtttatcaatcattatgcgtggattgatttatggaatgactgtaactttgatggataaatttgatgcagaaaaagttacatccttattaaagaaaagtagtgtaagtacaatgtcagtagtccctacaatgttgcaacaacttttagaaatttttccccaagaaggatacaattctaattttcgttgtttcttattaggtggcggaccaatagataaggttacattagagcgatgtcaacagctaaacataccagttattcagtcttatggaatgacggaaactgcttcgcaagtgatagctttaaattttgaagatgctgagaataaaattggttcagtaggaaaaccgttattttctgttgaattaaaattggctcatgatggtgaagtattacttaaagcacctaatatcacgccaggttactttaataatcctgagaaaaatcaagaagtatttgaagatggatggtttaagacgggagatattggttatttagatgaagatggattcttatatctgaaaggtagaaagggcgatatgataatttctggtggagaaaatatttttccacatgaagtagaagaaagctatttaaagttaacaggagttaaggatatcgttgtagcaggaattactgataaaaagtggggacaagtgccagttgcttttgtaatattggaaagaaaactttcacaacaggaattaatttcatatgggcgtgaacatctagcgcattacaaagtaccagtaagattttatcaagttatgtcatatccacagacagctagtggaaaagtaaaaagacgagaattgatccaaattaaggaatatcaaaagaatctcattaagtaa

SEQ ID NO: 728 - DNA, 1668 bp, Unknownn
  isolated from dental, unidentified
atgttacaagaattatcaataaaggatttcgccattatagatgaaatacaaatatcatttcaacctaagatgacagtattgacgggtgagacaggtgctggtaaatcaattattattgatgctctgggcttattagcaggaggcagaggttctactgaatttattcgtaagggtgagaaaaaagctgttattcaggggttatttacattacctagagaagctaatacttacaacattttggaagaatacggaatagattctgaagatggacaaataatcttgcaaagagatttatatcgaggcggaagaaatatttgtcgcatcaatggaatgatggtaaatttggcaactttacgaaaggtaggagaaacattaattgatattcatgggcagaatgagcaccaagaattgatgaagccagaaaaccatatagatttgttagatgaatatgataaaaaaacatcccagttaagaaatcaatatcaagttgtgtatcaaaattatcgtaagctaaaattatcaatggaaaaaaaagaagctgatgtgaaggcctgggcccaaagactagatatgctaaatttccaagtcaaagaaattgaagaagctggtttaaaaattaatgaagaagatgaactagtcgaagaaaaaaataaattggataattttcaagcaatacatgatgctttagaattgagttatcaaattttatctggtgaaaaaatagatgtagttggaaatttaggaaatgcaatgaatgagttaagcgatgtttcagatttatcagaaaatcttcaagaaatcaatactaaaatttcagatgctttttatagtctagaagatgccgctcgtgatatttcagatgaacttgattcaatggagtggaatggagaaaggttaaatgaaatagaggaaagattagagttgatccaccaattgaagagaaaatatggtgatacaatagaggatattttgcattatcatagtagaattgaaaaagaattaagagaaatggaaaatgcggaacaaaattcagaaaagcaagaaagacaattatctgaggcattagaaaaagtaaaagaattggcaataaaactttcgaaacagcggaagaaaagcgctaaaaaattagaaaaaatgatccatgaacaattaagtgcattatatatggacaaagctgtatttgaagttaaatgtttaaataattctaaattgtattctaaaggtatcgataaagttgaattttatattcaaactaatccaggtgaagaaatgggcccattagctaagatagcttcaggtggtgaactttcacgaataatgttagctttaaaaacaattttttctcaaaagatgggtgtcacaagtattatctttgatgaagttgatactggtgttagcggtcgtgtagctcaagcgattgctgaaaaaataagccaaatttcaaataattcacaagttttatgcattactcacttaccgcaagttgcagcaattgcagacaatcattactatatttcaaaatctgtcaacgatggtagaacagaaacttcattaaaagaattagatgaaaaacaaaaaattagagagatagcaagaatgttatctggatctgaaattacagaattaacattgaaacatgcagaagaattaattaaaatgtcaaaataa

SEQ ID NO: 729 - DNA, 3525 bp, Unknownn
  isolated from dental, unidentified
atggaattaatagatacttttttgaatgtctcggaattgaaagagtgggaaaagaatttaactactgatggacgacatatgttgacaggattggtaggctcttctaagacattgatgatagctaaactattaaaagataagaaagtaccacaattaattgtggaaagtgatttataccatgcacaacaattgcaaagtgatttagagaatataatagaagatacaagaattgaattatttccagtagaagatatgttagttgcagaaatggcaactagttctccagaatacagagctcaaagagtaagcgccttaactgcattaacttcagaaaatccagtaattgtaattactacagtagctgggataagacgttttttacctagtgtggagtactggaaacaacatgaaattcaattggagattggtaaagaagttaatccagccgaactagagaagaaattatttgaaatgggatatattaggtcaaatatggtaaatgcacctggagattttgcgattcgtggatctattgtcgatatttttcctttagatgcagataatccgtatagaatagatttctttgatattgaaattgattcaatgaggacttttgatattgcaaatcaaagaagtattgaaaatgtggatcaagtaactatcatcccagctactgactttattgctagtaaagaagttctagagttggctagtaaaaaaataaaaaaagaatataataagcaattttcaaaattaaagaatacaaaagaagaaaaactaactgaaaatattcaaaaaatgctagctgattttaaagatggttttttaaaggctgaatatctaccatatgctgaatatatttatccagaaagtacaaatttaattgattacttgagtgatgaagggttagtaatctttgatgactattctcgtttgactgagaaacaaaagaacctagaatattctgaagctgattggttaacagatagactacgtactaatagtttatttgataatttaaaattaggtcatgattttagaagtgtagaaaagaaaattaaacaacctagaattttcttatctttatttcaaaaaggactaggcagaatgaagtttgcccaacttgtagatataaagacacgtgctgttcaaaagttctttggacagatgccacttttgaagactgaagtttcacgttgggaaaaacaaaagcaaacagttgtatttttgattaatgatagagaaagattggaaaaggtctctcaaacattagatgattttgaaattaagtcgattataacagataagaatgcaattcaagttggagttacacaagtggtccaaggtttcttaaatgaaggatttgaaattcctaaggataaactcgttgttttaaccgaaaatgaattattttctaacgtgaagaaaaagcaacctagacgtttaactatgaataacgcagaacgactaaaaagttatactgagttgaaaaagggtgactatgtcgttcatgtcaatcatgggattggacgctatatagggatgaaaactttagaagttggtggacatcatcatgattatatgaccattctctatcaagatgatgcgaaactttttatcccggtatctcaattagataagatacaaaaatatgtgtcttcagaatcaaaaacccctagagttaataaattaggtggttctgagtgggctaaaactaaacgccgtgttgctaacaaaattgaagatattgctgatgaattagttgatctttatgctaaacgtgaagctgaaaagggatacgcatttactcctgatgatagctatcaaaaagagttcgaagatgcatttccatatacagaaacaccagatcaactgcggagtgctaaagaaattaaacaagatatggaaaagaccaagccaatggatcgattattaatcggtgatgttggttatggtaaaacagaagtggcgttaagagcggcttttaaagcggttcaagatggtaaacaagttgctttcttggcgccaacgacagttttggctcaacaacattacgaaacaatggaacaacgttttgaaaatttccctgttgagattggtattttatctagatttaatacagccaaggaaattaaagagactattgaaaatttagaaacaggtaagttggatattgttgttggaacacataggttattgtcaaaagatgtaaaatttgcagatttagggttattaattattgatgaggaacaacgttttggagttaaacataaggaacgattaaaagaattgaagacaagtgtagatgttttaacattaacagctacacctattccaagaacgttaaacatgtctatgttaggtgtacgtgatttatcagttattgaaacagcacccatgaatcgttatccaatacaaacttacgttattgaaaaaaattatggggtaattgtagatggaattaagcgtgaaatagagcgtgggggacaggttttctatctgcataatcgagttgatgatattgaaaaagttgctagtgaattggaaagtttagtaccagaagctaaagtagcttatattcatggaagaatgaccgaaacgcaactagaaaatattttgatagattttatcgatggtgagtatgatgttttggtcacaacaacaattattgaaacaggggttgatattcctaatgtgaatacattatttgttgataatgcggacagaatgggattatcacagttgtatcaattaagaggacgcgttggacgatcaaatcgtattgcgtatgcttacttcatgtatcaacctaacaaagtgttaacagaggtcgctgaaaaacgtctggaagctattaaagatttcacagagttgggttcaggatttaaaattgcgatgagagatttatcaattcgtggagctggaaatttattaggtaagcaacaacatggttttattgattctgttggatatgatttgtatacacagatgttaaatgatgctgtagctaagaaacgtggtaaagagattaaagttaaaacgtatgctgaacttaatcttgatctagaagcttatttgccagcggattatattactgatcccaaacaaaaggttgaaatttataaacgaatccaccaatttgaaaatgaagatcagtatatagaagttcaagatgatttaattgatagatttggtgaatatccaatagaagtacacaatttattagaagttggcctattaaaaatgtatgctgatgcagctttagtagatagtgttagccagaataaaaaaacaattgaaattgagttatcagataagttaaatgggaaattagacattaaggatgtttttaaagtattatcggtaactaaatttagtacgactctgggaaataaaaatcaaaaaattcaaattaagttaaacatccaacctggcatggaaagtaatcaaattttggaagaattaaaaaaattactcaaagaattagctaaaatggtggatgtcacaatggataaatcagcatag

SEQ ID NO: 730 - DNA, 999 bp, Unknownn
  isolated from dental, unidentified
atggctactattaaagatatcgccaaacttgcaggcgtttcaccagcaaccgtctctcgtgttttaaattatgatgaatcgttatctgttggtgatgagactaaaagaagaatttttaaaactgctgaaaagttaaattattctaaacataaaaaaaagaataaagaagaacatttaaataagatagcaattgtacaatggtatactgaagcccaagaattaacagacttgtactactattcaattcgtctaggaatcgaaaaaagagctcaagaattgggatatgaagttgtgcgtattttccatgatgatcctttagatgcaatccaaaatgtcgatgggatcattgcaattggaaaatatagtactaatgaaatacaacaacttgataatctaaatgctaatttaatctttgttgacagtgattccttaagcaatggttttagttgtgtcgtaactgatttccaaaattccgttatcactgttttagatcacttcttagaaaaaggtcaaaaaaacatcggattattagcaggtgaggaacatacttctgataattctcaaactttaattgatttacgttttactatatttaaagattatcttagtcgtttaaatctttacaaccatcaaaatgtatatgttggaagttttaaccctgaatctgggtacaaaatgatgaaaaaagctatcgtagaattaggcgataaccttccagaagcattttttgctgctaatgatgctattgctatcggcgcagtcagagcacttcaagaagaaaagatttctattcctgatcgagtaagtatcatttcttttaacgatacctctattactaaatatgtttacccatcattaagtagtattaaagtatttactgaagaaatgggcgttgaagccgttaacttactattggattacatcgctcatccatttagcgttgcaaaaaaagttaccttaggaacaaaactagttcttagagatagcactatcaattaa

SEQ ID NO: 731 - DNA, 2148 bp, Unknownn
  isolated from dental, unidentified
ttgaataagttaattaatgacaaaggagctgggttaatgcctactactcagaaaccaaagaaaaagacaacgaaaagaacacgaaagaaaaatttagtaatagtagaatcgccctccaaagcgaaaacaattgaaaagtatttaggatcaaactataaagttatggccagtttaggtcatattcgagatttacctaagagtaagatggggattgatgttgagaatggatatgaaccacattatatctctattcgtggtaaaggcgatgttataaaagaacttagaaaagaagcaaaaaaagctagtcatgtttatctagcagccgatccggaccgtgaaggagaagctattgcttggcatttatcgtatcttttaggattgaacccggaagacaaaaatcgcgttgtatttaatgaaataaccaaagatgctgtaaagaatgcatttaaatcaccacgttcaattgatatgaatttggtagatgcacaacaggctagacgtgtgttagataggctcgttggttactcaatttcaccattattatggtcaaagataaagaagggcctttctgctggacgtgtacaatcgatagcattgaacttaattatccaacgtgaaaaagaaattcgagactttaaacctgaagagtattggacgattgatgctaagttcaaaaaaggtagaactaaatttgaagctgacttctggggtgtagataataagaagaaaaaactatctaatgagaaagatgttaaagaagtcattgaaaagattgataaagataaacctttcaacgttattaatattgaacaaaaagaacgtaaaagaatgccaccattaccttttacaacttcaacaatgcaacaaactgctaacaataatttgaagtttagaactcaaaaaacaatgatggttgcacaacaattatatgaaggtattaatattggacgaggtggagctgtaggtttaattacttacatgcgtactgactctactcgaatttcgagtgttgctaagcatgaagcagctgtctttttacatgaaaattatggtgaagaatatgctgcttctaaaccacgtcagggtaaattatctgaaaatgcacaggatgctcacgaagctattcgaccatcatcagttgaacgtacacctgaaaagatggctaagtatttagataaggatcaattaaaattatatacattgatttggtcaagattcgtagcaagtcagatgacaccagccgtttttgatactatgcgtgtagatatagaacaaaatggagttcaatatcgtgcaaatggttctaagatgaaattccctggatttattaaggtatataaagcagcaacaagtaaagataacttactgccagaattgaaggttggcgatgaggtggatatagttcaaaatcaaccaaatcaacattttactttaccaccagctcgctattctgaagctactttaattcgtactttagaagaaaatggtgtaggtcgaccatctacttatgcacctactttaagtacaattcaaaagcgttattacgtgaagttagtttcacgaaagtttgaaccaactgaactaggtgaaatcgttaattccatgattgaagaatgtttccctgatattttaaatgttgattttacagctcatttggaagatcaattagatgatgttgaagaaggaaaagaagaatgggttagaattatagacgaattctaccaacctttttctaaggaagttgacaatgctcaagtaaagatggataagattaagatcaaagatgagccagcaggaattgattgtgaaatttgtggtgctccaatggtcattaaactaggtcgttatggtaaattctatgcctgcagtcgtttcccagattgtcgaaatactaaggcgatagttaaggaaataggcgtagtttgtcctaaatgccataaaggtcaaattatcgaacgcaaatctaagaaaaatagagtcttctatggttgctcattgtacccagattgtgactttgtttcttgggataaaccaattggacgtgactgtccaaaatgcagtcattacttagtagaaaagaaaattaagaagggcatgcaagttaaatgtagtaattgtgattatgaagaagcaattcaaaataattaa

SEQ ID NO: 732 - DNA, 2661 bp, Unknownn
  isolated from dental, unidentified
atgacaaaagaagtagaaatgtcaactaaatacgatccaagtcaagtagaacctggcagatataaagaatggatcgaaaaaggtttatttaaacctaatgaagataaagaagcaaaaccatattcaatcgttattccaccaccaaatgtaactggtaaattgcatttgggtcatgcatgggatacaacattgcaagatatgataattcgtcaaaagagaatgcaaggctttgatactttatggttaccaggaatggaccatgctggtattgcaactcaagctaaggtagaggctagattagctgaagatggaatttctcgttacgatttaggacgtgaaaaattcgtagaaaaagtttgggaatggaaaggcgaatatgctgacatcattcatcaacaatgggctaagctaggtttgtctttagattacgatagagaaagatttactttggatgatggattatctaaggctgtaagaaaagtctttgttactttgtacaaaaaaggattaatctatcgtggtgaatatattattaactgggatcctaaagctcgtactgctttatcagatattgaagttattcataaagatgataaaggtgcattttaccatgttaaatatccatttgctgacgatacaacatttaatggtaagaactatattgaaattgctacaactcgtcctgaaactatgatgggtgacgtagcagttgccgtaaatcctgatgatgaacgttataaggatattgtaggtaagactttagttctaccattacaaggtagacatattccaattattgctgaccaatatgttgatcctgaatttggtacaggtatggttaagattacaccagctcatgaccctaatgactttgaagtaggtaatagacataatttggaacgcatcaatacaatgaatgaagatgctacaatgaatgctaatgctggtaaatatgaaggtttagacagatttgaagcacgtaaggcaattgtgtctgatcttgaagaacaaggctacatgttgaagattgaaccaatcgtacatagtgtaggacattctgaaagaacaggggtacaagttgaatcacgtctttcaacacaatggtttgtaaagatgaagcctttagcagaagcagctttgaagaatcaagaaactgatgatagagtagactttgtgccacctcgttttgaacatacatttacacaatggatggaaaatgttcatgattgggttatttctcgtcaattatggtggggacatcaaatcccagcatggtaccacaaagaaactggtgaaatttatgtaggtgaagaagcacctgaagatattgaaaattgggaacaagattcggatgtattggatacatggttctctagtgcattatggtcattctcaacaatgggttggccagatactgaaagtcctgatttcaagcgttatttcccaactaatacattggttacaggttatgatattattttcttctgggtatccagaatgattttccaaagtgttgaatttacaaagcgtcgtccgtttaagaacgttctaattcatggtttaattcgtgatgaacaaggacgcaaaatgagtaaatcacttggaaatggtattgatccaatggatgtaattgataagtatggagcagatgcattgagatggttcttatctaatggttctgcacctggtcaagatgtacgtttctcatatacaaagatggacgctgcttggaactttatcaataagatttggaatgcaagtcgttttgttattatgaacttagatagcgatgttgaattaagtttaccagaagcatcagaatggcaattagctgataagtggattctaagtcgtcttaatgacacagttcgcgatgtaactcgtttatttgatagttttgaatttggtgaagctggtcgcgctctatataacttcatttggaatgatttctgtgactggtacattgaaatggctaaggaaaatcttacaggtgaagatgaaaaacttaagaagaatacacaatgtatcctacgttatgtattagatcaaattctacgcttaatgcatccaattatgccatttgttacagaaaagatttggttatctatgccacatgatggtgcatccttggttgttgctgaatatcctgttgaacatactgaatttgataatcaagtagcagaaaaagacatggataatttgattgagttaattaaagcagtacgtaacagtcgttctgaagttaatgctccaatgtcttcagcaattgatattttaattaagacaaaagatgatgatacaagaaaagtgtttgaaaacaatgttgattatatcaatcgtttctgtcatccaaaacgtttagaaatagctgcagatattgaggcacctaagttagctatgacatctgttatcacaggagcagaagtttacttaccattagctgatttaattgatttaaacgaagaaatttcacgtttacaaaaagaagctaagaaattagaaagtgaagttacacgtggtgaaaagaaactaggtaatgaaaaatttgttgccaatgcaccagaagcggttgttgctaaggaaaaagaaaaattagctaattataagcaacaacttgctgcaactgaaagtcgaattgaagagttaaaagctgaaatttaa

SEQ ID NO: 733 - DNA, 1287 bp, Unknownn
  isolated from dental, unidentified
atgaagaacgccttagctgtaaaagagattcgaaaaaaaatcttatttaccttaggtgtcttgattgtatttcgcttaggcacttatatcactgtccctgggatcaacgctaaagctctgcaaagcgttgcatcttcagggttaattaatatgttgaatatttttagtggtggtggtttaactaacttctcactatttgctatgggtgtttctccatatattactgcgcaaattgttgttcagttattacaaatggatattgttcctagatttgttgaatggagtaaacaaggtgaagtagggcgtagaaagttaaatcaagtaactagatatttaactattgtgcttgcgtttgtacaatcaatcgcaatcactgctggttttaatgctttgagtagcttaaaccttgtaactaacccaagtgttaaaacatttgtagttgtaggaattgttttaactggtggaactatgtttactacatggttgggtgacatgataactgatagaggtctgggaaacggaatctctatgattattatggctggtattttatctcgtgttccagatggaatcgtacagatttataaagatcagttctcaggtgttactggtagtgatttatgggaaccaatattatatgtagttattttattgattgttattttaataatcgttacatttgttacgtatgttgaacaagcaagctataaaattcctattcaatatactagaagattggctggagcaactgaaaattcttatttaccattgaaagttaatgttgctggggttattcctgttatttttgctagttcatttatttcagcacctcaaacaatactattagctttcacacagaaccactctgaagatacatggtataagattatgacaagcatttttaatatgcaatctactccaggtatgattctttacacagttttaattgtagtatttactttcttctatgcatttgttcaagttaatccagaaaaactttctgaaaacttgcaaaaacaaggaagttacatacctagtgtatggccaggaaaagaaactgaaagatatgtatcaagattattgatgcgtctcagttcagtgggttcattgtatctaggtcttatttcattaattcctttagttgcatccgcagtttggggattggatgaatcaatcggactaggtggtactagtttattgattgttgttggtgttacaattcaaacaattaatcaattaaatggtatgatgatgaaacaagaatacgtaggctttatacgtgaataa

SEQ ID NO: 734 - DNA, 1089 bp, Unknownn
  isolated from dental, unidentified
atgaaacgctatttgattttagatgatggctctgtttttgaaggtgaaggatttggagcaaaaagaacttcttttggtgaagtagtttttactaccggtatgacaggatatcaagaagctgttactgatcagtcatatgccaatcagattttagttttcactaacccattaattggtaactatggggtgaatttagatgattttgaatccttagaaccaaattgtcagggtgttgtttgtcgcgaagttgctagagtttcaactaattggcgcaagcaagagagttttccagaatttttagaagaaatgaatattccaggaattagtggtgttgacacacgtgcattaaccaaactcttacgttcacacggaacaatgaaaggtatgttagttgatgctgaagttgacattgaggaagcaaaacaaagattacataatacagaaataactagccaaatggtagccgaagtatctacaagtaaagcatatccaaatcctggtaataagcggaatattgttttagtagactatggagttaagcatagtattttacgtgagttggctgcacgtgattgtaacacaattgttttaccttatacggccacagctaaagatattttaagacttaagccagatggagtattactatctaatggacctggtgatccaattatgatggaaaatgcagttgaaatggtcaaagaaattgaggaaaaattgccagtgtttggtatctgcctgggccaccaaatcttggcattagcaaacggggccaaaacatttaagatgaaatttggtcatagaggatttaaccatccagtaaaagaaattgctacaggtaaaataatgtttacctcacaaaaccatgggtatgcagtagatccagattccattgaaggaacagatttaatcgttacacatacagaaattaatgacggaaccgtagaaggtgttaagcataagtattatccagcattttccgtgcaattccatccagatgcagcacctggaccacttgatgcaatagatatttttgatgattttatgcaagttattgatcaaagaaaggaagaaagaaacaatgcctaa

SEQ ID NO: 735 - DNA, 990 bp, Unknownn
  isolated from dental, unidentified
atgaaaaaaattttgatgatgtcagtacgtgaagatgaaaaggaagctattgaaaattggagtgaacgacatcctgatgtggaagttggaattgatgaaggtgagctacatgctgatacagtagctaaacttaaaggttttgatggtgttgttattcaacaaagaagtttagttgaagatgaagtatacgctgaattgaagaatctaggattaaagcaaatttctacaagaactgctggatatgatgtaattaatgttaatttagctcataagaatggtttgaaagtaacgaatgtacctgcatattcaccaagatcagttgcagaattagccttagcacataccatgcgattaattcgtaatttagaattgtttgatgaaagagctgaggaacaagattttagatggattggacttaaaggaaaagaaatccatactttgacaattgggataatcggtgctggtagaattggtggtactgcagctaaattgtttaatgctttaggtgctaaagtaattgcttatgatattaagccaaatccagaattaaatgaggttttgacttataaatcattgaacgaagtgttacaagaatcagatgttattagtttacatgtcgacttgaatgaaacaaccaaaggattaattggaagtgaagaattggcattaatgaaaccaactgcatttctaattaatgaatgtcgtggcccagttgtagatacagatgctctaatcgctgctttaaaaaataagaagttagcaggagcagctttagatacacttacaggcgaagagaatttctttaattttgatttacgtggtaaagaattaccaagtgagcaattaaaagaattaagagcgatgaataatgttattttgacaccgcatgttggtttctatactaatgtcgccgttcaaaatatggttgatattagtttagatgatgtactagctattatttcagagaaaagaagtgaccatgaaatttaa

SEQ ID NO: 736 - DNA, 2367 bp, Unknownn
  isolated from dental, unidentified
gtggtatttttaacaagaaatgaggaaaaactcttgattgatgctaaaaaagaatggcaagaaattgaattatcagaaaatgaacatcttgatgaattaattgaagaaacaggttttcctaagatagttttacaaatattaatggaaagaggatacgattctcttgaagctattaacaattttttagatccagatgctcgtggattgtatgatcctaattttatgcatgatatggaactaggtgtagatagaattcaacaagcaatcatgaatggtgaaaaaatagtcatttatggtgattatgatgttgatggaatcacaagtactgctcttatgtacgaaactcttgaagaattaggagcagaagtcgaatattatatacctgatagatttaaagatggctatggtccaaatgtggaagtctataagcgtttgattgatgaaggtgttagtttaattgtaaccgtggataatggggtagctggacatgaagccattgattatgcaaatcaacatggagtagatgtagtcgtaacagatcatcatgagttacctgaaacattgccagatgcatacgcgattatccatcctcgtcatcctgaaggcgattatccttttggcgaattatctggagtaggtgtggcttttaaggtggcagctgctttactagaagaattgccacaagatgtgctagatttagttgctttaggaacagtagctgatttggtttcgttaactggcgaaaatagaatcttagttaagtatggtttgcaattgttacaacaaacaatgcgtcctggattacaaagtttatataaagtagctggaatagaagcccctacaattacagaagaaacaattggttttacacttgctccacgtttaaatgcattaggaagaatggaaaatggaagtttaggagtagaattactaacgactttagatgaggaaagagctgaagagttagcaaaaactactaaccaattaaatgtaaaaaggcaagaagaagttaatgaaatcgttgaagaagcggtggcacaattagctaataaatccgaaaatcatttagtcaatgtagtggctggaaataactggcatgaaggtgtagtgggtatcgtggcaagtaggttggtcgatatgactggcaaaccttctttagttcttagcattgatgaaaaagcaggcattgccaaaggctcagggagatccattgaagcatttcaaatgtttgatgctttagatagtcatcgagatattctcatgaaatttggaggacatcatatggcttgtggcttgtctttagatagggagaagttgtcagatttacaacaagttgttgatgaagaaggaaagaaacaaggaattgaacatgctacaaaaccggtagtaaaagtcattcctgttaatttagatgatgttaatttggatttagaggcacaattagaagctttagcaccatttggtacagataatcctcgtcctgtttttgaattcaaagattacgaagtgaatacagttcaggcgattgggcaacaaaaaaatcatcttaaacttcaattgcaatccaataactctcaagtggatgccctggatttcggaattggtagcaaaaaaatttctgaaattgagcgaaataaaaattcagttcgtttgatagggactttgggaaaaaatgtttggcaaagtagggttaatcttcaaattatgatagaagatattttgttggatgacagtaatactggcacagttgttgagattcaacgaaaaaataaactaactaagtcaatgtttcaacaacaagcaacatatgttttctttgataaaaaactatacaatcaagtaatgccatatctagctgatgatagtgaagcttatttatataattttagcgatgataagaagttaaattgtgatacgttgattgtggtagattgcccagataatatagaaaaattaaagtctctacttgctaaagcaattgttaagcattttatttttgttggttatactagagaaaatacttacttaaatggcttgccaactagagaacagtttggtagactatataagttctcgcaaacacacactaatgtaaatataagaagagatttacagaaattggcggactatttaaaactaaaacgcgaacttttagtttttatgattaatgtgttttttgaagcgaaatttgttaaaatagaaaatgggttaatgagtggaaacacaaatgtaactccgcataatttagaagatacaaattcatatcaagcatatttacaaaaaatgaaagcacaaaaatcgctaatatacagcaaatcaacagatttacagaagtggatattaaagtatcttgatgaaaataattag

SEQ ID NO: 737 - DNA, 2418 bp, Unknownn
  isolated from dental, unidentified
atgaaagtttctacaaaatggttaaacgattatgtaaaagtagatgatttagctgttgaagaattagctgaaaaaattgaaagaacagcagttgaagtggatgaaacatacagacttgaagaaggattaaaaaagattgttgtcggtaaaactttagaagttgtaaagcatccagattctgatcacttaaatatttgtcaagttgatgtaggtgaagatgaaccaattcaaatcatatgtggagctcctaatattgctgctaatcaaaaagttatcgtagcactttcaggtgcaagaattgccgggaatgttaaaattaagcgcggtaaaatgagaggtcaagtatctaatggtatgatttgtgctttacaagaaattggcttttcagaaagtgttgttcctaaagaatatgctgacggaatttacgtattaccagaatctgctgttcctggagaaccagtatataattatctaggaatggatgaagatataattgacgttgatgtaacacctaaccgtggtgatatgttaagtatgcgtggagttgcacgagatgtagctgctgtttatggtagagaattgactttaccaatggaaactgttaacgaagatgatgaattacatattgaagactatttgacagtaaaggcagataaagaattagctccagcttataaattacgagttattgataatgttactgttaaacctagccctatgtggttacaaaaacgcttatggaatgctggtgtaagacctattaataatgttgttgatgttactaactacattttgatggattatggtcaaccacttcatgcctttgactacaataagattaattcaaaagaattagtagtaagactagctaagcaaggagaaaaaatcacaactctagatgatcaagaacgtgaattacaatctggggatattgttattactaacggtaaggatccaattgctttagctggtgtgatgggtggagctaatacagaagttgatgacaatactacaaccgtagtacttgaatctgcaatgtttgattcatcaagcatcagaaaaacttctcgtcgtgaaaatcttcattccgaagcatcaatgcgttttgaaagaggaattaatcgtggaacaatcgaagaagcattagattatgctgctaatttgattgcggaattaggcgatggtaaggtagctactggaattgcgcaagaacaagatatagatgttcaagatactacggtagaaatttccttagaaaaaataaataatgtcttaggaacagatttatcagttgcagatgtgacagatatttttgaacgtttaggatttaaggttgaagaaaatgctggcgaatttgttgtaaatgtgcctccatttagatgggatattagcattcctgcagatttaatagaagaagtagcacgtatttatggttatgacaatattccagctactttaccagtaggtccaactactccaggacactatacttacgaacaacaagtaattcgtaatacacgcgcaattcttgaggcttctggattaacacaagctatttcttatgggctcacaactaaagttaaagctgagagatttgcttttgaaccagcaatgaagtcaacagaattagatttcccaatgagttctgatcatacaacagttcgaatgaacctaatttctggattattagatgatgtttcatacaataaggctagaaaagttgaaaatgtagctctttacgaacaaggaagagtattcttcagagatgaagattcagaacgaccaagagaagtggaacatgttgctgcagctatgactggattaattgaagatgcaacttggcatgataagaaacgtccggttgacttctatgtaattaaaggaattgttcaaaatctattggataaagtaggagtaggttctagagttgtttatacagctacggcagaacatgaggaaatgcatccaggacgtacagcaaatatttatattgatggtgaatttattggatttgttggtgaagttcatccaactttagctaaagaatacaatttagatagagtttatgtatttgaattagacttacaaaaagttatggaactttctaaagatcctgaagtttatgaaccagtatctaaattccctgcaattaagcgtgatattgctttactagttgctgaagatattcaaaacagtgatatcattaaaacaatcaaagaaaatggcggggctaacttagcatctgtaaatatctttgatgtttatgctggtgaaaagattgacttaggattcaagtctttagcttatactttaactttcgaaaataaagaacgtacattaacggatgatgaagtaaataaagcatttgataaagtagttaataaattacaagaaaattataaagctgtaattcgttaa

SEQ ID NO: 738 - DNA, 1320 bp, Unknownn
  isolated from dental, unidentified
atgccagaaaataaaaatcatgttcaacttcagcgttcgctaggtttatattcagcattatcattagttattggaacaattattggctcaggaatattttttaaacaatcttccattttggctaatgcccatactacaaccatggcaatcgctgcatgggttattggtggtatcattacattaactagcggcttaaccatcgctgaaattggatctttattccctcatactggtggattatatgtttatatcgaaaaaatatatggcaaattttggggattcttagctggttgggttcaaataattgtttatggtcctgccttaatcgcatctctaggtgcataccttgctatcttaattggtgcatttttccattttcctagaacttggacacccgcaattgcaattatttcaattttattaatttcattgtttaatttgttatccaatagatttggagctgcactacaaatatttaccacactctgtaaaatggttcctatatttttaatcattatctgtggaattttatttggagatgaacacgcattaggacaagtcgtaagtaacggtcaagcttccattggtaacttcggtgttgctgtattagctacgctttttgcttacgatggttggatcttaattgctaatcttggtggagaaattaaaaaccctcaaaaaattcttccattagcaatcatcttaggaacttcctttgtgttaatcgtgtatgttttacttactgtaggaattttcaaggctatgccagctaatcagataactaaacttggagaaaatgctgctccttattttgcaattaaaatgttcggctcaattgggggtaaaattctcaatcttggaattattatttctatcattggtacaatcaatggtaaaattatgacattcccaagaattatgtttgcgatggcacgcgctaacgagcttccattttcaaaacaattagcttggttacatcctagaatgttttcccctgttgtttcagttcttacaatgtttagttttgcatctatcttgatattattctttgaccctgatagattatccgaaatttgtattttttctatttattgtttttatctcattgcatttttcggtttatttaaacttcgtaaacaacgcaaggatttagttagaccttttaaagttcctctatatcctcttacaccaattattgctattttaggagctatcttcgttatgcttagcgaaatattctctgatcttaacggtgtgttagtttcatttgtatttatcttaatcggtgttccagtatattattggaaagtcaaaaaataa

SEQ ID NO: 739 - DNA, 936 bp, Unknownn
  isolated from dental, unidentified
atgtctgacaaatacgatgtaattgtgattggggctggccctggtggtatgacagctgctttatatgcctctcgtgctaatttaaaagtagctatacttgaccgtggcgtatatggtggtcaaatgaataacacagctgaggttgaaaattatcctggttttaaatctattttaggtccagatttagctgaagagatgttccaaagttctacacaatttggtgccgaatttgtctatggtaatgttgaagatcttaccgttgatgataatggcattaagcatgttaagactgatgatggcgagttggaagcacccgttgttattattgccacaggttctcaatatcgcaaattaggtgttcctggtgaagaaaaatatagtggtcgtggcgtatcttactgcgctgtctgcgatggtgctttctaccgtgataaacccgttgtagttattggtggtggcgattctgccgttgaagaaggtatgtatcttgctaaattaacatcttctgttaatgtaattcatcgtcgtgatgagctacgtgcacaaaagattttacaagatcgtgcttttgctaatgataaaatgcacttcacatgggatacaattgtaactgaaattgttggtgatgataaaaaggttacaggtgtaaagactcataataaaaagactggtgaagatggtgaaattgaagccaatggtgtatttatctacgttggctcagttccaatgagtgaaccattccaaaaacttggcattactgatgataagggatggattgtaactgacgatcacatggcaacaagtgtcccaggtatttttgctattggtgatgttcgttctaagttcctacgtcagattacaacagctgttggtgatgcaggtattgcaggacaagaagcatttgcttatattgaaagcttgaaagataaaaattaa

SEQ ID NO: 740 - DNA, 1203 bp, Unknownn
  isolated from dental, unidentified
gtgcaggatagacagtcgcgagaacgtcgtgaagaagaagacgcacgaatagattggggaattattctatctgttatggttcttgcaataataggaatgctttcaatttatgttgctgcaagtcatgacactagtacaatgagtgtaccaagaacacttatttctcaagctatgtggtatgcaatagggataggtgcaattatatttattatgcagtttgatgctgaacaattgtggaaagtagctcctattgcgtatggtttaggtattactttgttagttttggttttgattttttatagtagagcttatgctttaaagactggggctaagagttggttagctttcggacctttgacttttcaaccgtctgaagtgatgaaacctgcctatattttgatgttaggtagggtggttgcacagcataatgcagagttttatgaacacactattaaaacagattggaatttgataggaaagttggctctatggacattgccggttgctgtattgttgaaattacaaaatgacttcggtacaatgttagttttctttgctattctcagtggtgtgattttagtttcaggtgtttcttggaagatattagcgcctctttttggaggtgctgccttcttaggaactgcaggtattttattagctgtttatgggagaaatttattaatggcaataggtttcaaagcttatcaatttgctagaattgaagcttggttgaacccatctgcatccactacgggtaatagttatcaattatggcaaagtatgaaagctattggatcaggacagttatttggtactggatttaatcattctaatgtatatgttcctgttagagaatcggatatgatattttctgttataggtgaaaattttggattcattggtggatgcattttgatttttatatatctattacttatttttcaaatgattcaggttacctttgatactagaaatgaattttatgcgtatatttctacaggtgttattatgatgatcttattccacgtttttgaaaatattggtatgagtattggattattaccattaacaggtattcctctaccatttataagccaaggtggatctgctttaattgcaaacatgataggtataggattaataatgtctatgagataccataataagatctatatgtttagcagtagtaaggaatttcgttaa

SEQ ID NO: 741 - DNA, 2979 bp, Unknownn; identical to SEQ ID NO: 459
  isolated from dental, unidentified

SEQ ID NO: 742 - DNA, 414 bp, Unknownn
  isolated from dental, unidentified
atggataatatgaataagagtactattgaatatttagttgcaaaattcaatcgtaagattagattgagcttaaatagagagctactcaaatatggcttaaatgaagctaatttttattatttatttgtagttattaataatccaggaattaatcaagtacagatgatcaagttattagatcgtgaacaaagtatagtgacaaagcaaatttctaatttagtcaaaaatggctggttagaaaagagaaagtcaacaattgatcatcgtcaaactgaattatatcctacaagtaagaccttagataatatagatgatattactgaaattactgaaaaagttagtgctgaagtaacgtctaatcttagtgaaaaagaaagtgcaactttacaaaaattattgcaaaaagttttataa

SEQ ID NO: 743 - DNA, 795 bp, Unknownn
  isolated from dental, unidentified
atggaatataatttaaaagataaatatattttgcagttaaatgaaaaagaaaaggcattagaaacaagggatttgaacatcttttatggagaaaaacaagctttatttgatgggaatttacaatttgaaagatataaaattacttctttaatcggtgcttcaggatctggaaaatcaacttttttacgctctttaaatcgtatgaatgaaggagtagcagatgttaagggaagtatcttatatcgaggaatcgacataaattctcctaaaataaatgtttatgagatgagaaaatatattggaatggtttttcaaagaccaaatcctttttcaaaatcaatatatgaaaatataacttttgcattaaaagaaaacggaataaaagataaagaaaagttagctgaaatagtagaaacaagtttgaaacaagctgctttatgggatgaagttaaggatgatttaaataagagtgcactagctttatctggaggacaacaacaaagattgtgtattgctagagctattgcgatgaaacctgatattttactattagatgagcctgcaagtgcattagatccgatatcaacagctaaaatagaggaaacattattagaattaaaggaaaaatatactttgataattgtaacgcataacatgcaacaagcttcaagaattagtgattacacagcatttttccatttaggaaatgtcattgaatataacaaaacaaagaatatttttacaaatcctaaaataaaattgacagaagattacatttcaggaaactttggatag

SEQ ID NO: 744 - DNA, 849 bp, Unknownn
  isolated from dental, unidentified
gtgattattttggcaaaaattcctaactatactttaaatgatggtaatcaaattcctgtacttggatttggtacttataaattgaatggtgctacaggagttaatgccattaatagtgctttaaataatggttattcattattagactctgcctttaattatgaaaatgaaggtgcagtcggcgaagcaatcagacgttcatctcttaagcgtgaagatatcttcgtaacatctaaacttccaggaagacatcaagtatacgaagaagctatccctactattcaagaatcactttatcgtgcaggcttagattattatgatctatatctcatccattggcctaaccctaaagaagatcattatgtcgaagcatggcaagctttaattgatgcacaaaaattcggtcttgttcgttcaattggggtctgcaacttcttacctgaacatcttgatcgtttagctaatgaaacaggtgtgatgccagctgtaaaccaaattgaattacatccatattggtctcaagctgttcaaagagaatatgataaagaacatggtattttcacacaagcttggagcccactaggtagagctaattcagtattacaagatcctgtaatcgttgaaattgccaagatgcatcataaatctgttgctcaagtaattttgcgttgggaattccaattaggtgtaggtattattcctaaagctaactctacaaaacaccaattatccaatttggatatttttgattttgaattatcagctgatgaagtcgcagctattactaatttggataaacctaatggcagaactaagaatcaagatcctgctgtttaccaagaattttaa

SEQ ID NO: 745 - DNA, 2067 bp, Unknownn
  isolated from dental, unidentified
gtgaaatttttacgcagttcacggagaaatagacggaatagtaatcaaaattcattaattccgtttagattaaattttctctttgttattgtatttttattatttgcagcattgattgctcagttagcatatttacaaattgttaatggacagaaattttcaagtgaagcagcaaataatgatacttatactgaaaccactaatgttcaacgtgggatgatgtatgattcaacaggtaagttaattgttggtaataattcttcaagagcaattacctatacaaaaccccttggcgttacgaatcaaaaaatgagagcaattgctgatgaattggtaaaatttgtatctatcaaaacagattcattaacgagtgggatgaaggctgaatattatctagctaatgtaaagaattatgatgctgtaaaaaagcatattaaaaatgctgatagtttagatagtagtgagttgaatcgtctaatgatcacttatgttagaaagcatggtctagtttctgatatgactaataaggaaaaaggagcagcaatcgtttataacaagatgagtggtgcttattctctatcaagtgtttatattaagactagtggtgttagtgatactgaaatggctgaagttggggaaaatctttcttcaatgcctggaataaagattggaacagattggacacgtagttacccagatggaacatcgataaagaatttagctgggactgtaacaactgaaaaacaaggtttgccagatgattctattaatactttcttagctcaaggatattcaagaaatgatagtgttggttcaagttatttagaaaaacaatatcaggatgtcctaaagggtactaagaaaaccaccaaagtatttactcaaaacggtaaaatcactaaagaagttgaacaatatggtggacaagccggtgatgatgttcagctaacaattaatgctaaattccaacaagatatgcaaaaaataatggatagcgcagttgctggattaggtggttattcaaatggtggttatgcagtagcgattaatccacatactggtggcatttatggtatggccggtgtttatcgtgaccctaacacaggtaagacaactgttgatcctgctggggcaattaatcaatctattactatggggtcggttgttaagccagctatgattattggagctttgaagtcaggcgttattacacctgataataatgtgttgactgatatgccaatcaaagttaaagatacgccagtcaagggatcatggtttaataagagtggtggagctaatgtggctttaactgcttctgatgctttgatggtttcttctaactcgtacatgatgcaacttgctatgaaggaagcaggatttaagtatagttatggtgcaaccttaactatgccaacctcaatttttaagaaattaagaaataactttaatgagtttggcttgggtgtaagaacagggattgatttacctggtgaagtttctggattggaaggtaagagtacagctaaatatattggtagtgcccttgacctttcttatgggaactatgattcttacacaacaattcaattagcccaatacgcttccattttggctaataaaggttataaaattcaaccacatttactacaatcaatcagagcaaatggcaaagatggtaagatgggtgctgtaaaatatgaagttaagcctaatatcacgggcgtgatagatgttccagattcttattgggatattattcacagtggtatgtataaagtagtacacggaactagtcaatatgcaactggtacagcaatgaaggatattaatccagccattgcagctaaaacaggtactgctgaaactgtttataagaatactgatacaatcacattaagtgctattagttatgctccttatgatgatccacaagtagtagtggttgtagctttcccaaatcttgctagtgataaaagtagtgttaacatgaatactttgaagagtatttatgaagcatactggaaagatgtccaatctagcgatggatataaaacatctaaataa

SEQ ID NO: 746 - DNA, 714 bp, Unknownn
  isolated from dental, unidentified
atgtctgaactgttatatgaaggtaaagctaagcaaatgtggagtacagaagatgaaaatgtattaagagtagtgtatatggaccaggctactgcactcaatggtaagaaaaaggatgtcattaaaggtaagggtcatgttaacaatcaaatttcaagtttaatctttgaatatttgataaagaatgacattcctacacactttataaagaagatttctgagaatgaagaattagtaaaaaaagttaaaatttttccacttgagatagttacacgaaatgttgcggcaggacatttttcaactagatatggagtagaagaaggaaagaaattcaataaacctgtagaagaaatgtacttcaagagtgatgaattagatgatccattcattaacgaatcacaggcattagcgttagaaattgctactaaggaagatttaaatagaatctgggatttatctagaaaagtaaatacattattgacagatttatttaaacaagcaggaatgaaattagttgattttaagcttgaatttggaactttagcagatggtacattagttttagctgatgaattttccccagataattgtcgtttatgggatttagaggataatcgtcatttagataaagatgtctatcgtagagatattggtgacttaacacctgtatatgaagaagtattaaatcgtttgaagaaagtgttaaacaaataa

SEQ ID NO: 747 - DNA, 1377 bp, Unknownn
  isolated from dental, unidentified
atgacggataatttaccaccacaaaatatagaagctgaacaagcggtcttaggtgctatcttcttgaatacagatgctttagcagatgcgatggaatatgtggaagctgatgatttttatcgaagagcacatcaaattttattccaagcaatggtaaatttgaacaatgatggtgaagcaatcgatgtattgacagtacaaaactatctgactactaataatcaattagatgatgttggtggagttgcttatattgcagaattagcaacatcagtaccaacagcagctaatgctggatattatgctaaaattgttgaaggaaagtctatgttgcgtcgcttaatttctactgcaacaaatattataacgcaagcaaataacggtgatgatgacgtaccatctctattagattcagctgaacggcaaataatggacgtttcagagcgaagaaatcgtagtgggtttagagagattaaagatgttttaaatgagacattgagtgatattgatagattatcacagcaaagtgaagatattacaggtttaccaactggatatagagaatttgataagatgacggcaggtttacagccagataatttgattattctagctgctcgtccagctgtaggtaagacagctttcgccttgaatattgctcaaaatgttgcaacgtctacggatacaagtgttgctattttttctcttgaaatgagtgctgagtctttagtaaatcgaatgttgtgtgcagaaggttcaataaatgctaaccatttacgtacagggcaactagatgaaggagaatggcaaaatttaatcgttgcaatgggagctttatcaaatacctcaatctttattgatgacactccaggtattaaaatggctgaaatcagagcaaaatgtcgtcgactagcaaaagaaaagggtaatttaggtttggtagttattgattatctacaattaattgaaggtagtaataaagaaagtcgccaacaagaagtatctgaaatttcacgacaattaaagaaattggctaaagaattaagtgtgccaattctagccttatcccaactttcacgtggagtagagcaaagacaagacaaacgtccagttctatctgatattcgagaatccggttctatagagcaggatgcggatatagttgctttcttatatcgtgatgattactatgaacgtggtgaatcaaaatcagaggaagatggcgatgatcaggattcattaaatcaagatgttggtgaggttgaattaatcattgaaaagaaccgtgctggagctagaggaacggttaaattattgtttattaaatcctataataaattttcaaatatttcatatgctcaagagccaccaatgtag

SEQ ID NO: 748 - DNA, 2001 bp, Unknownn
  isolated from dental, unidentified
gtgattgagcgtcaagcagatagaaattttgaattagtttctaagtatagcccaactggagaccagccggaagcaatacaagaattaacagaaggaattaaaaaaggtgaaaaagctcaaattttaatgggagcgacaggtactggtaaaacttttacaatttctaatgtaataaagaatgttaataaaccaactttagttttagcacataataagacgttggcaggacaattatatggagaatttaaagaattctttcctaataatgcagtggaatattttgttagttattatgactattatcaaccagaagcttatgttccttctagcgatacttatattgaaaaagattcaagtatcaatgatgaaatagataaacttcgtcactctgctacaagttcgttattagaaagaaatgatgtaattgttgtggcttctgtttcatcaatctttgggttaggtgatcctcatgaatatagagaacacacaatttcattaagagtcggacaagaaattgagcgtaataaattattaaatgatttaattgatattcaatttgaacgaaatgacatcgactttcaacgtggacgtttcagagttcgtggagatgttgttgaaatctttccagcttcaagagatgagtcagcattacgagtagaattttttggcgatgaaattgatagaattagagaaattgacccattgactggagaaactatcgctgatagagaacacatcgctattttccctgctactcactttatgacaaatgaagaaagattaggaacagcgattgagggaattcaacaagaattagaagaaagaacgactgaattaaagaatgaaggaaaacttttagaggctcaaagactacagcaaagaaccacgtatgatattgaaatgctaaaggaaatgggatattgttctggaattgaaaactattcaagacatatggatggtagaaaaccaggagaagcaccttatactttattagatttcttcccagatgatttcttgattgtagtagatgaatcacatgtaacgatgccccaagttagaggtatgtataatggggatagagctagaaagcaaatgctggtagattatggatttaggttacctagtgctttagataatcgtccattaactagagaagaatttgaaaaacatgtaaatcaaataatttatatgtcagcgacaccagggccttatgaacaagaaaaaacatcacatgttgtacaacagattattcgaccaactggattattagatccagaaattgaagttcgtcctattatgggacaaatggatgacttagttggagaaatcaataaacgggttgaacttaatgaaagagtatttgttacaacgttaactaaaaaaatggctgaagatttaactgattatttcaaagaaatgggaataaaagttaaatacttacactctgatataaagacattagaaagaaccgaaattgttcgagacttaagaatgggaaaattcgatgtattagtaggtattaatcttttgagagaaggaatagatgtgcctgaagtttcattggtagcaattttagatgctgataaagaaggatttttacgaaatgaacgctctttaattcagacgattggacgtgctgctcgtaatgcaagtggtcatgtaattatgtatgctgacgatgtaacaccttctatggaagcagccattaaggaaactaagagacgtcgtagtatccaagaacaatataataaagatcataatattattcctaaaacaattattaaaccaattagagcagctatttctataagttcaaaagttaataaatcagatacaaatattagtgatacagtagattttgctgatatgagtaagaaggaacaattagaaatgatttctaatctagaagaacaaatgcgtgaggctgctaagaagttagattttgaagaagctgcaacattaagagatactgtaatggaattgaaagcacagattagttaa

SEQ ID NO: 749 - DNA, 882 bp, Unknownn
  isolated from dental, unidentified
atggtattacaagtaattagtagtttcaaaggacaaacttcaaatggaactttatatttggttccaactcctattggaaacttaggagatatgacacccagagcgatagaagttttaggtgaagtagatttaatagcagcagaagatactagaaatacccaaaagctattaaatcattttaatatcagtactaaacaaattagttttcatgaacataacactcaggaaagaatacccaagttagttgaaaagttaaagacgggtataaatattgcacaagttagcgatgcaggtatgccatctataagtgatcctgggcatgaattggttgaggcgtgtattaaagaagatataccagttgtaccactaccaggagctaatgcaggtataacagcgttaatagcttcgggattaattccacagccattttatttctatggtttcttgccacgaaaaaatagtgaacagaaacaagaattaacgaatttaaaaggacatactagcacaattattttctatgaagctccacatcgattgaaaaagaccttaaagaatatgttagaagtgttgggaaatagaaaagttgtattatgccgcgaattgactaaaaaatttgaagaatttattaggggaaacttagaagaagtaatggaatgggcaaatacttctgagattcgtggagaatttgtaataatactagatggtaatcataatgaacaagtagaagagaataaggtaaccactaatttaagtattgaagaacaagtaaaagagttgattgaagataggaatttaaaacctaatcaagcaattaaagaagtagctaaagaaaatggactaaaaaaacaggaagtatacaatttatatcatcatttggattag

SEQ ID NO: 750 - DNA, 738 bp, Unknownn
  isolated from dental, unidentified
atggattttccattatttacacgattagctgcagaattttttggaactgcaattatgcttatgttaggtaacggatctgtagctgacgttgaattaaaaggaactaaaggctaccatagtggttggattacaatctctatcggttatggttttgctgttttggttccagctttgatgtttggtagtgtttctgggggacaatttaaccctgctatgactttaggtttagctatcaatggagcatttccatggaatgaagcatttttatacatattagcacaattcttaggtgccatcgctggtcaattggtcgtagttgcttgtttctaccctcactacgatattactgaagaccctgaaagtattttgggaacattctcaactatttctgcaacaaatagtcgtttcaatggtttcgttaacgaattctttggaacatttactttagtttttggtgctctagcaattactcatacttcattctttgaacatggtaaccaaggtgctggatacataggtatcggtttactagttatggttttagttacttcattcggtggacctactggacctgctttaaaccctgctcgtgacttgggccctcgtatcgttcatgcattacttccattaaaacataaaggttcttctcaatgggattatgcatgggttccagtattagcacctatttgcgctgctgtttcaggcgttttaatttataatattatttttggactttaa

SEQ ID NO: 751 - DNA, 873 bp, Unknownn
  isolated from dental, unidentified
atggatgagttgcaaaaggtgtggaagagacaccagtattttgcaaaagcatcaatggcttttatttatggtattttggtatcaattgcattaaatttcttttgggatcctggtaagatttattcttcaggtattacggggttagcccagttgatttctacattaactgcttcaagtggaattcatttgtcgacagcgctaatgctatttgtgttgaatctacctttgtttatattagcatggttccaaattagccataaatttacaatttttacaattttggcagttgttttttctagtattatgatgaaagttattcagccagttactttaaccaatgatcctattatttgtgcaatttttggtgctgctattaatggctttggaacaggattagcattaaaaaatggtatttcaactggtggattagatattattagtttaactgtgcgcaaacgcactggaaaatcagttggtacagtaaacttggtttttaatatgttcataattatagctgctggttttgtttttggctggccacatgctttttactcagctttggggattttcatcaatgctcaagtaatggatatggtttatactcgtcaacaaaaaatgcaagtgatgatagttactaataaacctgatcttgtagttaagactattcaacatcacatgagaagagggattacaattattcatgatgctgaaggagcatatcagcatgacagaaagacggtattattaactgtaatttctcgctatgaaatgtttgacttaaaagaagccatgcgtgagtcagatcctaaggcatttgtcagcatcgctgaaaatgtacatatattaggaagattttatgaaccaagtatgtaa

SEQ ID NO: 752 - DNA, 2790 bp, Unknownn
  isolated from dental, unidentified
atgataaaagaaagaatatatgcagtggttgatttagaaactacaggtcctaaacaagatggtagcgataaaataattcaatttagctgtgattttgtacaatcaaataaaattgtaaatcatttttctaccttaataaatccagggatgcctataccagctgaagtaaagaaacttacaggaataaaagataaagatgtacggtacgcgccatattttgatgaagttgcaggaacaatttatgcgatgttgcagaatacaacttttgtagcgcataacgtgaattttgactatagtttcttaagttctgaattagaaagggctggatacccagaattggaattaccaatgatggatacagttcagctgacacaaataatttatccaacattagtctcatataggttaatagatgttagtaagtatctacaactttctcatatacatcctcataaagcggatagtgatactaaagcaacagctgaattattaattaatttaaaaaagagaattgaaactttccccttaattctattgcaaagattagcgaaaatgggggattctttaattgctcaaacaggtgaattttttaatgaagtataccttaataaaaaggatagagaagagaagttacctaatgatttaatggtcgtagaagatattgtcttaaaaaggcctaaactcatagacgaaaaaatatcaaaacaagaatatcctgagacaaaggatgaaaagcaaaatcttttttctgaagtcttggaatggcgttctagtcaaataaaaatgatggatgatattaataatgacttgaatgaaaaaaaatcaaaaaaatatatatatgatgccgcaactgggattggcaagacattaggctatctaatgcctattgcatataaagctactgaagaaaaagttgtaataagtaccgctactacaactttacaaaatcagttaatagataaggatatatcaatgttaaaagaagttattccttttaatttgaatattgtaaatttaaagggaagccagcattatattgatatagataaattctaccaaagtttatctatccctcagtcaaaaaaggccactcaaatacagatgactttattagtttggcttatggaaacttcaactggcgatatggaagaacttaacttattgagtatgcaagatacaatttttgcacaaatagagcatcatggtataagaggactaaataaaaaaagtgcattttattcagtagactttttaaagcggcaagaaattttgagaagacatgcgaatataattattacaaatcatgcttatttattaagtcatgttgataaattaggcggaaatgacacggtattaatagttgatgaagcacagcacctgaatgataatttgcttaaagaaaacagaaaaacaatagattttgatcaaataaaaataatttctgattcattactagtaaaaacggaatcacaattatctttttcatttagagatttggtagagataaattttattactaaagcacaatatactgagttaataagaccaattcaaactatagactatgaaataatgaatctaagagaaatttttatgacttatcttaattcaaatatgaacaaagcatcagatgtatatgttgaagttccaataaaacctttgaatcttagaggaatgattaaggcaaatttatttatattcaaaaaaattgagaaagctttaagaaatttaaaaaggcttcaaaataaattttctcaaaagtatagcatagccattgttactgggagattgggattggatgaaattcagttaataaatgattatcaaaagttacttaatcttttattaagcgaaatgaaaagttggtcatatctagatttaaatagattggaagatgaattggaaacagagtttatctggttgacatatccatataaacaagaaaatggacatttacgtttgaattttatcatgttagatggtgagaacttcttaaatgatagagtatataaaaaattttctacagttttactggtaggtgcaaacctagctatgaaagaaactagggattacatgtttagacaattagatctcaatagtcaggttaagattaagaaatacgataatatttttgattatagcaaacaaactagagcctatattttaaaaaatattccggatataacgtcgatttcaaaaaaagaatacatagagtatttatctcatgatttagagaaaatattgctgaataataatagacagacattgatattatttaattcattagaaataattgaatcagtttatcctaagttagttaagaaaattggaagtaaacgtgagattttagcgcaaggtataactggcagtgtagaaaaaattaaaaagagatttatgctaggagaaggaaaaattttattaggagcaggcgctttttgggaaggtattgatttacctgaaaataatttagagatggtaatagtcacacgattgccattccagtctccagatactgtccttaataaagctaggtatagaaagttagaaaaaaaaggaattaattcattttataatctagctttaccagaggcaattttaagattgcaacagggttggggaagattaataagaacacctaaagataaaggaatatttgtattacttgattcaagaattgccaataaaaactatggggaaaaatttattagttcgtttccagatggagttaatcttaaaagtttgaaaattgatgatttactaaaagaaattacttcattttttgatgaataa

SEQ ID NO: 753 - DNA, 582 bp, Oribacterium sp.
  isolated from dental, Oribacterium sp.
atgggaaaattaattgtaaaagaaacaaaattacaagatgttaaattaattacaccagcagtatttggagataatcgtggatttttcacagaaagttattcagatcgtgattttaaagctgctggaattgattttgattttattcaagataatcactctctttctactcaagcaggtgtcttacgtggtttacattttcaacgtggtaaagctgcacaaacaaagttgattcgagtagcaactggggcagttttagatgtaatcgttgatttacgtaagggatctcctacatataagcaatgggaaggatacatcttatctgaaagtaatcatcgtcaattgttagtacctaaaggctatgctcatgggtttgttactttaactgacaacgttaacttcctttacaaatgtgataattactatgatgcagaagctgatggtggtatctccttcaagactcctgaacttaatattgactggccaatcgacttagataaggcaatcacatctgaaaaagatgctaaccaacctactttaacagaatttgaaaaagacaatccatttgtctacggcgaaatttag

SEQ ID NO: 754 - DNA, 915 bp, Unknownn
  isolated from dental, unidentified
atggaagaaaagaaaattaaattaacaaaagctgatcgttttaaaatgttcttgcgttcttactttctattaagttcctttaactatgaacgtatgcaaaatggtggggttgcttatactttaatccctgcaattaagaaactttattcaagtaaagctgatcgtgcagctgctttgaagcgtcacttagaattctttaacacacatccttttatggcaaatcctatttttggtgtaacacttgccttagaagaagaacgtgctaacggcgcaaatgttgatgatgctgctatctctggtgttaaaattggtatgatgggacctttagctggtgctggtgacccactattttggttcacattacgtccaattatgttatcattaggtgcaagtcttgctgtatctggtaacgttgctggtccatttgtattcttcattctatggaatatcatggcagctgctgttaagtggtatacacaagaatttggttatcgtgctggtactgctatcactgatgacttatctggtggtttattacaaaaggtaactcgtggagcttccatgatgggtatgttcgttatcggttccttgattcaacgttgggtatctatcacatttactccagttgtttctactgttaaacaacaaaaaggtgcttacattgactgggaaaaacttccagcaggcgcaaaaggtttgaaagaagcatttacacaatatgcagctggtcgttcattgagtgaaacaaaagttacaactttacaagataacttagatcaattagttccaggtttggctgctctaggtctaacattcttatgtatgtatcttttgaagcgtaaagtttcaccaatcgttattattcttggaatcttcgtattagctattgtattccacgtaattggtttactataa

SEQ ID NO: 755 - DNA, 1017 bp, Unknownn
  isolated from dental, unidentified
atgactgctttacaatttttatggttcattttaattggggtactatttgcaggtttcttcttccttgatggatttgattatggtgtagggatggcaactaagactttggcacaaaatgatgctgaaagaactcaattaattagaacaatcggtccagtttgggacggaaatgaagtttggctcatcactgctggtggggcaatgtttgcttctttcccttactggtatgcatccttattctcaggatactacttaattttattaattatcctattaggtttaattattcgtggagtatcatttgaatttagacatcatgctgaaggtgctaagaagagaacatgggattggactttagcaatcggtagtttcatcgtaccattcttctttggtattttattcatcagtatggttcaaggcatgccaattgatgctaatggtaatatgcatgctggtttctttgattacatcaatgtcttttcagttgttggtggtgtagctttaactttattagtttacttacatggtttgaactacattgcattgaagacagaaggtgctatcagagatagagctaagaactatgctcaattcttatattgggtactatatgtaggtttggttgtatttgcactattgttaattttccaaacagacttcttgaaagtacatccaattagcacattagctattttagttgtaattgtacttttaactgttttagcacatgtatcagtatttaaaggtaaggaaattaattctttcatttatagtggattgactttagtagctttagtagcattactattctcaggtttattcccacgtttgatgatttcctctatcagtgctaaatacaatttagtaatttcgacagcatcttcaacaccttatactttgaagatcatgacaattgcaacattctgtcttttaccttttgtattggcatacacaatttgggcatactacatcttcagaagaagaattaaaatgcctactataacggagggtgaataa

SEQ ID NO: 756 - DNA, 669 bp, Selenomonas sputigena
  isolated from dental, Selenomonas sputigena
atggaaaatatagtttcagttgatggtctgaatatagatttgcctgatcgtcgtttatttgaaaatttagcctttgatattcctagaggggctttaacatgtataactggagaaaatggtgttggaaaaacaacattagttaagcacttattacgtgatttaaaaactaattcgcataaccattttgttaaatttactattgaacgtgatgaagctttctatatgccacaaattagaaatattgatgaggattatcctttagcaattaaggattttgtatcattgggttttaagcatcgattattaccatggaatacagtagtaatgaatgataagttaaaacagattttaaaagaaacaaaactagaaaatctagctaaaaatccactaggtaaatgttctggtggtgaaaaacaaagaacatacttagcacaagcgttatgttcagatcccaaattattgatcttagatgaggcgactgctaatttagatcaatcatctaaacatgaactgatgcgacttttaaaaaaattgatgccaattcatggaattacagtattatttattacacacgacgcagagttaatagaagattatgcagattatgaattacatttagaaaataaatcaggtaaattgatgaagagagaggcgagatatcgtgtttga

SEQ ID NO: 757 - DNA, 1143 bp, Unknownn
  isolated from dental, unidentified
atgaaaaatgaaatgttaggagtaatccttgcaggaggtaaaggtacacgtttaggaaaattgacacataatcaagctaaacctgctgtaccatttggtggacgttatcgcattattgatttcactttaagtaattgcgttaactcaggagttaaaaatatcggtgttattacccagtatcaacccttaaatctaaatgcacatattggaaatggtgctagttggggattagatgacttgaatgcgggagtaacaatattacaaccatattctaataatgaaggtagcaagtggtttgaaggtactgctcatgctatctatcaaaatattggttacattgatcaaatggatccagaatatattttaattttatctggtgaccacatctataagatggactatgaagcaatgcttgaccaacataaagaaacaggagcttcattaacagttgctgttattgatgttccttgggatgaagcatcacgtttcggaattatgaatactgatgacaataatcgtattattgattttgaagaaaagccagctgaacctaagagtaatcatgcttccatgggtatttatatcttcaactggaagagattacgtgaagttttagtaaatagctttactcgtaatcaagatatggtggacttcggtaaaaatgttattccatattacctaaagagtggtgaaagtgtatttgcatacaacttcaaaggatattggaaagacgttggtactatcgattcattatggcatgcaaacatggaattcttagatgaaaataatgaattaaacttacaagatagaacatggagtatctattctagaaatcctattgcaccaccacaaattattgctgaaacagctgaaattaaagatgcaatgattgttgatggctcttatattgcaggtaaggttgatcatagtattttatctgctaatgtaaaaattcaaacaggttctgttgtaacagattctgtgatcatgccaggtgcaaagattggtaaaaatgtaactattcatcgcgcaattatcggtgaaggtgctgttatcggcgatgatgttgtcattgatggtacagatgaaattgcagttatcggaaataaagaagtagttggggtgacaagtcatgaagaataa

SEQ ID NO: 758 - DNA, 2238 bp, Unknownn
  isolated from dental, unidentified
atgccaattacatataacgaaaaaagcagagagtttcacttgtataataacaaaattagttatctaattaaaattttagctaatgaacagttaggacaattgtattttgggaagcgtattcctaacagagaaaatcatgactatttagtagagaatacatatcgcccagttacttcctatgtttttgatgatgactattcattttcattaggaaacgtaaaacaagaatatccagcttatggtacgacagatcaacgacgtccagcacttgatataaaacaacctaatggcagtcgaattactgattttaaatatgtttctcataaaatttatgctggaaagagaaaattaacggggttgccagcaacttatgtagaaaatgaaagtgaagcaactacacttgaaataaatttgtatgatgaattaattcaagttacattgtgcttacaatatactatttttgaaaatagtgctgcaattgctagaagtgtgaagtttagtaatgatagcgatcagaaatatcaattaaaaacagcactaagtttaaatttagatttgcccgatgctaattatgaatggttacaattttcaggtgcttggggtcgagaaagatacttacataagacacctttacgtccaggaattcaagcaataaatagtgctagaggtgcttcaagtcatatgcagaatccttttgttatcctaaaaagaccatttacgacagaagaacaaggtgaagctttaggggttagttttgtatatagtggtaactttttagcccaagcagaagtagatgaatattcagtaactcgtttacaaattggaatagatccattccagttcagttggtgtttaaagccaaatgaaacattccaaacaccagaagcaattttagcttatactagcgaaggattaaaccaacttagccagactttccaaaaattgtatacgacgaggctagctcgaggatattggagagataaagaacgtccaattttgattaataattgggaagctacttattttgattttactgaagaaaagctattatcaatcgcaaagaaagcaaaagaattgggaattgaattatttgtattagatgatggttggtttggagagagaacaaaagaaacagcaggtttaggtgattggtacgttaatcgaaatcgattaaaaaatggaatttcaggtttatcaagggaaattcatgacttgggaatgatgtttggtttatggcttgagccggaaatggtcaataaagatagtgatctctatcgaaaacacccagactacattattgaaacacctaaacgacacgcttcacatggtagaaaacaatacgttttagatttttcaaggaaagaagtagttaataatatttatgagcagttagttaagattttagatgaagatgaaatagattatattaaatgggatatgaatcgtaatattactgaatgttattcaatagcttatcctccagaacaacaaggagaaatcatgcatcgctacattttaggtgtctataatttatatgaacgtttaattgaacgctatcccaaaattctatttgaatcttgtgcaagtggtggtgggagatttgatgctggaatgttatattatgctccacaagcttggacgagtgatgatagcgatgcaattgagcgtttaaaaattcagtatggaacgagttttggatatccgcaaagtatgatgggagcacatgtttcagcttcacctaatgaacaactcggacgaaatacaccattgaagataaggggagatgttgccttctttggagcttttggatatgaacttgatttagataaattaagttcaacagagttagcaagtattaagaaacaaatcgaacttatgaaaaaatatcgtagtatattccaatatggcactttttatcgcttaaagagtccttttgaaggaaatattgtatcttggatggttgtatctgaagataaatcacaagcaatagtgggatactataagattttaaatgatgtaaattgtgaatacagacgattatacttgccaggattagaagcagatactctatataatgtccaagaagaattaggttcatacttaggtaattttactggtgacgagttagctaatataggtttggttacaacagatgcctctgctggtcaaaatcaagaaacaactgatttttatagtaaactatttattttagaaaggtgtggggaattaagtgactag

SEQ ID NO: 759 - DNA, 207 bp, Streptococcus salivarius
  isolated from dental, Streptococcus salivarius
caggttaatcaagaaatccggcgtcgtgaccgtgtgatccggatatttccgaatgatctaagtgtcttgcgactaatgggggcactactgattgaacagaatgaaaaatgggctgctggtccacgatacttaaacatgaccgtttaccacgggattgaaaaagatgccgactcagaagaagccggtaagcttaagcttgtgaaatga

SEQ ID NO: 760 - DNA, 1824 bp, Unknownn
  isolated from dental, unidentified
atggaggttctatttatgactgaaaagaaaattgctgcaagtgttgctatgttaaaagttttagaagcatggggagttaaggatgtttatggttatccaggtggttcttttaactcaacaatgaaagcgctagatattgaaaaagaaaatataaattatgttcaagttagacatgaacaagtaggtgctttagctgcagctgctcacgcaaaattaacaggacaaataggtgtaacttttggttctgctggacctggtgcagttaatttattaaatggactttatgatgctaaggaagatcatgcacctgttttagcattagtagaacaagttcctcatactaatatgaactatgattatttccaagaatttcctgaagttccaatgttccaagatgtagcagtatatgatcgtattgtaatgacaccggaaagtttaccttatgttgttgataaagcaattcgtgaagcatataagaataaaggtgtagcggtagttgtaattcctaacgattttggatatgtagaaattccagatgtagactatgcatctactacaattctagataaagctgaacctaagccagcaccaacagatgaagaagttgacaagttcttagaattagttaagaatgctaaacgtcctattttccatgtgggttcaggtattaaagaaaatgctgataagttaatagagttatctagaaaattacaaattccggtaacaattacaggtttagcaaaaggttctgttcctgatgactacgaaggtaatttaggtacattaaaccgtgctgcttctaaagctgcagatgaagcattcgcaacagcagatttggtaattgctttaggtgcagatttcccatttgctaacttagtatatcgtacacatgactttaagtttgtacaaattgataatgatagatcacattttggtagacatcatttcttagatctaggaatttggtcagattcaggggaattcttagcaaaagctttagaaagaagtgaaactgctccagaaagtgcattctttaaagcaagtgttgcagctatgaaagactggaaagcatatcttaacaaattaatgcataaagaagaaggtccactttcatttgaacaagtgtaccgtgaaattaatcgtattgctgaagaaaatgctgttttcggtattgatacaggtgataatattatcaatagtttccgtctcttagactttaaaggcgataaaaagtggacaatttctgcattatttgcaactatgggatacggagtacctgcagctattgctggtcaattagcttatccagatcgccaagtattcaatatttctggtgacggagctttctcaatggttatgcaagacttattgactgaagttaaatataatttgccagtaatcaacatcgtaacttctaaccaaacactaaactttattaaatcagaacaagatgatatttttgaaatgaatcattctggtattgatttagtagatgctgactatgctaaaattgcagaaggaatgggtgtaaagggaattacagtgaagactcttgaagaacttcctgcagcatttgacgaagcattagctactacaaaggctggtcgtccagtattaattgatgctaagattactgataagcgtggaattccagtagaagaactagaattgcatgttgaagatggtaaatttgttgaaacaatttctgctggttatcaagcaacacatgctgaaaagacagtagaagatttcttcgcaagttatgacggtgctgaattaaaacctttaactgcatattttgaagaatatggcgtagaagcttaa

SEQ ID NO: 761 - DNA, 1410 bp, Unknownn
  isolated from dental, unidentified
atggcaatagattggaaagcagaagttgaaaaaagacgagatgatattctcgaagatttaaaaacaatgcttcgaattgaaagtgtacgagatgaaagtatagcaacagctgatgcaccattaggtccaggccctaaagaagctttagatgcctttttgaatattggtaaacgtgatggatttgaagttgaagaatttgatggtatggctggacacattaaatttggagatggtaaagaagatttaggtattctagcacacgttgacgtaatgccagcaggtaaaggttgggatacagatccatttaacccagttattaaagatggaaaattatatgctcgtggtgcctctgatgataaaggaccaagtatggcagcatattatggattaaagattgttaaagaattaggattaccagttaaaaagagtgtacgttttattttaggtactgatgaagaaagtagttggagaggaatgactcactactttgaaaaaatgcctaagccaacaattggtttttcaccagatgcatttttcccaatcatcaatggtgaaaaaggtaatttcagtatgcttgtaaaattcgatggtaaaaatggtgataaattaaaattattatcctttgattctggtttacgtgacaacatggttccacgcgatgcagtagccgttgttgaaggtaatgatcttgaaagcatggctgctgatttcaagcaatatgttgctgaaaatagtgttttaagtggcgatgcagaaattaaagatggaaaattagaattatccttaattggtaaggctgctcatgcacaagaaccacgtaatggcgaaaatgcaggaacttacttagctgtattcttgaataagtacaattttgctaaggatgccaagggatacttagcttttgctgctgaatacttacatcaagattcacgtatggataattttggaattagctatactgatgaagtgatgggtgatttaactatgaatgctggtatctttacatttgaagctggcaaaggtggagaaattactttgaacttcagatatcctagaggtattgatgatgaatatgtattcaatgctgttaaggaagctgcaactaaattagaagctgtttcatttgaaaagaaggaacatgcaatggtaccacattatgtttcacctgaagatccattggtttcaaaattattggctgtttatagtcgtcaaacaggtcaagaagctcatggcatggttgtcggtgggggaacttacggtagattgttagaacgtggtgtagcatttggcgctatgttcccaggtgttgaagacacaatgcaccaagcaaatgaatttattccagtagatgatgtaatgaaagctgctgcaatctatgcagaatccatctatgaattaattaaagactaa

SEQ ID NO: 762 - DNA, 951 bp, Unknownn
  isolated from dental, unidentified
gtggagtcattacttcccggaaatgatagagttgaaattttattaatagatgatggttcgacagataggacagcagagattatagataaatatgaacgtacatatcctaagcaaataaaggctgttcatcaagaaaatgggggacatgggcaggctgtaaacactggaatgtatctagcaaagggaaagtatgtaaaagtcgttgacagtgatgattggctagatttaaattcatatcagaaagttctgaattttctagagagtttagaagaatcaaacaaagaaattgatatgttaatttgtaattatatttacgataaagtggagttaggacataaaaaggtaattaagtatcggtggttaccaaaaaataaaagtttcacgtggaacaaagtacatttactgtatggagaatattttttgatgcatgctgttatatatagaactagtctagtaaccaaagaagctaaattaagattaccaaagcataaattctatgtagataacctttatgtatttgaaccattgccttatgttaaaaaaatgtactatttagatgttgatttgtatcattattttattggaagagaagatcaatctgttaatgaaaaagtgatgctcaaacgaatagaccaacaattgtatgttaataaaagaatgataaagttctatgctgagaatatagatgctaattctgacgtaggaaagtacatgaagagatatttagaaattattacgactatttcgtcgatacttttgatccgtgggaatacaaaagaatacttggatttaaaagatgatttatggaattatttaaaagaatatggcgatgtatacaggattttgcgaagaagactatttgggataggtgttaatcttccaggaaaatttggtaggaaattagctacagatgtttataaagtagctcaaaggctatatggctttaattga

SEQ ID NO: 763 - DNA, 978 bp, Unknownn
  isolated from dental, unidentified
atgcataaatataattggggtattatcggaactggttggatcgcacatgaaatggctgacgctttgaatgatgttaatggtgaaatttacgctgtatctaatcctaatgaagaatctctatataaatttgctaaagaaaagaacgttaagcatacttttataaatcctgatgaaatgatcacagatccagatgtagatattatttatatcgctactccacatatatctcattatgactatataaagaaagcattgaatgcaggaaaacatgtttttgctgaaaaagctattactactagcgctaaacaattagatgaggttattgccttagctaagtctaaaaacttgattttaactgaaggattcactctttatcacatgcctatctatgaaaaagtaagagacctaatctctagcggtaaattaggcgatatcaaactcgttcaagtaaacttcggtagtcttaaagactatgatccaaataatcgtttcttcgcaaaagaattagctggtggtgctttacttgatattgggggatatgctactgcctttgctcgtatgttcttaaatgaacagcctgaagtaactctaacaacggttaaattctttgaaactggagtagatgaacaatctggtatcattttaaagaattctcaagaacaattagctgtcatggctctttcaatgcgcgctaagcagcctaaacgtggtgttatatctggtacaaaaggatatatagaaataaataattatccacgcgcaacagaagctaaagtaacatacactctagatgctcatactgaaagtcacgaaacaataactgcaggcgattctgctaaagctttaaattacgaagttatggatatgcaacgttatatatcacaaggtcatgatggcggtcagctatcactttcacaagatgtagctcatattttaaatcgtgttcgtgacaattggggtatgaattatactaaataa

SEQ ID NO: 764 - DNA, 960 bp, Unknownn
  isolated from dental, unidentified
atggaggaatttatcatggaaacaaaaaaattggcagtatcattgcctggactagaattaaaaaatcctatcatgcctgctagtggaacttttggcttcggcgatgttccaagcgctaataaatattctttggatacattaggagcattggttataaaaactactactccagaagctagaaccgggaatcctgatcctaaaatttcagtaattgaagatggagtcttaaatgcagttggtcttactaatcctggtgtagatgtagtagtgtctgaaaagttaccaactttaagagaaaaatatcctgaactaccaataattggaagtgttggtggagcaacagaggatgattatgttgaagtagctactaagttgtcacaatcaggaatggttaatgcattagaactgaatatatcttgtcctaatgttcatgagggtggtatggcatttggaactgttccagaagttgctgaaagattaacaaagaaagttaaggaagtttcaacagttcctgtttatgtaaaactctcacctaatgtaacagatatagtggctattgccaaagctgtagaacgtggtggagcagatggaataagcatgattaatacagttttaggaatgcatatagatgtagcttcaggtaaaccagtacttggtaacattatgggtggtttatctggaaaagctgtaaaagcaattgcgattagaatgatctatcaagtcgctcaaaacactgatttgccaattattggaatgggcggagtagaaacagtagatgatgtcttagagatgtatatggctggtgcttcagctgttgctgttggaactgcacatttccatgattctatgatttgtccacatttaattgaagaacttccaaaaagaatggaagaattgggaattgaaagccttgaggaattacgtttaaatgtgaaaaaacgtggagcgttcaagctttaa

SEQ ID NO: 765 - DNA, 963 bp, Unknownn; identical to SEQ ID NO: 31
  isolated from dental, unidentified

SEQ ID NO: 766 - DNA, 1020 bp, Unknownn
  isolated from dental, unidentified
atggcaaaagaaattattttaacaggtgatagacctactggaaaattacatgtgggacattatattggttcattgaaaaaacgtgtttctatgcaaaattcaggaaagtatgattcatacattatgattgctgatcaacaagctttgactgacaatgcacgtgatcctgaaaaaataaaaaattcattaatacaagtagcattagactatttggcagtaggactagatcctaaaaaatcaacaatctttgtgcaatcacaaattccagcattagcagaattgaatttgtattacttaaacttagtaactgtttcacgtcttgaacgtaatccaactgtaaaagctgaaattcaacaaaaacattttgaacgctcaattccagctggatttttcacttaccctgttagccaagctgctgatattacagcttttaaggctaatttagttccagttggtgatgatcaagaacctatgttggaacaaactcgtgaaattgtaagaaccttcaattcaatttatggcgaagtattagttgaacctcaaggtgtatttgcacctaagggatctggacgtttaccaggtttagatggaaatgcaaagatgagtaaatctttaaataatgctatttacttatctgatgatgctgatacattacgtaaaaaagtaatgtcaatgtacacagatcctaaccatattcacgtagaagatccaggaaaagtagaaggtaatatggtcttcacatatcttgatatttttgataaagacaaagacaaggttgcagaattaaaagaacaatatcgtgctggtggattaggtgacgttaagattaagcgttacttgaatgaagtcttagaagctgaattaggacctatccgtgctagacgtgaagaatttgcaaaagatattccagctgtatatgcaatgcttaaggaaggtagcgaaaaagcaaacgaagtcgctaataaaactttagaagaagtacgtagagcaatcggggtaaattacttcgacaatatttaa

SEQ ID NO: 767 - DNA, 1092 bp, Unknownn
  isolated from dental, unidentified
atgagtcaaaaattaaaagtagcagttattggtgctactggtatggttggacaaagatttattgcgattttggataaccatccctggtttgaagttacagaattagcagctagccctcgtagtgctggtaaaacttacgaagaagctcttaacggtcgctggcgtatggaaacacctattcctgaacgtgttaaggatatggttgttttagatgctaatgatgtagaaaaagttacttctaatgtagactttgtattttcagctgtcagcatgtctaaagatgaaattaaagcacttgaagaaagatatgctaaaactgaaacacctgttgtttctaataatagtgctcaccgttggactccagatgttcctatgattatccctgaaattaatcctgaacatactgaagttatcaaataccaacgtgaacgtttaggtacaaaacgtggctttatcgcagttaaaccaaattgctctatccaaagctacacaccagcattatctgcttggaagaaatttgaaccttatgaagtagttgctactacatatcaagctatctccggtgccggaaagactttcaaagaatggccagaaatggaaggtaacatcattccatttattagtggagaagaagaaaaatcagaaaaagaacctcttcgtatttggggtcatgtagatgctgaaagtaagtctattgtcccagctgatgatacagttatcactactcaatgtgtacgtgtaccagtgctttacggacacactgcagctgcttttgttaaattcagaaaacctgctactaaggaagaattaattaaagcacttgaagattatcgtggtgttccacaagaattagaacttcctagtgctcctaaacaattcattcgctacatgactgaagatgatcgtcctcaagttgcattagatgttaactacgaaaacggtatgggcgtttctatcggtcgtttacgtgaagataaagtatatgactggaaattcattggcctatcacacaacactgctcgtggtgctgctggtggtgctgttgaatgtgctgaattactaaaagctcaaggttatatcactaaaaaataa

SEQ ID NO: 768 - DNA, 939 bp, Unknownn
  isolated from dental, unidentified
gtgagctatgtggaagatatgggaaaggaacttagtaaaagactagtagaaaataagtgggaaaaaaagtataaagaaataattgaaaaaagtttaaaagatgatgatgtgcaattgtttttacgtgaaaacaaagatagactaagccatcaagaaatattaaagggtgcaagtaagttatatgaatttgttgacttgaagcaaaaaatagcagaaggaaaagaagtttttgccccagggtattcgccacaattaactattagtgatcatcacattgaagtaacctatgtacctactaaaaaattgatagaagagagacgactaagagaaataaataatagaattaatattgtcaatcttcctaaaagtattcgtaaagcaacactagaaaattattatagagatgatgatggaagaatgatagctttaaaaaaagctatagaatttgttgcgaactatactgaaatgcctaatatctttcataaaggactatatttatctggatcgtttggagtaggaaaaacatatttactgggagcgattgctaataaattagcagaaaaggggataaaagtaactttagttcacatgccatcttttgctgtagaaataaaaaattctattggtaaaaataccactatggaaaaagttgatgctttgaaaaaatctcctgtattaatgatggatgatataggtgctgatcaattaagtagttggtttagagatgatgttctaggtgtgattttacaatatcgtatgcaagaagaattaccaactttctttagttcaaatattgctttagatgacttagaagaattttacttaacgcagaatacgagaggcgagttagaacccttgaaagctaaaagaatcatggaaagaattagatttttagttgatgaagtagttattaatggtgaaaatagaagaaataaataa

SEQ ID NO: 769 - DNA, 1383 bp, Unknownn
  isolated from dental, unidentified
atggagaaattagtagaaagaaaattaactaaaaaagattattttgtcgttagttcgttgctatttgcattatttttcggagctgggaacttaattttcccactacatttaggacaattggcaggtcataattggcttcctgctacactaggatttttagtaacaggtgttttgttaccattgctatcagttctagctatcgcaatcacacgttctaaaggtgtttatgatgtaggtttaccattaggttcaacttttgctttagtatttatggtattaattcatgctacaatcggaccattatttggtactccaagaacagctaccgtttcatttacggttggtttggcaccattagttccacaacaatatcaacatgtagcattatttggtttctctgcattattctttttagcagcatttttattatcatataaagaaaataacatcgcatctaatttaggtaaggttttaaatccagtatttttggcattattattcttagtattcttggtatcatttttaaaaccaatgggtagtgtttctcaagcagcacctactgcacaatatttacatggtgcattcactaatggatttttagaaggttataacacaatggatgctttggcaggtttagcttttggtgttactgttgttacagctgttcgtgcaatgggtaaaaaacgtgaaaagagtgttgctgccgttactgctaaagctggtttcttctcaatgagtgcagttgcagtaatctacttacttctaattgttgtaggcgcaatgtcattaggtagatttaaattatccgctgatggtggtgtagcattttctcaaatcgttaatgcttatgcaggttcatttggtcaagctgtattggctacattaatcacagttacatgtttaacaacagcggtaggtttggttgcagcttttgctcaagatttccatgcacattttccaaaggttagttatcacacatggttggcattatcatgcttagcatcattcttaacagctaattttggattggaacaaatcatcgcttggtcaactccaatgttaatgttcttatatccactatcaatggtattgatcttattatctgtattttcacctttattcaagcgtgatggtgcagtatacttcatggtagttctatttactgtagttccagcattctttgatatggtagttgcattcccagcagttgttagtcaaagcgcatttggtaaagcagttgcagcatttagattgcattacttaccattagctagcatcggattatcatgggtagttccagcattagttggattagtattaggattaggggtttacttctataagaaggctagagtatctgtaggagtaactgaaaaagaatag

SEQ ID NO: 770 - DNA, 768 bp, Unknownn
  isolated from dental, unidentified
atgaaattaatgtcagacttgttaaaaggaaagaaaatccttgttatgggagtagctaataagcgttcaattgcatggggatgttcccagatgatgatggaaaatggggctgaattaatattcacatatcaaaatgacagaataaaaaaaagtttgagtcgtttagtttctgaagaagaaaaactagtagaatgtgatgtttcagatgacgcaagtattgaaaatgcctttaaactagtgaatgaacgttttggaaaagtagatggaattttacacgcaattgcttttgccaacaaggaagaattgggtggagaaattatgcaagctagtcgcgaaggatatgcattagctcaagatatttcagcatattccttgattgcagttgcaaaatacggccgtgaaattttaaatgatccatctagtattgtaacattaacttattttggttcagaaagagctatccctaactataatgtcatgggagtagctaaagcatctctagaagctagtgttcgttatttagctcgtgacatggctaagtatggtactagagttaatgctatttctgcaggagcaataaagacattggctgttactggaattaaaggtcattcagagttattaaaaatgtctgaagaaagaacagttgatggggaatcagtaacaattagagaagtaggcggaacgtgtgcattcttgatgagtgacttgtcaacaggtgtcgtaggagatgttatttacgtggataaaggagtccatttaatatag

SEQ ID NO: 771 - DNA, 897 bp, Unknownn
  isolated from dental, unidentified
atggaactcacttggattgaagaattcaagaaatatttgttaattgaaaaacaatattcagacgaaactttgaaagcttatagtgaagatttacaacattttgttgattttattgacgaaactggaggcgctaaatctttcaaggaaattggtagtaatgatgttcatgcatatatgagctatctatatgatagatatgaaatgacatcaatttcgagaatgatttccagcttacgtgcattctacaattttttaatcaagaatgaattaacagatgaaaatcccttcgcttatgtacaattaaagcgacatccacgatcactaccacgttttttctatgaaaaggaaatgaccgcattatttgaagcaactgaaggcgacacacagatgttgatcagagatagagcgttgttggagtctttgtatggaactggaatgcgtgtcagtgaatgtacaggtttaaaaatggaaaatgtagatttgactaataaaaagatgcttctacatgggaaaggtgataaagacagattagtaccatttggaagctactgtcaggaagcattacaacgttattttgaacaaactcgtacacctttaatggaaaaatatcatcgggatcatgatttagtctttgtaaatcattatggaaatcctttaactccagctggggtagcatatatcttaaaacagatagttaagcgtagcagtctacacaccagcattcatcctcatgagttgcgacacacatttgcgacacatttgatgagtaatggtgcggatttacgtgcagtacaagagttactagggcatagtagtttatctactactcaaatctatactcatgtaacaccggagcatttacaaagagattatcgaaaatttttcccaagagcatag

SEQ ID NO: 772 - DNA, 816 bp, Unknownn
  isolated from dental, unidentified
atgccgcaaattgaaattagtgggttgcgttacacttatccagaacactcatttcaggtggaaattgatcggcaatcttttgacagtccactaaccgcaattgttggtcagaacggcgctggtaaatcaactttgttaaagttactgatcggattgataacaccgcaagaagggaccattatgattaatggcgtttcaatagatgagttgaaatcacaggcaaagttgaaacaaattggcgtgacatttcaagatccagatgatcaattatttaacgcaacggttcaaaaagaagtggcttgggggctttctcaaattgaatcggatcaattgatgattaaaaaagcggctgatcaagctttggttgcggttggattagctgataaagcagccgaaaatccatatgacctttcgttatctgaacgaaagttattaacgtttgcaacggttttggccattaatcctgcaatttatttgtttgacgagccgatgatgtcgttagactggcccagtcgaaagcgaatgactaacatttttcatcaacttgtaaaaagtggtcatcaggtgatcacgattactcatgatatggattgggtagcggctgaattttcgacagttcacgtgatggcgcatggtcagattgccttttccgggacaccttcagccttatttggtaattcaggactggttaagcgggtgggattgctgccaccaagaattatgacgataacgagtgcattaggtgatcactcggtttatttaacctcagaggattactgcaggaagcataaacaagttgccaacaatttaaattga

SEQ ID NO: 773 - DNA, 1188 bp, Neisseria gonorrhoeae; identical to SEQ ID NO: 2
  isolated from dental, Neisseria gonorrhoeae

SEQ ID NO: 774 - DNA, 1149 bp, Unknownn
  isolated from dental, unidentified
atgatttattttgataatagtgcaacaacacaagtactaccagaagtattaagtacttataatgctgttagtgaaaagatttggggtaacccatcttcacttcatgcgatgggagaacaagcttttaatttgttagaacaatcaagaaaacaaattgctgacttactccattgcaatattgatgaaatttattttacaagtggtggaacagaaggagataactgggtcgtaaagggaactgcgattgaaaaaagaccatatggacgacatattataactagcagtgttgaacatccagctgttttaaattcactacatcaattagaaaaattaggttatgacgtaacatatcttccggttgacgaaaatggaagagtttctgcagaagatttgaaaatagctatcagaaaggatacaattcttgtttcaattatggctgttaataatgaagtaggagctatccaaccgttgaaagaaattgcagcagtactggaagattttcctaaaatacatttccatgttgatgcagttcaaggtgtgggtaaaggtattcaagaattattagaacaagatagagtggacttcttaacattctctggacataaattccatgcacctcgtggcattggattcatgtataaaaaacgcggtcgtatgattgcaccattaatgtctggtggcggtcaagaaaaagctttacgaagtggtacagagaatcttcctgcaattgcaagtatggctaaagcattaagattgactttggaaaatgaagaaaagaaagtagcacaacaaaaagctattaaagaaaaaatctataatcatatttctaaaagatctaaagtaacagtattttctaaattaaacgatgaatttgctccacatattttatgttttgcaatcagtggagttcgtggagaaactattgttcatgcttttgaaaattatgatatttatatttcaacaactagtgcttgctcctctaaaaagggaataacatctgggacattgactgcaatgaagattccagataatattgctacatccgctgtacgtgtaagtctagatgaaaaaaatactttagcagaagctgataaatttattgaaatttttgatgttctatatgaaaaattcaaaaaaattaattcttaa

SEQ ID NO: 775 - DNA, 2853 bp, Unknownn
  isolated from dental, unidentified
atggataacgaaacattgaaggaagcgatgcttaacggcttgtatgctgatgattattccggacatgaattattaactcctaaaatgttagttaatgctaatgatcaacatatctggacaagtctgaaacaagaattaaaaacatgcaaaagctttatctggtcggtggcctttataactttggatatgttaactcctttgaaagttgttttggtagatttggataaaaaagggataaggggcaagatcgttacaagtacgtatcttaattttaaccaacccaaagtatttactgaattactaaagttaaaaaatgtggatgtctatcttgccgaagaatctggctttcatgcgaaaggatacatgtttgaacattcagattattatacgatgattgttggcagtgctaattttactagagctgcgatgttaagtaattatgaatgggcgataaaactaacttcaacggaaaatggtagtctatatcagcaaactcattcagagttagagcgaattatagaaaattcccaagtactgacacaagcttggatagataattataaagaagtttggcaaaatttacgagtaacagaaaagtctactaataacaaagctaaaagtgagatagttcctaataagatgcagatggctgctttaaaagagctagaaaaaatagttgaagaaaagaaacataaagctttagttgtgtctgctactgggactggtaagacttatttaggagcattcgcggttaaggaataccaacctaaacgatttttatttgtagttcatagggaacagattgctaaaaaagcgatggaaagttttaagaaggtaatcggtggaagtgatagattgtatggaatgttgagtggtgataggcaagatattcaagcaaagtatattttttctaccattcaaacagtgagccaagacaaaatattagcccaattatcaagtaattatttcgattatattttgattgatgaggcacatcgttcagcagcgccatcttatcaaaaaatcatgcaccattttaaaccagatttttggttgggaatgacggcaacacctgaaagaatggataatcaagatgtatatgccttatttgattataatttggcttacgaaattagattgcgtgatgctttagaaaacaaaatgcttagtccatttcactatattggggttcaagattatgaaaaagatggcattactgtagatgaaacaactaatctacgctatttaacagctcctaagcgtgtgaaatatattttggatcaattagattattatggttactctgggccaaaagttcatggcttggttttctgtagtcgccaagatgaggcattagaattggccaagtcatttacagatgcaggacatcaagctaaagctctaactaatcaagatagtaatgaacgtagaagagcagtagttagagaattagaagaagggaaaatagaatatattattaccgttaatttgtttaacgaaggtatcgatattccttgtgtcaatcaagtggtgatgttacggaatacacagtcaagtattgtatttattcaacaattaggacgtggattaagaaaatatccaggaaaagattttgtaacagtattagattttattggtaattataaaaataattatttgattccaattgttttaactcaagataatagtcgcagtattgacgaagctaaagcagagttaagagttccaccagtaattgatgtttcaacgattaattttacagagattgctcaagaaaagattttgcaatcattggataaagtgaagttagattcaatgaaggaattgagaacagcttatcaagatttgaaaagtaaacttggcaaagcgcctttgctacaagacttttatagatttggatcagtttctccaattgtttttgctaataacggaaatcttgataactatgatattttcttgcaaaaaatgggagaagattctgagttaactttgtatcaagaacaagttttaacttttataaccaaagaattattgaatggaatgagacctcacgaactcatattattagatctattgactaaaaataaagtatgcagtttatttgattatgagcaagaattacaagaaaaacaaatttacttcaatatggaattaatgaattctgttgaaaatattttgaacttatctttctttgatgtgaaggctggaaagacaactaaagctgaacagtatggtggaattccaatcatagaaaagatcaatttgttagattatcaacttaataatcaaattaaaacaagtttgaataatcctaaattctatcagttatggaaagatgttattcaaacaggattattattgaatgaggaatatcaaaataaaaagcagtttacattctatcaaaaatacactcgtaaagatgtgtgtcgcttattaaattgggaaaaagacgtcagtgcaccaatgtatggatatcgtgtaggtgaaaaagaatgtccaatttttataacctataagaaagattctgaagataagagaaatgctaaatatcgtaatgatttacaaaatggtaaaagtttgagatggtataccagatctcctcgacatatagattcagatgaggttcaacgacttttagcaaaagataaaatgggaaattataaaataaaactacatctttttgtaaagcgtagcgatgccgatggaaaaggtttctattatttgggagaaggtaagattgtatcagatagtgttcgtgaagaaatcgtttggaaaaagacagcagtaggaatgaacatagagttgcaacacccattagaaactaaaatgtatgatttgttatttactgaataa

SEQ ID NO: 776 - DNA, 606 bp, Unknownn
  isolated from dental, unidentified
atgaaaattttaggattaactggcggaatagcttcagggaagacgactgttagcacatatttaaaagagatgggatatccaattattgacgctgataaagtttctcgtaaagttgtggagccacatacagaaggcttaaaagaaattagtcatttttttggaaatgatattttacaatctgatggaagtttaaatagaaaaaaattaggtgaaatagtttttgaaaacaaggacaaaagggaattacttaataaaatattgagtaaaaaaatacgcacagaaataattaatcaaattgaatattataaaaagcaaggtgcagatgtattaatcttggatattcctttgttatttgaaggtggatatgataagatgtgtgattttacaatggtcatatacattcctaaagaattacaaatagaaagattgatacaaagagatggactaactagggataaagcgttaaaaagaatatctgctcaattagatagtgcagaaagaaattccaaagctgatattatcattgataattcaagaagtattgaagatactcataatcaagtgatagaatggctagagagaaataatttaatgttagagaaatga

SEQ ID NO: 777 - DNA, 723 bp, Unknownn
  isolated from dental, unidentified
ttgataactttagctggaattattggttctggaaagtctagtttaacaaaattattatctcaagaattaaatactacacctttctttgaaccagttactgataatcctgttttaccactattttataaaggaaatgaattggcagcaaaaaaaagagctgctggcgctaccgatgtaaccaatccttatacttaccttttacaaactttcttcttaaatcgtcgtttcaaaatgataaaagaagctatgcgtggggataacaatatattagatagatctatttatgaagatgctatgttcatgagaatgaatacagaattaggtaatgcaacccaaatagagtatcaaatttatcaagaattattaaaaaatatgctagatgaaattaaattagcaacccctaaaaatcataaagacttgatgattctaattaaagtttcttatcctacaatgatcaagcgtattgaaaaacgaggacgtgaatatgaacaggttacaaatgatccttctttagtagattactataaacgattattagaattctacgacgaatgggaacgtacttatgataaatccccattactagtaatagacggcgataaatacgattttgtagaaaataaatcagatcgtcaatttgttctcaatactattgctgatactcttttagacatgggaaaaatatctagagatgaacatttaaaactatatactgaaaattaa

SEQ ID NO: 778 - DNA, 321 bp, Unknownn
  isolated from dental, unidentified
ttgatagataaaccccaatatattattgttgctggtattaacggagcaggtaagagtacgttgtacgatacatttcccagcttgtttgataaaacaaaacggattaatgctgatgagattttacgacaaatgggtggcgattggcataaagacagcgacaatttaaaagccatgcgtgaagaaataaagcaactacactattccttagataaccgacaaagtattcatgtagaaacgacacttgctggaagaggtaaggctcaactaaatttgattgataaagcgcatgaaaatggctttgaagtgactttattgtatgtt

SEQ ID NO: 779 - DNA, 510 bp, Unknownn
  isolated from dental, unidentified
atgagaaaaaaattatttcttataccactttttatatctttatttttattaggagcttgtagcaacaattctacttctcaaaactcggagtctagcagtaactctagttctgtcaaaacttctaaattagtaaaaagttctagtcaaaaaaaatctagttcaattaagtccagtagtagcagttcacaatcttctagctctagcagcgaagtagcaagtgattcttcaaacgcaatcccctcaagttctgtttctgcttcaagtcaatcacaagatgttactacagataacaattctgtcttaacttcatttttaaacgcttcaggtgttcaacttggaaatggtgatattgcttttataactggggaaaataatggtatgtatgaaattgaaattcgtactcaatctcctggtagtactgcggttactaatctaaagggaatttatcattataatcctactactggttctattcaaaaaatggatcctacaacaggcgtctttaactaa

SEQ ID NO: 780 - DNA, 726 bp, Unknownn
  isolated from dental, unidentified
ttggatatattacaacaattatatggcccattttttgatgctaataactggcgaacagtagtcacttctggtgaagattggatgatcatcctatcactagtattgattgaatgtttattgtctgttgataatgcgattgttttggctgcacagacacaggtattaccagataaaaaacaacaagaaaaatctcttttttatggactttggggagcttatatattccgcttcatcttgattggtttgggagcctatctaattcatttctgggaaataaaagtggcaggggcagcatatttaatgtatcttgctgttagtcatttttatcgtaagaagaatcctaaaccaaagaaggacgggaagaaagctaaaaagcgtatattaccattattctggtcggtagttgtatccattgaaatgatggatattgtattctcggttgactcagttttagcttcattagcgatttcacctaatcctgtgattgttttgatcggtggattaataggtattctagcaatgcgaggaattgctgaaattatcatgaggttaatggaaattgtaccagaattagaaacgacagcatatggtttgattgcattaattgcaattaagctattcctaacaattcctatgattgatattgaaatccctaatctattatttggggtaattgtattaggttcgattgtcgcaacctttattgttcatagaattaagaattaa

SEQ ID NO: 781 - DNA, 2076 bp, Unknownn
  isolated from dental, unidentified
atgaagaaattaattttagcagaaaagccaagtgtcgctcgtgacattggaagaattttaaatgctaatgaaaagaagaaaaactatcttgaaggtaaaaattatgttataacttgggctttaggacatttactaggtttaaaaatgccagaagatttaaacaagaagtgggagaagtggcaattagaaacattaccaatgctacctaaattcattggaacaaagccattgccaaagaccagaagccaattaaagacaatagaaagtttagtcaaaagaaaagacataaatgaaattgtaatagctactgatgctggtcgtgaaggagaattggtagcgcgttggatattacaatatgtacatgcaaataaaaaagttacgcgtctttggatttcttcacagacagataaagctgttaagcagggatttaaagaattaaaaccagcagaaaaatatgataacttatatgaatcagcattagctcgtgccacagcagactggttagtcggtttaaatgttacacgtgcattaactgttaaatatcaagacaatttatcagctggacgtgttcaaactcctacattagctttagtgagaagacaagaagaaaaaattgaaaaattcatgcctcaaaagtattatcggatagcattacgccttggtaatcaaactgcatacatgaaacaaaaaaacatttatgcgattaaagaacgtgatgaagctgaaaagaaaaagcgtcatctggataattttaagggtcaaataaggaatattaattcaaaggtaaaaagagaagcagcacctttactgtacgatttgacggaattacaaagagaagcaaataagagatacggttattcagctaagaagacattgagcttggttcaaagtttatacgaaattcataaagtggtatcttatccaagaactgatagtagatacttgtctaatgatattaagtctactttaatggaaaggttacaagcgattagaaaatatgatagtagggctgaagaatctataaaaaacaaagctaaggttatcttgaaaaaagttttcaatgatagtaaagttacagatcaccatgctctaattccaactgaacaagtaccaaactacagtaaattttctgctgatgaacagaaaatatataacttaattgtttcgcgtttcttagggatttttgcacaaccttatacagttgaagaattaagagtagttgtaacttttgataaagatgaatttattttcgtaggaaagaaagttctagattatggttggaagaataaagatgcatctgaagaagttgctttaaatctgaaaaaagatactgtagtaagtccaaactttacagttgaagaaaaattaacaacaccaccatcaccgttaaccgaagctggattattagcgcaaatggaaaaatttggtttgggtactccagcaactagagctgaaattattgagaaattagtaaaatcggagctgatggaaagaactggtcatgcactaagagtaacacctaaaggaaaacaattgttaaatcttgtaaataaagaacttgttagtcctaaattgactgctaaatgggaaaaacaattggaagatattgctcatggaaaaatgaaatcacaaaaatttattggagatataaaaaatgatactaaacgtttagtaagtgaagtaaagaatagtaaagaaaattataaagacttttcattgactaagaaacgttgtccagaatgtaatagtttcctaaaagttcgaaaaacaagagatggagaaatatatgtatgttctaatccagaatgcaattatcgtcgtcgaaaagatgctaaagtttccaaccatcgctgtccacaatgtcaccgtaaaatgttaattgttgaaggaaaaaacggtaaatatttcagatgtaagtatgacggtactactgaaaagatgacagttggtaagaaaaataaaaagatgactaagcatgaggaaagaagattgctaaagaaaattaaccaagatgatgagccacaagagagtcctttagcattagctttaaaaacagcaatgggtaaaaacgaataa

SEQ ID NO: 782 - DNA, 3639 bp, Unknownn
  isolated from dental, unidentified
atgcagatcggtcttgcttcttccgataagatccgtagctggtcttatggtgaagtaaagaaacctgaaactattaactaccgtacattgaaaccagaaaaagatggcttgtttgatgaacgtatttttggacctactaaggactgggaatgtgcctgtggtaagtacaaacgtatccgttataaaggtgttgtttgtgatcgctgtggggttgaagttactcgttcaaaagtacgtcgtgaacgtatgggtcatatcgaattagcagctcctgttacacatatttggtactttaaaggtattccaagtcgtatgggtcttgtcttagatatgagtccacgtgcattggaagaaattatctactttgcatcttatgtagttacagatgcaggtgatacagcacttgaaaagaaacaactcttaactgaaggcgaatatcgtgaaaaacgtgaagaatatggtgatggctttaaggcagcaatgggtgctgaagctattagaactttactaagggatgtagatcttgaaaaagaatgtgctgaactaaaagaagaattacgcgaagctacaggtcaaaaacgtactcgtgcagttcgtcgcttagatattttagaagcatttttgaactctggaaatcgtcctgattggatggttatggatgcaattccagttattccacctgatcttcgtccaatggttcaattagaaggtggacgctttgcaacttctgacttgaatgatttatatcgtcgagttatcaaccgtaacaatcgtttgaagcgtttattagatttgaatgctcctggaattattgttcaaaacgaaaagcgtatgttgcaagaagctgttgatgctttaattgataacggtcgtcgtggtcgcccagttactggtcctggtaaccgtccacttaagtcattgtcacacatgttgaaaggtaagcaaggtcgtttccgtcaaaacttacttggtaagcgtgttgactattctggtcgttcagttattgatgtaggtcctaagttgaagttaaaccaaatgggtattcctcatgaaatggctttggaattgttcaaaccattcatgatgagagaattggttaagcgtgaaatggcatctaacattaagaatgctaagcgtaagattgaacgccgcgatgaagatatttgggatgtcttagatgatgttatcaaggaacacccagttctactaaaccgtgcccctacgcttcaccgtttaggtatccaagctttcgaaccagtattggttaacggtaaagctatgcgtctccatccattggcttgtgaagcttacaacgccgactttgacggggaccaaatggctattcacgttcctttatcagatgaagctcaagctgaagctcgtttattgatgttagcagctcatcatatcttagctccaaaagatggtaaaccaatcatttcaccatctcaagatatgacaatcggtaattactacatcacacttgaagaagctggtcgtgaaggcgaaggtatggtatttaaggatgttaacgaagtaagaacagcttaccaaaacgggtatgtacatttgcatacaagaattggtttgcaagcttcttcattagctaagttaggtacaccatttactgattggcaaaaagaacgtattttaataactacagctggtaaagcaatctttaatgaaattctacctgctgatttcccattcttaaacgagcctacacaagaaaacttaacaggaatgactcctgataagtactttgtagaaccaggaacagatattaaggaattcattaagaatcaacctttagtaggaccatttaaatctggattcttatcagatattatcgctcaagtttataaagagtataaagtaactgcaactgcagaattacttgaccgcatgaaagatttaggttattacgaatctactaaatcaggtttaactgttggtatcgctgacgttactgttttgaaagaaaagccagaaattattgaacaagcacacaaaaatgttgcaactgttgctaagcaattccgtcgtggtttgattacagatgaagaacgctacaatcgtgttatctctatctggaacaaagcaaaagatgatattcaagctaaattggttgaaaacatggatccatctaacccaattcaaatgatgagtgattcaggtgctcgtggtaatatttctaactttacacagttatctggtatgcgtggtttgatggctgctcctaacggtaagacaatggaattacctgttatttcaaacttccgtgaaggactttctgttttggaaatgttcttgtcctctcacggtgctcgtaaaggtatgacggatacagctttgaagactgctaactctggttacttgactcgtcgtttagtagacgttgctcaagatgttatcattcgtgaagaagactgtcatacagatagaggtttggatgttactgctattactgaaggtaatgaaatgattgaaccattatatgatcgtattttgggtcgttatactatgaaagaagttaaagatcctaatactggtgaaattattgttccagctaatgtattagtagaagaatccgaagctcgtaagattgttgatgccggtgtacaaaaagttactattcgttctgcattcacatgtaacacacgtcacggtgtttgtgaacgttgttatggacgtaacttagctactggtgatgaagttgaagttggtgaagcagtaggtaccgttgctgctcaatcaattggtgaaccaggtacacagttaacaatgagaaacttccaccaaggtggggttgctggtggcgacgatattactcaaggtcttcctcgtgttcaagaattatttgaagcacgtaatcctaaaggtcgtgcagtaattacagaagttactggtgttgttgatacagttgaagaaaatcctgctgaacgtacaaaagaagttactgttaaaggtgaaacagatactagaacatatagcttgccatttacttccgttcttaaagttaaggaaggcgatcaagttcatcgtggtgatgcattgactgtaggttctattgatcctaaggaacttatcaaggttcgtgatgttttatctacagaaaattacattttacgtgaagttcaaaaagtataccgtatgcaaggtgtagatatttcagataagcatattgaaatcatggctcgtcaaatgttacgtaaagtacgtattatggatccaggtgatacagatatgcttccaggaactctattggatattagccaattcaaagatcgcaatacaagtgcaatcattgaaggtagaattcctgctactgcacgtccagttcttcttggtattactaaagctgctcttgaaacaaacagtttcttatctgctgcttcattccaagaaacaacacgtgtattgacagatgctgcaattcgcggtaagaacgatccacttgttggtttgaaagaaaatgttattattggtaagacaattcctgcaggtacaggtatgaagaagtatcatgatatcgaaccagaagttgttaatagcaatgtaacagatggtgtttattcaatctctgaattagaagaaaagattaatgaacaacaaaataatgttgaatcttcaaactag

SEQ ID NO: 783 - DNA, 1149 bp, Unknownn
  isolated from dental, unidentified
atgagagcagtacattttggagcaggtaatattggtcgtggatttattggtgaaactttagccgcaaatggttttggaattgattttgtagatgtaaatgacactatcattagtgctttgaatcaacgtggagaatatgatatcgaattggctgcacctggtcaaaagaagattcatgtagaaaatgttgatggaatcaataatggtgaacatccagaaaaggttgttgaagctattaagactactgatttagtaacaacagcaattggtcctaagattttgaagttcatcgcaccattgattgctgatggtatcaaggctcgtaaagatgctgataacaagcaaacattagatgtaattgcatgtgaaaacatgattggtggttcgcaacatcttaaagaagaagtttacagccacttagatgacgatgtaaaagcttttgctgatgaatatattggtttccctaatgcagcagtagaccgtatcgttcctttacaaaagcatgatgatccattgttggtatcagtagaagagttcaaggaatgggttgttgatgaaagtcaaatgaagaatcctagtttgaagctagaaacagtccactatgctcctgatcttgaaccatatattgaacgtaaattattctcagttaatacaggtcatgccacagtagcatacactggtaaagctttaggatatgaaacaattggtgaagctattaaggatgaaaaagttcttacacaattgaagaatactttgaaagaaattcgctcactattattagctaagtgggatttccaagaaaaagaattagaagaatatcatgataagattattggtcgttttgaaaatccatacatctctgatgatattgctcgtgtaggccgtactcctatccgtaagttaggttacgatgaacgtttcattcgtccaattcgtgaattaaaggctcgtggcttaagttacacaacattaatggaaactgttggtaagatttatcactttgatgaaccaaaagacgatgaaagtcaaaaacttcaaaagatgctaaaagatgaagatttgaaggatgtaattgttgaaacaacaggccttaaagatgatgctgacttagttgccgaaattgctgcaagtgtaaaagctgctgattaa

SEQ ID NO: 784 - DNA, 1830 bp, Unknownn
  isolated from dental, unidentified
atggatttagaacaaatgaaagttcgtcagaagcatattcggaatttttccattgtggcacatattgatcacggaaaatcaactctagctgatcgaattttagaaatgactgatacagtaaccaaaagagagatgcaagatcaacttttagattcaatggaattagagagagaacgaggcattacaattaaattaaatgctgttgaattgcactatcatgcaaaagacggtgagacatatatttttcacttgattgatacaccgggacacgttgatttttcatatgaagtttctagatctttagcagcttgcgaaggagctgtattagttgttgacgctgcacaaggggtagaagcgcagactttagcaaatgtatatctagctttagatgatgatttagaaattgtaccggttattaataagatagatttaccttcagcagatccagaacgtgttcgtcaagaaattgaggatgtgataggactagatgcttctgaagctgttttggctagtgctaaaaagggaattggaattgaagaaatgttagaacaaatagtgcagaatgttcctgctcctgacggggatttagaggcaccgttgaaagctttaatttttgattctgtttatgatgattatcgaggtgtagttctaagtattagagttgttgaagggactgtaaagcctggtgataaaattcgtttgatgaatagtggcgccgaatatgaagtagttgaagttggtgtgaattcacctaaaccattaaagagagattttttaatggctggagacgtgggatatcttactgcaagtataaaagatattcaggatacacgagtaggtgatactgtaacaaatgctaataatccgacagcaaagccactcgaaggatatcgtgaaatgaatcctatggtatattcaggattgtatccaacagataacgctaaatataatgatttacgagaagcgttagaaaaattgcaattaaatgatgctgctttagagtttgaaccagaaacttcacaagctttaggatttggtttcagatgtggttttttaggtttgttgcatatggatgttgttcaagaaagattagaacgagaatttaatatggacctaataacaacggctccttctgtaacatatgatgttgaattaacagatggtacacatattaatgtatctaatccatctgaaatgccagaaacaccactaatcaagcaaattaatgaaccatacgttaaggcagagataatggtaccaaatgactatgttggcgctgtaatggagttatgccaacgaaaacgtggtacttttgtaactatggattatctagacgattatcgtgttaatgttatttatgaaataccattatctgaaataatttttgacttctttgacaagttgaaatctagcacacgtggttatgcgtcattagattacgagttagatggaactagaccaagtgatttggtgaaaatagacatacttcttaatggtgataaggtagatgctctaagttttatttctcatagacaatttgctcaagcgagaggtagagtaatagttgataagcttaagactatcataccacgtcaaaactttgaaattcctattcaagctgctattggagctaaaataatagctagaactaatataaaagcttatcgtaaagatgtaacagcaagaattcatactggtgatccagatagacgtgctaaattactagataaacaaaaacgtggtaaaaagagaatgaaagcagtaggtacagtagatgtacctcaagctgcttttatggctgtattgaagacagatgaagaaataaaataa

SEQ ID NO: 785 - DNA, 756 bp, Shuttleworthia satelles
  isolated from dental, Shuttleworthia satelles
atgaattatgataaatattgggaggaattttacatgtctgacatcaagtataaacgtgtattactaaagttgagtggtgaagcacttgctggtgatcaaggaaaaggaattaatccgcccgaaattttgaaagttgcagaagaaataaaagaagttcatgatttaggtgtacaaattgctatcgtcgtaggtggcggaaatatgtggcgtggtgaagctggtgctgaaataggaatggagagagcacaagctgattacataggcatgttgggaactgttatgaacgctttagcacttcaagatagtctagagtcagttggagttcctacaagagttcaaacagctattgaaatgagacaagtagcagaaccatatattcgtagaaaagcaattcgtcatctagaaaaaggaagaattgttatttttgcagcaggtacaggctcaccatatttctcaacagatactacagctacattaagagcatccgagcttaatgcagaagtaatcttaatggctaaaaatggagtagatggaatctacaatgcggatcctaaagttgatcctacagctaaaaagtatactaagttaacacatatggatattattaataagggattacgtgttatggatactacagcttcatcattatcaatggataacaatattgctttagtggtcttcaacatgaataaccgaggaaacattaagaaggttgttgaaggcgaagaaattggtacaacagtggaaggaaaataa

SEQ ID NO: 786 - DNA, 756 bp, Unknownn
  isolated from dental, unidentified
atggaaaaaataataacaactaaagatgtacatttatattatggaagtaaggaagctcttaagggaataactttggactttccagataagggaatacatgcattaattgggccatctggttgtgggaaatcaacgtacttaagaactttgaatagaatgaatgatatgatagaaaatgtaaaaatagaaggcgaatttaaatttaaaaatcaaaatatatatgatgaaaaaatagatttagttgaattaagaaagaaaataggaatggttttccaacagcctaacccttttccattttctatttatgataatgttacttatggattaaggatggctggaataaaagataagagaattttggatgaaaaagtagaaacaagtttgaaacaagctgcaatttgggaagaagtaaaggataatttaaataaaaatgccttggctttatctgggggacaacagcaaagaatctgtattgccagggtacttgctgtagctccagaggttattttattagatgagccaacgagtgcacttgatccaatttcaacagaaaaaatagaagaaatgttactaacacttagagataattatacctgcattatggtaacacataatatgcaacaagcttcaagaatatcagatacaacgtctttctttttgagtggtaatttagttgagagcaataaaactaaaaagatatttttaaatccagacaaagaacaaacagctgactatttaagtggaaaatttggataa

SEQ ID NO: 787 - DNA, 969 bp, Shuttleworthia satelles
  isolated from dental, Shuttleworthia satelles
gtgtcaaaaacacaaaatcatcaaaaagttattttagtcggtgacggtgctgttggatctagctatgcttatgctatggctttacaaggtactgccgaagaatttggtatcgtagacgttgttaaagaacgtacagaaggtgacgctcttgacttattcgatgctacaggtttcacattccctaagaagatctatgcagcagaatactctgactgcaaggatgcagatctagttgttattactgctggtgctcctcaaaaacctggtgaaactcgtttagatcttgtaaacaagaacttgaagattttatcttctatcgtaaaaccagttgttgaatctggtttcgacggtatcttcttggttgcagctaaccctgtagatatcttgacatatgctacatggaaattctctggattccctaaagaaaaagttatcggttccggtacttttttagatacagcacgtttacgtgttgctatgactgaaatgacaggcatcaaggatcctcgttctatgcatgcttacatcatgggtgaacatggtgactctgaatttgctgcatactctgctgctacaatcggtggtcgtccattcttagattgggcaaaagaacatggtgtctccaaagaagatttagataagatggaagatgacgttcgtaacaaagcttacgaaatcatcaacaagaaaggtgctacattctacggtgttgctgctgctcttgcacgtatttctaaagctattttacgtgacgaaaatgctgtattaccagtttctgcatacatggaaggtcaatatggtttaaacgatatctttatcggtactccagccgttgttaacggtactggtttacatgaagttatcgaagtacctttaaacgaagaagaaagcaagaagatgacagaatctgctgctactttgaagaaggttcttacagatggcttaaaggctcttgaagaaaacaagtaa

SEQ ID NO: 788 - DNA, 1458 bp, Oribacterium sinus
  isolated from dental, Oribacterium sinus
atgctaaaaaaagcatttatttttattgtcagttgcttatgtactttattaatttttactaacttgaataataatcatgttaaagcagacactaaaacctacaatatcgggacagatgttacttatcccccttttgaattcgctaataagaataatcaatatgttggaatagatatcgatttaatgaaagctatcgctaaagaagaaggatttaaagttaatattcaaccaattggatttaactctgccgtacaatctttacaatctggacaaattgatggggttattgctgggatggctattactgatgaacgtaaacaaaaattcgatttctcaaagccatactataaaacaggtttcatcatggcagttgctaaaaatagtaacattaccagcctcaaacaactacgtggtaagcgtgttgctctaaaaaccggtactgccgctgctaactatgctctctcactaaaagacaaatatggtttcaaaactgtaacttttgatgattctgataacatgtacaatgatgttgttaacggaaactctgttgcttgttttgaagatatgccggtaatgcaatatgcaattcaaacaggtactaagttgaaaattgttactaaacctgctcaaagtggttactacggtttcgctattatgaaaggtaagaaccaagaacttctacataaatttgatgatggtttagctaagttaaagaaaaatggtggttatgataagattgtaaatcgctacatcaaccaaaacacaattgctgaacaaaagaaagctaacgaaaatagcaacaatgaacatacctttattggtttgttaaaacaaaactctggcgttttccttaacggtctttggaaaacaatctacctaactattttaggtatcatcggcgcaactatctttgggattatcattggtttcttaggagtaattcctaacaaattcgctcaaggtgtttcaactactgttatttatatcttccgtggtcttccattgttagtacttgccctattcatctataacggtattcctagcttaactggtactaagattccagctttcatcgccggtatcatcacccttactttaaacgaaggtgcttatactgctgcttttgttaaaggtggaattgaagctgttgataaaggacaaatggaagctgctcgtagtttgggattgtcatttggtaaagcaatgagaaaagttattttaccacaaggaattaagattatggttccttcattcgtaaaccaatttattattactttgaaagatacttctattctttctattattggtattctcgaacttacacaaacaggtaaaattatcatcgctcgtaaccttgaaggcttcaaagtttgggcaattatcggattaatgtacttaatcgtaattacagttctaacttggatttctaactatttacaaaagaaaatgaatagctaa

SEQ ID NO: 789 - DNA, 768 bp, Unknownn
  isolated from dental, unidentified
atgaaaaaaagatatgttctaatggggttattatcattgctatttctaggagcatgttccaataataaacaggaaacagcttcatctagcagtagtcatgtgagctcaagtctagcatcaactgatactattaatcaaaccctagacactgtaggatcacttaaatatcatttaggtactgttactactagaaaagttgaaaatgaccgtaataactacacagaggccgaaagaaagttcaaatataagtcatctcttggggatacttactatcgtactacaatcacttatagtgttactaatgttggcgaagaaactattaatttagctaaaacaccattatcagttacaactgacgatggtagcaaatttacttcaacgggaaaacttaatcactatgcacataatgttcttgtgaatggatataagttaaaggttggcaaaaaattacaaggaaaattagtactattatcatcacacaagttagacattagttctattcaattaaatattggaactcaggtaccttataacagtacagatgatactgccgaagtaactagcgaaaataccacaaatagtgctaccacttcttcagctgtatcttcaactacctcttcttctgatagtatttctccggatttacaacaacaattaatccaaaatgaacagggcgagaataaggtcaacggttctaatagtggatcttccaatagttcagcatcatcttcatctgctcaaaccggtactagtggaactgctcaataa

SEQ ID NO: 790 - DNA, 2475 bp, Unknownn
  isolated from dental, unidentified
atgagtgaggaattagatctttttgaccaagaagataatggtaagtatcttataggaacagtaaatgctgtctatttcgaggcttccgatagtttttataaagttttacaagtcttgattaaagaaactaatttcgactgggatgatcagagaataactgttactggaagttttgccaatatccaaacagattctttatatcgatttgagggaaatgttgtagaacatcaacgttatgggaaacagttccaagctgaaagttatcaactagaattaccttctacaaaagatggtgtaattgcatatctttcgagtgatgaatttgttggtataggtaagaagactgctgaaaaaatagtaaaaaaattaggtgtagatgctattgacgttttaaacaatgatatggataaattggaagaacttggattatctgaaaagcaaaaggacagtataaaaaaagttttaaaggaaaattatggaattgataaaatcataattgaacttaatagtctaggttttactagtacgatggctggaaggatttataataattatacaaatagtaccttggaaataatccatgaagatccatacaggttatccgtagatattgacggaattagctttactaaagcagatcaaatagcacagcaatttggttttgctagtgattcccctggtagaattcgaggagctatttttcaatcattatatgatttgacttatgctacaggaaatacttatgttgagttaaaacctttagtaactgaaacattaaaacttcttgaaagtaatcgcaatgaagcaatcgacccacaattagttgcagatcagttaattaagcttgctgaagaagataaaattaagtctgatgataataaagtgtacagtagaacctttttcaatgccgagtggaatatagcagagaatttatatcgactattgaaatcgggtaacagtgatttaccaaataatgatgcattattagataaactcttaataaaagctgaggatcaattggaaatagattatgatagtgaacaaaaaagggcgataaaagatgcaattaaatcgccagtttttctgttaacaggtggtccaggtactggtaagacaacaattattaatgggattgttgcagtatatgccttattaaacgacatagatttagatattggtaagtatgataaagataatccatttccaatattgttagctgcaccaacgggacgagctgctaaaagaatggcagaatcgacgggattaccagcttctacaattcatagaatgttaggaataaatgcacatgatgataagttacctgaagatattcaagaacttgaaggtgcattgttaattgtcgatgaaacatctatggtagatacacttatcatggatttattgttaaatagtattcctagtcatatgcaagttatttttgtgggagatagaaatcagctcccatcagtacaaccagggcaagtattttctgatttattagttagtgataccttacctaaaaaagaattaacgaaaatctatagacaaggtaaaggttcctcgataattaatttggcacattcaataaagaatggagagctaccagcagactttactaaagcacaatctgacagagcatttattccatgtgaagctgggcaattaacttctgctgttgagcaagtgataaaagctgctttgaataagggaaatagtaaagatgatattcaagtattagctccaatgtatcgtggtaatgcaggaattaataggttaaatactattttacaagaattattgaatccagctaaacctcgacaaaaagaagttactttcaatgagcaaatatttagaattggggatagagttcttcatttagtgaatgatcctgaaaataatgtctttaatggtgatattgggaagattgtgggaataaatatacctagaactaaaaaagataaaaagggtgaacagataatagcagatttcgatggaaatgaggtaacttttgataaaaaggattggattaatttgacgttggcttattgtatgtccatccataaatcccaaggtagtgagtttccaattgtagtgttggcaatgttaccacaatatcaaagaatgtttgctagaaatttgttatatacaggaataactagagctaagcaaaaattagttcttttagggaatgtttcttcatttagacaaagtgcagagattatctctctcaatagaaaaactggattattgaaacgtataagaatggaattcggagtagaagaaaaaccagtagaaaaaactgataatgaagaagttgctgttaataataacaaagaacaagatctcattgttgaagaacaggatgaaccgttcatttataatgatggtatattgaccatggatattattgttaataacaaagttgatgcaatgataggtatggatgatataacaccttatgattttatggaataa

SEQ ID NO: 791 - DNA, 4026 bp, Unknownn
  isolated from dental, unidentified
atggaggatatggaaagatatcacattggcctagatatagggacttcgtctataggatgggcagtaataggcgatgatttcaaaattaagagaaagaaaggaaagaatttaataggggttcgtttatttaaagaaggagataccgccgcagaacgtcgaagctttagaactcaaagaagacgacttaacagaagaaaatggcgattgaaattattagaagaaatttttgatccgtacatggcagaagtagacgaatatttttttgccagattaaaagaatcaaatctttccccaaaagacagcaataagaaatatttaggttcattattattcccagatatatctgactcaaacttctatgataagtatccaacaatttatcatttgcgaagagatttaatggaaaaagataagaagtttgatttaagagaaatctatttagcaattcaccatattgtcaagtatcgtggcaatttcttagaaaaagttcctgcaaaaaactataaaaatagtggagcatcaattggatttcttttagaagaagttaacagtttatataaggatattattggtgatgaaagtgttgctattcttaacagcggaaagtttgaagatgtagaaaaaataatcttagatgaagaaactagaaatcttgataaacaaaagagtgtagggaaactattagtagaagataagaagaaaaagaatatagttactgcattttctaaggctattttgggatataaatttaatattgaagatttattgttgatagaaagtgatgaaaagaataaattaacatttaatgatgaaaatattgatgacatttttaatgaattatcacattccctagatgataaccaaatggatttactaactaagactagagagatctactttaagtttaaactaaatatgattgttccgactggatatacattatccgaatctatgatagaaaagtacgagatgcacaaagctcacttaaaaatgtacaaggaatttatcaatactctaaatgcaaaagatagaaagatcttaaagaatgcttacagtgactatattaataatgaaaaagctaaagctgctaacgcacaggaaaatttctataaaactataaagaagactattaaagacaataattcagatacggctaaaaaaattataggcttaattgatgagggtaattttatgcctaagcaaagaactggtgaaaatggtgtgattcctcatcaattacatcaaatagagttagatagaattattgaaaatcaggctaagtattatccttggttagcagaagaaaatcctgtagaaaagaataggaaatttgctaaatataaattagatgaactagttacttttagggtgccatactatgttggaccactggtagacaagacagaatctaataaaaacgaaaaagaaacaaaatttgcatggatggttcgaaaagcaaaaggaacaataactccatggaatttcgaaaatttagttgatagaacagaatcagctaatcgttttattaaacgcatgacttccaaagatacatatataattggtgaagatgtattgcctgcttctagtttgctatacgagaaatttaaagtacttaatgaattgaacaatatcaaagtaaataaaaagaagttagatgttgaacagaaacagcatgtatatttagatttgttcacaactagaaagaatgtaacaaaagataatctagcaacttccctaaattgtgatgtagaaagtattactggattatcagataatgagaagtttaattcttcattgtcaagttatattgatttaaaagcaatattaggaaatgcagtagatgattgcaataaaaacaaagatttagaaaaaattattgaatattcaactatttttgaagatggtaatatttacaaagaaaaattaagtgaaatatcatggttgactgatgagcagattgaaaaattatcaaatattcattttaaaggatggggaagattatcaaagaaattactaacacagattactaatgagaatggtgaaagaattattgatgcattatggaatacatctaataattttatacaaattataagtgatgaaagtattcaagcaaaattagctgaaattaatggtgagtatgcggataaatctaacttagaagatatattagatgaggcatatacatctccacaaaacaaaaaagccattagacaagtaatgaaagttgtcgaagatattgaaaaagcaatgaagtgtaagccaacatctatagctattgaatttactagaagaaaagggaagagtaaattaacgaatactcgttataagaaaatatctgaaacttatgagaaaattacagatgaactaatctctgaatatgaattaggaaaattacaatcaaaattagatagtaaagccaataatatgagagatatatattatctatactttatgcaattaggtagggatatgtatactggtgagaaaataaatattgatgaattacatcaatactatgatattgatcatatttttccacgatcctttataaaagataattcacttaataacagggtattaactcgtaaggaaataaataataatgaaaaggcagataggacagccgcagatttatatgcagtaaagatgggtgatttttggcgtaaactacgtaaacaaggtttaataactgaaaaaaaatacaaaaacttattaactagaacagacagtatagataaatatactaagcaaagtttcattaagcgtcaattagtagaaacaagtcaagtagtaaaaatggctgctaatatattgcaagataaatatagtaatacaaagattattgaagtaagggcaagattgaatagtgatttaagaaaagaatatgagttgataaaaaatcgagaagttaacgattatcatcatgctatagatgggtatttaacaatctttattggacaatatctgtataaaacatatcctaaattacgcagttattttgtatatgatgattttaagaagttagatagtaattacttgaaacatatggataagtttaactttatatggaaattagaagataaaaaagcagaagatgtctacgataatgtaaataatgaatttattttaaatgttccaaagatgaaagactatatacagaaaatttataattacaaatatatgttgatttcaaaagaagtaactactgaaagtggtgcgttctacaaggaaactaagtataaggctggcgggatgaatttaattcctataaagcagaataaaccaattaatatttacggtggttataaggaaaaacgtaatagttatatgatgttagttaaaattaaaaagaagaaagagactatttataaaatcgtaggtataccaagattattatccgatgaattagatagattaaatactatgagtgagaaacaattgttactagaaacaattgcaagaactagtttatctaaaacagaacaaaattttaagattatattagataaaatttattatggtcagctagtcatagatgaaaatcaaaaatatactttgggaagtgtcatatataagcataatgcaatgcaactgcatttatccaaacaagctctggagattttggctgtagggaaaaccaaaagtagggaagtaaaggatgaagagttaatagcagtatatgaagaaatattattagttgtgaataaatattttgagttatatgatatctctaaatttagacaaaaattaaatgatggattagaaatatttaaagaacttcctatctacaatatatatgaaaataataagataaagaaaatcggaaaatttgaagtattgaataggatcttaatcggattacatgctaatgctgcgagagcagacttaagcgttttaggatttaaagatctgggtaagttacaagtgaatggtggtataaagttatcgccagatgctaaattaatatatcaatcaccaacaggaattttttcaagagctgttagagtgaaagatttaggatag

SEQ ID NO: 792 - DNA, 921 bp, Unknownn
  isolated from dental, unidentified
atgaaagaattagtttttggacacaagaatccagatacagatgctattgtagcagctaaagcatactcatatttacaaaataaattaggtgctgatactgaagcagttgctttaggcacacctaacgaagaaacaaaatttgtgttagattacttcaaggaagaatatccacgtgtaattacaactgcaaaaaatgaagtagaagctgtaatgttagttgatcataatgaagcccaacaaagtgttgatgacattaaggaattaactgtaacacatgttgtagatcatcaccgtattgcaaactttgaaacagctgcaccattgtactaccatgcagaaccattgggatgctcaagtactgtaatttacaaagaattcaaagcaaataatgtagaagttcctgctaaattagctggtttaatgttatcagctatcatttctgatacattattattaaaatcaccaacaacaactgatgaagatgttgctgctgtgaaagaattagctgaaattgcaggtgtaaactatgaagaatatggtttggaaatgttaaaagctggaacaaacctttcaagtaaaacagaagaagaattaatttctgcagatgctaagtcatttgaaatgggtggtaagacagtacgtgtagaccaagttaacacagttgacttagatgaagtatttgctagagaaactgctttgcgtgcagcaattgaaaagcaaaatgcagaagaaggctacgacttattcttattaatggtaacaaatattttagattcaaatacacgtttattagtagtaggtgaacctaaagatgtagttgaaaaagcattcgataagaagttggaagacgacaagatggacttaccaggcgtagtttcacgtaagaaacaagttgttcctccattggaagctgcattttaa

SEQ ID NO: 793 - DNA, 930 bp, Unknownn; identical to SEQ ID NO: 234
  isolated from dental, unidentified

SEQ ID NO: 794 - DNA, 690 bp, Unknownn
  isolated from dental, unidentified
atgaaaaagatattaattattctaactaacaccagatactatggtaatagtaaagataagacaggtttgtggttagctgaagctgctgaatttgtctataaagtgcaagaacatggctatcaagttgattatgccagtgttaatggtggagaagttcctctagatcctcgtagtttaaaaagtacttatcgttctaaagaggttgatgaaatttattattctaatgattttcaaaatcgcgctttaaaacacagtttaaaagtttctgatcttgatcctcaagactattttgcaatttactatactggaggtcatggagtactatgggattttcctaatcaaccagcccttagctctataactaatagcatctttaagcaaggtggcttcattatgtcaatctgccacggattagctggactcgttacaattaaagatgatcaaggtaattatttgatcaataacaagaagatcactggctttactaactttgaagaaattctcagtggcaaattacttaaagtaccatttttaactgaaaaccaagctaagaaagccggagctaaatttgttcaaaaaagaccttttgctagttttgcagttcaagatggacaatttattacgggtcaaaaccctatgtctggcttcgctgttgcagaccttttagtaaaaaattcccctaaatattaa

SEQ ID NO: 795 - DNA, 645 bp, Unknownn
  isolated from dental, unidentified
atgactaatttcaaaaacaatgatttcgaaagtgtaatgttaggtcgtcattcagtacgtaaattcgatacttctgtaaaaattcctcgtgaagaattgaaagaaatggttgccaatgctattactgctccttctgcatgtaacttacaagcatggcatttcatcgtagttgatactccagaaggaaaagataaattacgttcattcttcatgaagtttaatttaccacagttagaaacatcttctgctattgtaatgcttttcggtgatactctagcttttaagaaatatcgtgctttatgggaaaacatttacgaacaaaaacaaattagtaaggaagaattagatcgtatccttaataccttcttaccattgtatgaaaatgccgataaacaattattaactgctgatgctatggttgatagttctttagctgctatgcaattcatgctagctgctcgtgctcatggctacgacactaatccaattgctggatatgatgctaaaaaagcagctactgctttagggctagatccagaacgttatgtcccagttatggcaattgctgttggtaaagctgacagtcaatctactgacattaagtctacccgctacagtgttgatgatgttattgaatttcaataa

SEQ ID NO: 796 - DNA, 3294 bp, Unknownn
  isolated from dental, unidentified
atgtatgctcccttacaagttttaagttcatatagtttgttgcaaagtccattgagaattccagagtatgtaaaattaggaaaagaattgggatacaatgctctagtattgacagatataaattcaatgtatggcgttttggacttctatcatgaatgtgttaaagcaggaattaagccaattattggtattacattacaatctggtgatgatgagtatatttttatcgctaagaacagtaatggttatcaaaatttgatgaatatttcttcaaagagactaactgcagtggatgagaattataaaaatatttttaaattagcagatattacagagtatttacaagatgtaattgttatattgaagccatcgtatctaacggtaaatgacataataagtgatcaggtgacggaattacaaacattagtgtcagctgccgagacaacttattatggtgttaaccctaatgatagagatgctataaataatgatttaatggctgctgaaaagttacaattagagacaattttattaacaccagttaaatacttaaaagaacgtgattactttagtactaaggtattacaagccataggaactggtgaaaatgttaatccgaattggaattttaaaaatgatggaaattatctacatacacctgaggaatatgagcgcttaggtacagattatttaagtagtgcatatcaaaatgcaattaatgtgattgctcaatgtaacttaacattaaactttcctaaaacacagttaccccattttaaagaaactaatggcttaagttcagaaggtttcttaagaaaattgtgtcaagaaggattggctaaaagaatagcggaagaaaatataaagaaccaagaagaatatcaaaatagattagattatgaattatcagtcattcatcgcatgggatttgatgattacttcttaattgtttgggacgtgacaaattttgcccatgaaaataatattttaaccggtccaggtagaggatcagcagctggttctttagtttcatataccttatatattactgatattgatcctattaagtatgacttgatttttgaacgttttttgaatgaagaacgtgctcaaatgccagatattgacttggatattcctgacataaaaagagatactatcattgaatacttacatcagaaatatgggcagcaacatatggcacagattataacatttggaacattaaaaacaaaacaggtattgcgcgatgttgctagggtatttgatttaaaaacttatgaagcagatgcgtggagtaaggcgatacctaaagaatatggaattactttaaaagaagcgtatgctagtagccaatctttgaagaacttagttgcagataactctaagaatcgactattattcgaaactgccattgcacttgaaggactaccacgacattattctacacatgcagctgggattatcttaagtgatgatgatttaatagatcacgtaccggttcagattggtggcgatggtattttaatgagtcaatttgctaaaaatcaagttgaagaagttggattgttaaaaatggattttctaggattgagaaatttatcaattttggaaaatacaattacgctaataaaaaagggttatcatgtcgattttgatataagaaaaattaatttggacgatcctgaaactttaaagatctatcaaaatgcagaaacaagtggtgtttttcaatttgaatcagctggtatcagaggagtattaacgaaattaaagcctacttcatttgaagatgtagcagcggtaaatgccttatatcgtccaggacctattcaaaatattgacgaatttattgcaagaaagcatggtgaaagaccaataacttatccttcaaaagaactggaaggtattttgaagcaaacttatggaattatggtttaccaagaacaagttatgcaagttgcctctactatgggaggatttactttaggacaagctgattcgcttagaagagcgatgagtaaaaagaaacatgatataatctcgcgaatggaagttatgtttattaatggcgcgatgaaaaaaggatacacacatgaggttgctaaaaaagtgtatgcttatatcatggaatttggagattatggttttaaccggtcacatgcagttgcttattcaaaaatgtcatttgaattagcatatataaaagcacattacccagcagctttctttgcagctttattaaattcagtaattggaaatcctcgtaaaactaaagattatgttttggaagctaagaataagggagtaagagtgcatcacccagacataaatattagccaatctctatatatcttacgtaatggagaaatctactttgggttaagttgtattaagtcattgagaaagaactttcttcaagacattttgcaagaaagaaaacgaaatggtattttcaaaaatatggaggatttcttgcaaagaatcgataaaagatacttaaaaagagaattaatagagattttaatttactcgggtgtttttgatacatttggtcaatctagaagagaattgtttgcaatgttaccacgcttactaagcaatattgaacttagtggaaataatgttgaactattttcaatgttagcacccaagaaaacgactgtagaaaagatagagatttcaaatgatgaactcttagaaaaagagaattattatctaggggcttatttatcaggccatccagtcgaaaaatatacagagttaatctatttaaccaattcaactagagtttctcaaataaatgagtctaataaagataagtatgtttcaatgattttgcagataaaagttataaaaatcattagaactaaaaatggttctcaaatggcgtttgtaactgcagcagatcaaactggaaacatggatttaacgtttttccctaatgcatataagagattttcatcagttttggaagatggaaatataatcttgattgaaggtagagttgatacaacaagaggattggccataacaattagtaaagcgatgttagcaaacgatgtaaaaataaaaacttattatctacgcttatcaaaagccttcgatacaagtaaaagaagaaatcttgaaaagttaatgctccaaaatagtggtaatgtacctgttattatagttgatgaaaaatcagggaaaaagaaacttcttaataaaaaattatggctatcacaggataaaatagtttacaatagacttgtagagttgttaggagttgaaaatgtagttttgaaataa

SEQ ID NO: 797 - DNA, 1023 bp, Unknownn
  isolated from dental, unidentified
gtgaaagtagatgagttgcgcaaagaaatagaaaataatagtctaaaaaatgtttatttagttttaggggaagatacatatcttaataataaagttaaagaattattttggaactatattcctgaaagtgatagggaatttaatgctgcaatttatgatatggaaactacttcgattgcaactgcaatagcagatgcaatttctgctcctttttttagtgaaaaaagattggtgattattactcatccgtattttttaacaggggatacaaagaaacattctatcgaacaagatgtaaatgaattgataggatatttgcaaaatccttctccagatactttgttagtagtattagcaagttatgagaagttagattcacgtaagaaagtagttaaagagttaaagtcaaaagctgaaatagtggatacttcctcgttgaatgaatctgagataagacaatatcttataaaatattgtgatgagaaaaaagttataattgaaaaaagagcaatagacagattaattcaattaaccaatgccaatttctctaaaataatgaatgaactttctaaactaataatagcaactgttgatactaaaaagattacagttagtgaggtagatagattagttacaaaatcgctggaacaaaatgtttttgacttggtagattttgttcgtgataaaaagataaaagaagcatttgaattatatcatgaacttttagaacaaaaagaagagccaataaaaataaatgcgatcttaattggacaatttagattacttttacaagttaaaatattacagaagcatagctatgatcaaggaagtattgcctcaactttaaaagttcatccctttagagtgaagttagctatgcagaatgctcgtaaatttagcaataatagtttgaaatctgcttacttaggtttggccgaaatagaagaaaagttaaaaacaagtagtcagaatccagaattgttgtttcaattatttttaacaaaatatgcgtataaaaaataa

SEQ ID NO: 798 - DNA, 1932 bp, Unknownn; identical to SEQ ID NO: 426
  isolated from dental, unidentified

SEQ ID NO: 799 - DNA, 786 bp, Unknownn
  isolated from dental, unidentified
ttgaaaggaagaaatatgacgcaaagatttaaagtaacgttagcttatgatggtactaattttgcaggttttcaagctcagccaaatcaaagaacagttcaatttgttctggaaaaagctattaacaaaatgagtaaaaaggatgagtatataactgtttacggatcagggagaacagattctggagtacatgctttaggacaagtggtacattttgattttccgcatcctatttctgctaaaggtatgttgagaggattaaatagtatgttgccgctggactgtgaagtagtagattgcaaaatagtaccaaatgattttcattcaagatatacaactcatgggaaaagatacttatatcgtgttagtagaggagaatttgtaaatccttttaagagattgtatacaggacactataagtatcctttagatatagaaaaaataaaagaagcgatgccagatgttgaaggaacacatgattattcaagttttgtcgcttctggtagtcaagcaaaaagtcatgtaagaacaatttatgaagctaaagtttacgaagataaggtaaacgatgaaatagtttttgaattttatggaaatggatttttatataatcaagttagaataatggtggcaacacttctagaaattggtaatggaaaaagaccagtacacgattttttgagattgtatgaagttaaggacagaagtcaagcaagacagacagcaccagctagtggcttatacttaaaggaagtatattatgatgaagaggatgaaaaattataa

SEQ ID NO: 800 - DNA, 1440 bp, Unknownn
  isolated from dental, unidentified
atgaatctacaactattaaccgacttatatgaattttccatggccaatgggtactacgctaccctaccccatgatcgacaagctcgcttcgacgtcttttaccgccgggttcccgacaacggtagttttgtcattgtcgctggtctccagcaggtggtagaacaagttcaaaattggcatttcactaaggagaatattgaatacctgacctccctgaatgaatttactcccgagtttttggattacctgagcaagattaaaaatcactgctcgattaaggctttaccagaaggaacccctgttttcccacgggaaccaattatttcaattagtggaccgttgattgaagcccagctgttagaaacctttattctaaacatcattaaccatcaatcattaattgcgacgaagtcttggcaaatcaaccatgccgctcaaggccgaccaattatggaatttggcgcgcggcgggcgcaaggccctgatgccgccacgtatggggcgcgagccgcggtgatcggcggttgtaccagcacgtcgaacttacaagcagccagtcaatttaatattcccgcggccggcacaatggcacatgcctgggtcgaaagcttctctgatgaattaagtgcctttcaagcttgggccaaggtttatcctgacaaagtttccttgctcgttgatacttatgatgtcttgaagtcaggagtgccgaacgcgattcgggtcttcaagcaagttagcgctcaagggcaccaaccagtcgggatccggatcgattccggtgacatttcgcaattagccatcaaagtccggaagatgctcgatgatgctggcttccccaaggcaaagattacagcttcaaatgcccttgatgcgcatgtagttaagtcgttgttggatgaaggagctccaattgataactttgggattggggaacgtttaattaccagttcctctagtccggtattaagtggcgtttataagctcgccgaagaaaagattaatgatcaatggatcccaaaaattaaggttagtgatagcagagaaaagatcactctgcctggtaataagcaagtttaccggatttaccggcaagataaccttcaccaagcgatcgccgatgtgattgccctggctgatgagcacatcacggctccattgaaagtggttaatgctaatttggcagctacgcacgccagccaagttctgactaactttaatgctaagccattgatgcaagaatatctgggttccaatgcttccccaatcgaaaatgatctctttaagattcagcaattctcaatggatcaagtggcagaattaccagaagccacaaaacggttagttaaccccgatcggtacccagtttacttaacagctacattggctgaattgcaagaacagttaattactaaagctcaatttacggaggaacattaa

SEQ ID NO: 801 - DNA, 336 bp, Unknownn
  isolated from dental, unidentified
atggaaacatggaataatcttcaggattgtgccaaagccgtcgatgtcttgtcgattggccaatatggctttaatctggtgaaaatcccatcatcatggctccatatggacgtcggcttatcatttctacatgatacatcgcccctagttaataaaatcggccggacaatcgatcaatttttgcttcttgctatatctagaatcattgatattgtatactacggttatagtatgatcaggtttactactggcaatatgactggtcttcttggtattataagattagttatgtttagtaatgattatcaaaagaaggagatgatttcttatgattga

SEQ ID NO: 802 - DNA, 1629 bp, Unknownn
  isolated from dental, unidentified
atgaaccgaatattattagcgacaattgtaacagcgatttttcatggaatcggtattaccgttttatgcacaaaaatgcctatttcctattatttaatgggaccgctatttcaatttatgtttaccgtgagtgtaaggtttgcatatcgttttattaatttagtgagaagacgaaaacaaagaaatgaaaatgctaaatataattctttaattattggagctggttcagcaggtcaaattattatcaaagaactggaaaattcatcagtagtacaatctgttcctaaatgtgtaattgatgatgatccaaacaaatggggaagaatgttggaaaatattccaattataggtggacgtgagaaaatcattgaagcagttcaaaaatttgatatcacacaaattatttttacaataccttctgcaagtgctaaagataaaagagagattttgaatatctgtaaggaaacagactgtaagttattgacattaccaggggtatatcaattattaaacgagaaagttttcttacaacatttaaagccagtagcggttgaagatttattaggaagagaaccaataaaggcagatttaggccaaatcaagcaacaaattcaaggtaaagttgtattgataactggtggtggaggctcaattggttcagagctttgtcgccagattgcgacctatgatcctgagcaattaattgtctttgatatttatgagaataatgcttatagtattgaacaagaattaaaaagaaactatcctaatttgaatttgaaagttttaattggatcagttcgagatcaaaaaagagtagatgatattttttcgagttatcgaccagatattgtttatcacgctgctgcccataagcatgtgccattaatggaaggcagtcctaatgaagcagttaaaaacaatgttgttggtacttataacacttctaaagcagccttaaagcacaatgctgaacgatttgtactaattagtacagataaggcagttaatccaacaaatgcaatgggagctagcaagcgtatttgtgagatgattattcaaatgatggataaagacagtcgtaatagcaagaagcgaacacagtttgtagcagttagatttggaaatgttctaggaagtaatggttctgtgattcctttattcaagaaacaaattgcagccggtggtccagttacagtaactcatcctgatattattcgatatttcatgacgatttcagaagcagttgggttggttttgcaagctggagcatatgcggctggtggagaaatatttgttttagatatgggacaaccaattaaaattgatactttagcacgaaacttaattaagttatcaggattgcatccagatgaagatatcaaaattaaatatattggtttgcgtccaggagaaaaactatatgaagaaaagttaatggccgaagaaggattacaaaagacagaaaatcaacttatctatattggaaaaccaattccatttgatgagaaaaaattcttaaaagatttacagagtctaattcaaaatagtcaagagaatcctaagaatattgaagctcagatgcaacaaattgtacctaactttaagttccaggaggtggtaggatga

SEQ ID NO: 803 - DNA, 678 bp, Unknownn
  isolated from dental, unidentified
atgaaagtaacacaaaatagaaatttagaaacgacttcaatgggattgttattagggtattttatcctgtcaatatttttgaatagtttaggcaatgctttgacggtatctttgaatttagaaagtgcattgtggactgcagcagcagttaatatagctaaaataacaccaatttctttgagtgcgatgctatttatttctggttttattgtaataattgtcaatctagtaattttgaaaaaggttaatgtaaaaagaatattgggtaatctaatttttatgactcctttttcaattttagtaggaatttttgcaacagaattagttaaactaggaattcatagtttaaatttacctgtgcgtatctttttggattgtttaggagtagtcctaattgccatcgctatatcactttatcaaagaataaattggatgttgcatccgattgatgatttgatgcaaattattcgttttaaatacttcaagggtagttctacaattgcccaattggtaacttttactccaccaattgtagcgattattatttcggtaattgtatcacatcatatatatgcaataaatgttggaacgatatttgccttattatgtcagggaccaatcgtagggatagctgacaagatagtttttccaagtctaaagcatcgcaatttagactag

SEQ ID NO: 804 - DNA, 711 bp, Unknownn
  isolated from dental, unidentified
atgaaaaagatacttgtagtagatgatgaaaaacccatctcagatatagtgaagtttaatttaaccaaagaaggttatgatgtttatacagcctatgatggtgaagaagctttacaacaagttaaagaagtagaaccagacttaattttacttgacttgatgttgccaaaaattgatggcttagaagtagctcgtgaagttcgtaagacacatgacatgccaatcattatggtaacagccaaggattctgaaattgataaggttctaggtttggaattaggtgcagatgactatgtaactaaacctttctctaaccgtgaattagtagctcgtgttaaagccaatttgcgccgtcaatcagcagtagccgcaaagtcttccgctgaagatgacaagaattctgaaattactgttggtgatttgacaattcatccagaagcatacactgtgtctaagaatggtcaaagaattgaattaactcatcgcgaatttgagttattacattacttagctcaacatctaggtcaagttatgacgcgtgaacatttgttacaaacagtttggggatatgactactttggtgatgtgcgtactgtggacgtaacagttcgtcgtttaagagaaaagattgaagataatcctagtcgtccaacttggttagtgacacgtcgtggtgtaggttattatttacgcaatcctgaagttgaatag

SEQ ID NO: 805 - DNA, 684 bp, Streptococcus anginosus
  isolated from dental, Streptococcus anginosus
atgaaccaagatgaattaaagcaattagtaggtacaaaggcagttgaatggattaaagatggcatgattgtcggtctaggaacaggttcaactgttaaatacatggttgatgcacttggaaaacgtgtaaacgaagaaggtctaaacattgttggtgttacaacttctattagaacagctgaacaagctaagtctttgggcattgttatcaaagatattgatgaagttgatcatattgatttaacaatcgatggtgctgacgaaatttcttctgacttccaaggaattaaaggtggcggtgcagctttactatatgaaaagattgttgcaactaaatctaataagaatatgtggattgtcgatgaaagtaaaatggtcgatgatctaggacaattcccattaccagttgaagttatcccttatggtagtggtactgtctttaaacgctttgaagaaaaaggattaaatccagaatttagaaaaaatgaagatggcagtttacttcatacagactctgataactatattatcgatcttcacttaggtaaaattgaaaatcctaaagaacttggagattacctaattaatcaagtaggagttgtcgaacacggattattcttagacatcgtaaatactgttattgttgggcgtcaagatggccctgaggttcttgaagccagataa

SEQ ID NO: 806 - DNA, 726 bp, Unknownn
  isolated from dental, unidentified
atgcgatgggctttgatattaggtgcttcaggggatataggatcaaaaatagctaatgatttagctgcccaaggttggtcattatatcttcattataataattcttatgagaaagttaaaagattatatgataagctagatagtgaatatagtgagcaagaatttttaatcattcaaagtgacatgtcgaaaatttctgaaatagataagttaactaattcagtttttagtttagatgctgttatttttgctgaaggaacaactaagtacggattgtttaaccagttaaaaatggaagaatttgatgaaatgttaacaatgcaacttagatatcctttattcctattgcaaaagctagaggaaaaattagcacattctagtttaggaagaatagtatttataggttctgtttatggtggatatggtagtgccatggaagttggatatagtacgattaaaggtgctttgagtgcattcgtaaaagcctatagtaaagaagtagcttcattaggaattacagtaaatgttgtagctccaggtgcggtcgatactagaatgaacaacatgttttcttctgatgtgaaagaacaagtagcagaggatattccgatgggaaaattggcacaacctaatcaaataagttattgggtaacttgtctactagcagatagagcagagtatctaacaggacagacaatatatgtgacgggtggttggttacaataa

SEQ ID NO: 807 - DNA, 726 bp, Unknownn
  isolated from dental, unidentified
atgaaaataaataaccagagaatacaattacaaaatataaagaagaaattcggaaatgataatgtcttaaattctgttaatttaacagtaaattcaggagaaatagtaggtttgattggtccgtctggctcagggaaatcaacaactatcaaaattctattgggtatggaaaaagctgacgaaggtgaggctttaattttagaaaagagaatgcccaatcggaaattattagcagatattggttatatggctcaatcagatgcgctttatgaatcaatgacagctagggaaaatttaaggtttttcggttatatgaaagacgttgcgaagaaagaattgccaaaagaaatagaatatgttgctgaagttgttgatttaactaattatttggataagaaggtttcaggatattctggtggaatgaaacgaagattatcactagcaatagctttactagcaaaacctaaaataattattttagatgaaccaacagttggaattgaccctgctctgagacttaaaatatggaaagaattagctaaattaagagatgagggaagaagtattcttgtaacaacacatgtcatgtctgaagctgagctgacagatagggtagcacttctttttgagggaaaaatcatagcctttgataaacctaagaaattagaagatgaatatgaagttaataatattgaagaagtatttttgaaagtcgagggtgagtag

SEQ ID NO: 808 - DNA, 1887 bp, Unknownn
  isolated from dental, unidentified
atgcctaataaaatcagtggcgctgatgccatgttaaaagttttgcatgaatggggagttactcatatttatggtcatcctggtggctcacttgactctactatgaatgctttacataatcaacaagataaaattaaatttattcaagttcggcatgaagaagccggtgcacttgctgcctctgctagtgctaaacttactggtaaaattggagttgttttaggttctgctggtccaggagctattcatcttcttaatggcttgcacgatgcaaaagctgaccatgttccaatattcgctattatcgcacaggtccctacaaccaaaatgaatatagattttttccaagcttacaatgaaggtccttggtttgataatgttgcttgttggaatagaacagctatgactgctgaaagtattcctaaacttgttgatgaaggtatccgtcaagcttataagcatcgtggagtcgccaccctaattttacctaaagacctaggatggaaaatgattcctgatacttttgtttccaatgcagctaaccacgttgaaccaatttaccctgaacccaatcctcaatccattaccgacgctttagaactgataaaagcagctaaagcacctatggtttactttggtattggggctaaacatgctgctaaggaattgaaagaaatttctgctaaatttaaacttcctctagtatcttctgttcttgctaagggaattattgaagatacctatcctacttatatgggatcaactggccgtgttgctccaaaaaccggagtagaattaggatttaatactgatttaattctctggattggtaacgatgtgcctttcagtatcttcctttttaatcctaaggctaaagtcattcaaattgatattgatagtgaaaaattaggtaaacgacatcaagttactgttccaattcttgctgattctaaaaaaacattgcaagccttacttaaacaaggtgaagaattacctgaaacaccattctacaaagctgctttagctaacaaagaaaattggctagcatggttaaatagatttaaacacagtgaagatatcccacttagacctgaaccagttttcgaagttttgaatcaagaagctagtgatcaagcaatcttcactcttgatgttggtaatgtaaatattaactttgctagacttatgaacttacatgatcaacaaaaatggactacctcaggccaattcgcaactatggggtatggtgttcctgcggccatcgcagctaaaatactttatccagatcgtgacgtatatagtcttaatggcgatggtggttttgctatgctaatggaggaaatcattacacaggtaaagtacaatttgaatattatcaacattatttttaacaataagacccttggctatatcgaggctgagcaaattgatgacactcaacaacctgtttttggagtcgatcttcctgatactgattgggcaacaatcgccaaaggaatgggtgcagttggttatacagtctacactttagacgactttaaagatgcaattgctgctggcaaagaaagttctaagccaattgtaattgacgttaaatttactcgagagatgccatttactactgaacatatgtatttggatcctagttaccaagatccacagaaagtagctagttttatcgaaaaatatcaagcaactactttacgtccatttagttatttcctaaagcgtgaactaggagaatctcgcgatgattttaactccgcgatgcaaaatgtttttgatgtaattacaacaccatcaaccttaccggaaaattatgaccaaaagaaaaaagaacaagatcaaatcatcccagatgcagtttctggagcttccgagtactaa

SEQ ID NO: 809 - DNA, 2082 bp, Unknownn
  isolated from dental, unidentified
atggctcatacatttttactagaaatcggactagaagaaataccagcacatgttgttactcctagtgttaaccaattagtacaaaagacaacaaaattcttaaaagaacaaagaatagattttgatgaagttatcccatattcaactccacgccgtttaacagtaaaagtaacaggcctagctgataaacaagctgacattgaagaagaagctaagggaccttcaaagaaaattgctttggatgatgaaggtaattggtcaaaagctgctcaaggtttcgttagaggtcaaggcgtaaccgttgacgatatcttctttaaagaattaaaaggtacagaatacgtatatgttaagaaatttattcctggtaagccagttgctgaagttttgacaggaatgaaagatgtagcgatggacttaaaattccctacaatgatgcgttggggatccaatgattttgaatatgttcgcccaatcaagtggttagtagctttattagataatgaagtagtgccatttgaaattttagatattaaaacaggccgtacaactcaaggacatcgcttcttaggtgaagcagttgacgttccatcagctgacaagtacttagaaacattagaaacacaaaaagtaattgctgacgctggagttagaaaagcagaaattcgtaaacaaattgatgctttagcaactgaaaaaaattggaacattgttgttgacgaagacttattagaagaagttaataacttagtagaatatccaacagtttttgctggcaaatttaaagaagaatacttgcaggtgccaaatgaagttttaattacttccatgaaagatcaccaacgtttcttctacgtaacagataaagaaggtaacttattgccaaactttgtatctgttagaaacggtaacaaggattacttagaaaatgttatagctggaaatgaaaaagtattaactgctcgtttagaagatgctaagttcttctatgaagaagatcaacaacatacaattgctgactatgttgaaagattaaagaaagttatgttccacgataagatcggtactatctatgaaaagatggaacgtgtaaatctattagctaagttcctaggaaacaagcttggtttatctgaaactgaattaaaagatttagacagagcatccatgatttataagtttgacttagtaacaggaatggttggtgaattttctgaacttcaaggtattatgggtgaaatatatgctcgtctacaaggtgaagatgacaatgtaagtacggcaattcgtgaagaatatatgccaacaagttctgaaggtgaattacctcaaagtaatgtaggtgcagtattatctattgctgataagttagatagtattcaatcattctttgctgctaatatgattccaagtggttctaatgacccatatgcattacgtcgtcaagctttaggtattatcagaattgctttagataagggttgggatatttccctaccagtactacatgcagcaattaattatgcctatgctgaacgtgaagatctatataagaatactcagccaattgctaatatttctgaaactgatacttttgtaattgacagactagcacaagtattaagtggcaataaattccgtcgtgatattttagatgcagtagtaactggtgctgatatgccatttatccaagcactacaagcagcacaagtattaagcaagcatgcagaagataatgactttaaagaagtaattgaagctttaactagagttactcgtttagctaagaaagctcctgactttgataaagatgcttcagttgatagtactttatttgaaaatgatactgaaaaagctcttgcagatgcatttgctaagattgaaactgagtatggcgatgcagaaatgaatgaaaaatttgctattttaagttcattaaaagacagtattacagcttactttgatgctactatgattatggctgatgatgaaaaagttaagaataatagattgttacaattagttaaaattgctagattaacagaagattttggatcattagataaattaattgtaaaataa

SEQ ID NO: 810 - DNA, 876 bp, Unknownn
  isolated from dental, unidentified
gtgatttttttgaaaaaaatactaagtttaagtttaggaataattgcattatgcttattcttcctacctagtaatgttagagcagataaaataaaagttgtaacaacgacagatttttatggacaagttgcagaagaagttttgggcaataaagggaaagtaacttcaattattaataaccctagtgtagatccacatgattatgagccaactacacaaacagctaagcaagtttcaaatgcaaatattgttatttataatggattaggatatgattcatggataacaaaacttagtaatggcaaaaagaagatagatgttgcgacagacgtaatgcatgctaaggatggggataacgagcatttatggtataactcaaagacaatgggtaagcttgcagattatttagttaaggaatatgcgaagctagatcctaaaaatgaaacttactataaaaagaatgcagaaaaatataaacaaaaattaactaaattacaaactttaattgcaaagattaagaaaaatagtgataataaggaagttgcagtaagtgaacctgtttttgattatgctttaaaagatatgggatataagattgctaatagacattttgctaaagctacagaagatggtagcgatccttcctatagtgatattaagaaattacaaaatgatattaaacacaaaaagatagcattttttgtagaaaatactcaatctgatagtaaagtaatttcaagtattgttagtctatgtcaaaagtatgatgttccagttataaaagtgactgaaacaacacctaagggaaaggattacttacagtggatgagttcagaatatgaacaagttctaaaaattcaagaagacgggaagtaa

SEQ ID NO: 811 - DNA, 978 bp, Unknownn
  isolated from dental, unidentified
atgtgtacaagtgttagtgttatttctgaagatggaacacatgttatgggaagaacaatggattggtatgatctttatgtgaaacctatgtatgttcccaggggatatcagtggaaatcagcatttgataataaaaaatatataaacaaatacgctatagttggtggaggttttcaagataataattatattgatttaagtgatggagttaatgaatgtgggttgatggcccaaaaattgacattttctaatggagcacaattggttgatgataagcatgatgataaaatccaacttgaagcatatgaatttgttacttatatacttggaaatttttcttcagtaactgaagtagaagaaaatatagagaaaattgaactaatgagtaatgtaattaataatacaaaacatggtggatcagagttacattttagtctttcagatgagagtggacgaaatattgtagttgaacctagtcagcacccaatgagaataattgataatcctttaggggtagtaactaatatgcctaaatttgagcgtcagttggcaaaattagaaaattatatggaatttactgatgaatttaaagaaaattcgattaaatatggaaaatttcatgtaactactggaaaactgggtggcaagaagacaccaccaggatcttactctccaagccaaagatttattcgtgcatcttatttaaaggaacttgttgatatgcctaaaacacgcgatgaagccgcatcgttagcatttggtatattagatacagtttcaattcctaagagtaaagcacatagaccgacgtatacagtttatagagcagttgcggtatcagaggataggacttattattatcaagtaaatgggcaagctacggttagtggaattaaattagatgaagagctagtacaaaatacagaaccgatagtatttaatgtatcgaatatatggaatccacaaatgttaagttaa

SEQ ID NO: 812 - DNA, 918 bp, Unknownn
  isolated from dental, unidentified
atgattaaaaaggataagaaagttgaggcgatgttcatgagtgcattgcaattagtaatagttaccggaatgagtggtgctggtaaaacagtagctgtacagagttttgaagatttaggttatttttgtgtggataatatgccgcctaaattattgcctaaattttatgaattggttaaggaatctgggaaaataacgaaaatagcattagtagtagatttaaaatctcgtgctttctatgatgaaattgtagaaatggtgagagaattagatgaaaatgaattcaattcttctagaatattgtttttagatgcttcagatgaagaactagttgctagatataaagaaactagaagatctcatccgctggctatggagggaagaattttagacggaattcatttagaaagagaactattggcaccaattaagtcaaatgctcaaatcatcattgatacctctaaattatctccacgtcaactaagagaagagatatttaagaatttcgaagccagagataccaaaactttccatattgaagttatgtcatttggtttcaaatatggattacctatagatgcagatattgtcatggatgtacgtttcttacctaatccttattatgtgccggaattgcgaaataaaactggtaaggatgatgctgtatatgaatatgtgatgaaatctgagaaaacagaagaattttatcaaaaatttgtatctcttctaaaatatgtaattccaggttatattgcagaaggaaagtctaatgtaacaattgcaattggatgtacagggggacaacatcgctcagtagcattagctgaaagaataggtaatgaactatctaaagagtatccggttcatatgtcacatcgtgatatgaataaacgaaaggagacggtgaatcgctcatga

SEQ ID NO: 813 - DNA, 1449 bp, Lachnospiraceae bacterium
  isolated from dental, Lachnospiraceae bacterium
gtggccattgtggcatttgaaggtttaacagaacgtttacaaaacgcaattggaaaacttagacgaaaaggtaaaattagtgaatctgatgtcaaggaagttatgcgagaaattcgtttagctttgcttgaagccgatgtaaattttaaggttgttaaagattttgtaaagaccgttagaagtagagctattggggcagaagtattagaaagtcttacacccgcacaacaaattgtaaagattgttaatgaagaattagtgaaagttatgggtgaggaagccgctcccctaaataaatcagctaaaattccaacaattattatgatggtaggtttgcagggtgctggtaagacaactacagcttcaaaattagcaaataagttaaaaaaagaaaaaaatgcacgaccttttatgattgcagctgacgtatacagacctgctgctattgaccaattgaaaatattagggaaagatattgatgttcctgtattttcattaggtgttgatgttgatccagtagagattgtacgacaaggtcttgaagaagctaaagacaagaaaaatgattacgttattatcgataccgctggtcgtttacaaattgatgaaaagttaatgcaagagttatctagtattaaagaattagcacagccagatgaaattctattaacagttgatgcgatgactggtcagaatgcggttgaagttgctaaaggttttaatgatcaacttgatgtaacaggggttgttctaactaagctagatggtgatactcgtggtggggctgcactttcaataagagctgttactggaaaaccaattaaatttattggtcagggtgaaaaaatgacggatttagatgtattttatcctgacagaatggcttctcgtattcttggaatgggtgatatgcttaccttaattgagaaggcacagcaagaatatgatcaaaaacaagcagaagaacttgcagaaaagatgagagagaacaattttgattttaatgatttcttgattcagatggaacaagttcaaaatatgggacctatggaagatattataaagatgattccaggaatggctaacaatcctgcactgaagaatttgaaagtagatcctaaggacattgaacacactaaagcgatagtatattcaatgacaccacaagaaagagaaaatccagatttattgaatcctagtcgtcgtcgccgtatagctgctggatctggtagaccaatccaggaagttaatcgcatgataaagcagtttaagcaaatgcaagatatgatgaaaaagatgtcaaatggtaacttctcaggtatggaaggccttttaggtggaggtatgcaaggtaagttggctaagatgtcaatgaatagaatgattagaaaaaataagaaattaaagcaaaagaagctgaaaaaactacttaaaagaaaagggaaataa

SEQ ID NO: 814 - DNA, 801 bp, Unknownn
  isolated from dental, unidentified
atgaaaaagataaatcctttattaacaatcccttattatctatggataggtttatttgtaattgctccagtgctgctaattgtctattattctttcatagacatccatggaaacttcactttaagtaactatggaaattatttcggttcaggcaagtatttaatgatgacttttaactcattcctatatgcttttattattaccttctttacggttttagtaagttatcctatggcatactttttgacgaagttaaagcataaagaactttggctattgttagtcatcttaccaacctgggttaatttgttgttaaaagcttatgcctttattggtatttttggaattgacggaagtgtaaatcatttccttagtttttttggaataggacctaaacagatattatttactgattttagttttattgttgttgcgacttatattcaaatacctttcatgataatgccaatatttaatgctcttgaagaaattaatccgtcagtcttacgtgctagtcgagatttaggtgctaatgaatggcagaccttctttaaagttgtaatgccattatctatgaatggggtaaagagtggaattcaagcagtatttattccatcgctctcactatttatgttgacacgtttgataggaggaaatagggtaatcactctaggtactgctatcgaagaacatttcttagtaacacaaaactggggaatgggttcaacaattggtgttgttttgattgttataatgttcattgttatggtaattaccggtgagaaaagggggcataaatag

SEQ ID NO: 815 - DNA, 1461 bp, Unknownn
  isolated from dental, unidentified
atgatagaaaaatttaggaaaaatatttctccgcccctattagcctgtgttttagcagcagtgatagtggggtatttgttatttgtatctccaattaatggatatgcagataacggagattttgccagggtaatttatatcaatggaatctacccattagatacgaagaattaccagtatacaacttatttaacgcaacattatggtttatttaaatactacaatgaacatattgcgatgttgttttcttcgcaaggtatttttgtaaaaacagcagtattattaaataagttattctacagcaaaacagtgtttgatattaggtttatgggattagtttattacgtcttttatttaggggcaatttacttactaactctagctgtgacaaactcaaacaagcgaaaaaatgtagattatgtaattgcgttaattgtagtttttatgtttgctgattcatcgctgacattatattttaactcttttttcgctgaaccagttatgataatagcaatgatgtatattacagcttccttattattactgatgaaaaaacattttgctcgtagttggtatatgctagcagtgtattttttagcatcattagcattggtaactgttaaacagcaaaatgcaccattagcattgagtttagttgtggttacaatcggaatttattttgtatatagaaacaaactttctagattactaattccgatttcttgtttaatcttgctgggatcagggattgcgacttatgtaatgattacagatcaattcagtaatattaatagttaccaatcaatgactcgaggggtaatgttaaaagaacaagatcctggtaattctctagaaaaaggtggaatatctcgtcaatatggattgttgaaaggagatatttatactcaaacttatgccgcaacatctattaaatccaaaaacataaccaaggactttattccaaaatataattttgcttggattttgaaatattatctaacacatgaacaacaatttaatgaaatgttagacgtagctgcacgcgatggctacctggtacaaattaaagcggtcggtgattttactaaaaaatctggtgcaaagccgcatcaacaagtacaatactttactttatatggagcgatgatgaaagctttctttcctaaaaagtttgctttctatatgacattatgtgtagttttagttgctttatatatagtaatttttgttattagcgtaaaaagtaatgaaatggaatctgcaattaaagtttttatggtaattggatatacaacaatggtaatagggacctttattacagcggttgttggtgacggtgatgctgatttagccaagcatttattgatggtacctttatcattaaacttaattttcttgcagataatttcagatgtcttacatcataatttttggcatccttcgagggagggtgaatattga

SEQ ID NO: 816 - DNA, 789 bp, Unknownn
  isolated from dental, unidentified
atgcctaaaattttaaagaagaaaaaaacggcttctgaaattgtagctgctgcgcgtgggttaaaaaaagtaactgccaatgaattgatagatggaatttttgatgatttttttgaacttcatggtgatcgcaaatattcagatgatgaagcaattataggtggaattgcattatttaatgggattcctataacagttattgcaacggataaaggtggtactcctgaagagagaatagcaaaacattttggatgcccagaaccgtcaggatatagaaagtccttacgtttaatgaaacaagctgagaaattcaatcgaccaatcgtaacttttgtaaatacttcaggtgcttatcccggacgatctgctgaggaaaatggacagggtgaagctattgctagaaatttactagaaatgagtgatctaaaggtaccaattatttcatttatttatggtgaaggaggcagtggaggagctttagctttggcatgtggagatcaagtttggatgttagaagatagtatgtattctattttatcacccgaaggatttgcttctattttatggaaagatagtaaaagggcagatgaagctgcagaagtaatgcagttaactcctgaggctttattaaaacaagaaattattgaaggaataattccagaatctaattcacatcgaaaagtttgcaaagagataaagaaaatattggcacaagaattaaaaaatctaacttcacttacaaagtttgaacttgtaaaaagaagaaaagagagatatagaaagttttag

SEQ ID NO: 817 - DNA, 1251 bp, Unknownn
  isolated from dental, unidentified
atgaatattttagatgaattagcatggcgtggtgcgattaaccaagtttctgatgaagaagggttaagaaaattattagataaaaagtcagtaggtttatactgtggggtcgatccaactggagatagtcttcatatcggtcatttaattccatttatgatgttaaagagattccaagaagctggacatcgagcacatatcatcattggtgggggtacaggttcaattggtgatccttcaggtaaaaaatctgaacgtgtactacaaacaatggaacaagttcaccataatgaagaagctttaactaagcaaatgaagcatttgtttggaaaggataatatcacaattgtgaacaaccgtgattggctttctaaaattgatttattaggttttttacgtgactatggtaagttatttaatgtaaatacaatgcttaataaagaagttgttgcaagtcgtttagaagtaggtatttcatttactgaatttacataccaaattcttcaatctattgacttccaccatttatggaagaataatgatgttcaacttcaaattggtggagctgatcaatggggaaatattacatctggtatagatttaattcataagatggaaggtagcgaggctgaagcttatgcattgactatcccattaatgttaaaagctgatggaactaaatttggtaaaacagctggtggagcagtatggttggatcctgaaaagacaacaccttatgaattctaccaattctggttaaaccaagatgatagagatgttattaaatacttgaagtactttacattcttatctcaggaagaaattgctgacttagaagaaaaagttaagactcaaccagaaaaacgtgaagctcaaagaagattagcagaagaaactgtagaatttgtacacggaaaagaagcagttaaggaagctgaacacatttctgcagcattattctctggtgaagttaaagacttaacagcaagtgaaattgaacaaggatttaagaacatgccaagtgtagaagtaactgctgaacctaagaacatcgttgaatggcttgtagatactggaattgaaagttccaagcgtcaagctcgtgaagacgtaacaaatggtgcaattagaattaacggagatagaattcaagatttagaattcacaattgatccatctgcagaatttgatggtaaatttgtaatcgttagacgtggtaagaagaagtatttcttggcaagagtaaaataa

SEQ ID NO: 818 - DNA, 1128 bp, Streptococcus sp.
  isolated from dental, Streptococcus sp.
atgagtaaggaattactaaacgcattaaatgccttagaagttgaaaaaggtgtaaagaaagaaattgtgattgaagcattagaagcagctttagtttcagcttataagcgtaattatggtcaagctcaaaatgtggaagttgaatttgataagattgcaggtaatatccatgtttatgctgttaaagaagtagtaaatgaagtgtatgattctcagttagaaattagtttgaaatctgctcttgaaattaatagagcttatgaaattggtgatactatccgtgaagaagttacaccaaaagattttgggcgtatagcagcacaaactgctaaacaagtaatcatgcaacgtgttcgtaaagaagaaagagaagttatttataatgaatatgttcaatatgaacaagaaattgttacaggtgaagtagaacgtagagataataaatttgtttacgttaatttaggtagaattgaagctgttttgtcacgtcaagatcaaattccaggtgaagaatacaagtcacatgataaaattaaggtatacatttataaagttgaaaacacatcaaaaggacctcaagtatttgtaagccgttctcatccagatttgttaagacgtttatttgaacaagaaattccagaaatttttgatggtactgtagaaatagtttcaatttctagagaagccggtgatcgtgctaaagtagctgttcgttctaatgaagatggtgtagatcctgttggaacatgtgtaggaccaagaggtgaacgtgtacaagctatcgtaaatgaactaaaaggtgaaaacatggatattgttgaatggcgtgaagatccagcagaatacattgctaatgctttgaatcctgctaaagtattagacgttcgttttgatgatgaaaatgagcatgcttgtacagttgttgtaccagatgatcaattgtctttagcaattggtaaacgtggacaaaatgcaagattagctgcaagattgacaggttataaaattgatattaaatcagaaagcgatgctgctgatttaaataacgtggaagctgataataatgatattgatgatgaagatcaattgatgtcagactcttcttccaatatgattgaggaggaataa

SEQ ID NO: 819 - DNA, 843 bp, Unknownn
  isolated from dental, unidentified
atggataatcggcagcaaattcatttagaaaatttaagtctacgttaccgagggattgaaacatccgcgctaaaacatatttcggttgacgccgaatttgggcatgttattggcatcattggtaatcatcatgcaggtaaaacatcgttatgtcgggtattagccggaattgtaccaacaattatttcaggtgatgtaacgggaaccattcaagttggatcattatcgccaaatttggattggcagaagtataatcagcaaaccggtgttgtgctgcagaatccggctggtcaattgagtgggcttgccgatacggttgccgatgaaattgcgtttgatcttattaatcaaggagttccagctgatcaaattaaacggcgagtcctcaatgttgccgatcagttggggttaggcgaccaattaaatcaatcaccgggaacgctgtctggcggacaaaaacaacggctggcaattgccacagcaatcgtaactgatccgtcaattttggttttagatgatcccaccagtgaaatggatccacttggacgtcagcatttcttcagttggttagtcagtgttgaaaaaaagacgatcttcattgtgtcaaatgaagtcgacgatctctgtgaaatttctgaccaaatttgggttctgaaagctggcgagttagttgcggcaggaaaaccgctgactgtttttaatcatctgaagccggactggcagcttgctgaaccgactgtgtttcgattggcaaaattaatgaagtggtcaatccctggtgcagcagacgaatttccggttaccaatcaacaattagaggaggcttattatgccgcaaattga

SEQ ID NO: 820 - DNA, 1566 bp, Unknownn
  isolated from dental, unidentified
gtggtaaacaatgaaaataatcataaaaagcataagatgattcaatatgctaacggtaaatcacttgaagaagtcaatggtaccgtagaaattcctaaaggcaagggtttctggaaaactttatttgcatattccggacctggtgccttagtcgctgtaggttatatggatccaggtaactggtcaacatctattactggtggtcaaaactttcaatatctattgatgtctgttatcttactatcaagtttaattgccatgttgttacaatatatggctgctaaactgggtattgtaagccaaatggacttggcccaagctattcgtgctagaactagtaaagcattaggtattgtactttggattttaactgagttggctatcatggctactgatattgctgaagttatcggtgcggcaattgccttgtatttattatttgatattccgttaattattgccgtatttattactgtttttgacgtattactccttttattacttactaaagtcggatttagaaaaatcgaagctattgttgtttgtttgatttttgttattctttttgtttttgtttatcaagttgctttatcaaatcctgactggggtggcgtatttaaaggattaattccaacatctgaaacttttgctaaacatccagttgtacatgacatgtctccattaaatggtgctttaggtattatcggagcaacagttatgcctcataacttatatcttcactctgcaatttctcaaacacgtaagtttgatcgtaataatgaagatgacattgctaacgctgttcgttttacagcttgggattccaacattcaattaggtttagcttttgttgtaaattcccttcttcttatcatgggggttgctgttttcaaatctggtgctgttgaagatccttcattctttggattatatcaagcattatccgatacaagcgttatgagtaatggccttttagctgctgctgctagaactggtattttatctactttattcgcagttgccttattagcttcaggtcaaaactccactattactggtactttaactggacaagttattatggaaggatttatccatttgagaatgccactttgggctagaagattaattactcgtttattatctgtaatcccagtacttatctgtgtagccttaactagtggtaagagtacaattgaagaacatgaagcattaaataatttaatgaacaactcacaagtattcttagcctttgcccttccattctcaatgttacctcttgttattatgaccggtagtaaagttgaaatgggtgaaagatttaagaatagattatggatcaatatccttggttggatttcagttatttctctaacttacttaaatatgattggtttgccacaaaaccttgaacctttcttcccagctgacaaagttggcttagcacacacagtagcttacatattaattgtgcttattattgctttactaatttggacattagttgaattacatttaggtaataaacgctttgcagctgaacaagctaaaaaacataataaatag

SEQ ID NO: 821 - DNA, 1359 bp, Unknownn
  isolated from dental, unidentified
atgtttagcaagataggtcaattaatctttgataatgaagctgtcgctaaaacttccgattttactatgggattagaaattgaaatgcaacgtgttgatgataccggacatctaagccaggagccttatccgtcagctattggagatgagaaaactaacccttggattacaaatgatttcttagaaacaatgtctgaggttgtaacacctgcagctagtcacgcacttgatgcaatgcattatctttacgccatcaataatgtgctacgttctgcattagctccaggagaactgctctggccactttcaatgccgcctaaattgcctaaagataaaagtacaattcaaactgctaaaatgggaccagtaaaagaagcttatttcaaggaattcatcaagcgtcacggcttttccaagggtactccatgtggtgcccatattaatttgagtattgacgatcatatcattgacttggttttaaagaattttcctgagcgtttcaaaaatagaattgaagtccagaactatctttatactgttttagctcaaggttttatgcgctatcgatggcttattacatatctttttggtgctagtccaattgctgaagccaactatttcgacaaagaagatgaacttccccatcctattagaagtattcgtcagagttcttatggctttggtactcgatttagtggctgctttattgatgttcaaaaatatgttaaacgtattgaagaaggacttaaacaaggagtattgattgctgaccatgatttccatagccccgttcgttttaaagggactaaagatttcagagatcttcctaaaaaaggtgttcaatatcttgaattaagaatgttggatcttgaccctagtagttctgtgggcgttagaactggcactcttcgctttattcgtctactctctagttatttcatcatgcaccctgctttaaaggctgatgatgtcgaccaagttctcagtaaagctgatgaaatgaatgaagatgtatcagtagaattacctactgaccaatgtaaatatcaaaataaggctcgtgcttttatcaagagtcttgaacgttttgcgaatcaaatccagttaggaccagaatatcaagaaattcttgaagatttagaagatagagttgaaaatcctaagacaactcctagtgctaaattattaagctacgttgaaaataattctttagaaaaatatgcgttaagacgtgccaaacgttatcaagaagctgctttagaatctatctatcaatttaaaggctttgaagatgacgcacctatgtctgcagaagatttaaaacgtgaattattctatggtaattgggaagtgcaataa

SEQ ID NO: 822 - DNA, 1251 bp, Unknownn
  isolated from dental, unidentified
atgagtgcaccagcatttacaccaattttattaggtagcgattttaatgtttacggaatggcacgttctttttatgaactataccataaaccagttaaagcatttgcagaaatagaattggtaccaacaagatttacaaaaattgttgacttagaattaatagatggtttttctgaagatccagtttggattaatgaaatgcgtaagataaagaaacgttacgctgatcatgaagaaccagtaatcttaattggttgtggtgatggctatgcagaattgattgctaagcataaggatgaattgtcagatgtatttatttgtccttacgttgactatgatttattgaagcatttgaataacaaggaacgtttctatgaaatgtgtgacaagtatgacttgccatatccaaaaacaaaaatcatcactaaagctgatcatgacagtggagacaagattgaacaaccattccaatatccggtagcattgaaaccagctaatagtgttgaatggcttgacgttcattttgaaggtcgtaaaaaagcctttagaattaaggatcgagaagaatttgattatgtcttgaaacaagcatatgcaaatggctacaagtctgattttattttacaagactttattcctggcgatgatagtcatatgcgtgtattgaatgcctatgtagataaagatcataaagttaagatgatgtgtatgggacatcctttactagaagatccagcaccatcagcaattggaaactatgttgcaatattgccagactttaatcaagatatctatgatcgtatcaagaatttcttagaagctattaactatactggttatgctaactttgatatgaagtacgacacaagagataacacatataagttatttgaaattaatcttcgtcaaggaagaagtagtttctttgtaactttagatggttacaatttagctgattgggttgttaaagactacgttaaagatagcttaaaagatcaagaaactgtctatggaaataaagatgaagaacaacatgctctatggttaggtgtgcctgcgaaagtgtttaagaaatatgccaaggataatgaagataagcaaaaagctttggaattaattaaagctggtcgttacggaacaactttcgaatattctaaagatatgaatattagacgttggctattaattaagtggatgaatcataactatgtgaagaacttcaatcgttatttcaaagaaaataaagggtga

SEQ ID NO: 823 - DNA, 1824 bp, Unknownn
  isolated from dental, unidentified
atgataggggtgtcgaatttgaaaaaaaaagttataagtcttttcaaaaagaattggaaatattgcttattagtaatattagtattgagtataattttagttattaaaaatattaacaaaagacactacgatattgaagattataattctaatattcaattaaaaaatgatggctctataggagtatcgacacgtgtacaatataatattcatggtaagtatgacttattagttattccacaagcattaccaaaagatgtggatacgattaataatgtggaagtgtatgaaattaaaaataacaagcaagtcttattaaaaaaagggactaatgcagatatatctaaagaggccaagatgaatgctggtaaatattttgtcacttctgatttagcagaaacaaatactaaagtaaaagtaagaatatatcaaccagttgaaaatgagagagttacatacaaactaacatataatgtaccaaatgcgattataaattatggtaatagtaatatttcagaattaaattggaatatactgagtaattggggacataagtttagcaatattgatataacatttgatttacctgaaaaaaatccacaaattttacgagcgtgggtgagaggaacaaccgatggtaaaataacgactagtaagaaaaatggaaaagtgaattttaagttgaataggcttcccgaaaataagagtttacatttaagactaatatgttctaaagatctatttgcttataataccaacaatatgtttaaaacccctataccaacagaaagtagtattgcaggatatgaatacaaaaatagtgataaagtaaagagggatagtagactaaaatatactggaaagtatatttctataacaatattattaattgttatgacaattatgggaatattcagttggagagtgttatctaaaaatttggttttatcaaattatcttaagtttacaaagtattcatttgatattcctgatatatcggttaaatatgttagatcgattttatttcctaaacgaaagcccaacagaaatgtttacgcagcatatatagtagacttaataaataagggtgatctagtattaaatccactaagaactgaaaattatcagactatatatgactacgaattgcaagttaaagatgaacagtttatagaaaataatagattgaatacattattatttagtaatcttacttctgacaataaaattaagttatctgaaatagaagaaactgtcaatcttatgaagatttcagaagttactgaaacttataagcaatggcaagggaaaattaaagaagaagtggataatctatttaaactggaacataaacgtaatttaaaaggttattttactaaaaaatggttaatactctggacactattcaatctagcaggagtaattttattttttattgtatctaagtggttagggataattatagctacaattcttattgttaatgatataaatttgatatatatatttattaatgtttataaatatgaacctgaaatatttatagaactgagaagattaaagattttatatcgaagtttacgcaatatagaaaagctagaattgaatgatgttggtgacgaaaatttttgggaaaaattattaccatatgcaatagctttaaatatggaagaaagaacaaatcgaaaactatatcagttatatagtgaatcaaatgtctttatgaaagattccatattatatatgggggattttgctgaaaaaataggggaaatttttattagattagatttaaatagtgaaacattgaatataaaaaaataa

SEQ ID NO: 824 - DNA, 1137 bp, Unknownn
  isolated from dental, unidentified
atgagtacagttttaaaacatggacttatttatactggttccgaaaaaattgtagatggatatttacgatttgataaacaaattatcaatgttggaccaatgtctgaatataaagcccaagtatctgatgataaaattattgatttggaaggacaagttgtagttcctgggtttatcgacgttcatagccatggtggttatagtttcgattccatggatggcgatgctaaccaaattgatgaaatggttaatgatatggtccatgaaggtattactacatatttcgctacaactatgactcaatcccatgaaaatattgcgcatgcgatggttggtattaaagaagccgctgcaaaaaatccagttattcaaggtattcatcttgaaggaccttttgtttcacctattttcaaaggagctcaaccagaagaatatatcgaatctcctgatatcgatgctttcgctcattggaatgaactatctggtggtatgattaaattagttacttatgctcctgaaaatgaaaatactactgaatttgaaaaatattgtattgaacacaacatcgtattatctgtaggtcatagtaatgctacacgtgctcaaatgaaaggctcacttgctagtcacgttactcatttatacaatgctcaacgtgaattgaagcatcgcgaaccaggtgttactggtcatgcccttctcgaaggaaatatgtattgcgaaatcattgctgatggattccacgttttcccagatatgattaaactagcttatgaccttaaaggaccagacaagattgaattagttactgactccatgcgtgcaaaaggtatgcctgaaggagtttcagaattaggtggtcaaaaagttatcgttaaagataagcaagctcgtctagaatctggtaatttagctggttctgtattgcaataccaagatgcctttaagaatattatgaaatttactggttgcggtattgaagaagctgtgaaaatgtcttctgttaaccaagctcgtgaatttggcttaactcaaaaaggtgctattgaagttggcaaagatgctgacttaaatgtgcttgattctgatttaaatgttgttaaaacatttagttttggtcgtttatttgaaaaatag

SEQ ID NO: 825 - DNA, 2427 bp, Unknownn
  isolated from dental, unidentified
atgccgactgaaagaaaaattcaagaattatcactagaagctgttatgggagagcgttttggtagatattctaaatatattattcaggaacgtgctttacctgatattcgtgacgggctaaaacctgttcaaagacgtattttatttgcaatgaacgaagatggaaatacctatgataaagcatttagaaaatctgctaagtctgtaggtaatgttatgggtaatttccaccctcatggagatacctctatttatgaagctatggttcgtttgagtcaaagttggaaattacgtgaaccgttaattgaaatgcacgggaataacggttctatggacggagattctccagctgctatgcgttatacagaagctagattatctcaaattgcttctgaaatgttgcaagatattgataaaaagactgttgatatggtacttaattttgatgatacagagtacgaaccaaccgtcttgccagctcgtttccctaatttattagtaaatggggctacaggaatttctgctggttatgcaaccgaaatccctcctcataatttgagcgaaacaattgaagctgcaatttatttgataaatcatcctaatgctagtttagacgacttgatgcaatttattaaaggaccggatttcccaaccggtggtattttgcaagggatagatggaattaagaaagcttatgaaacaggacgtggtagagcagttttacgttcaaaaactaagattgaagatatcagaggtaataagcagcaaattattgttactgaaattccatatgaagttaataaatcagctttagtcaaacgaattgatgaattgagaatattgaaaaaagtagaaggcatttctgaagtaagggacgaaagtgatagagaaggtcttcgagtagtagttgagttaaagaaaaatgctaatgcgcaaggtattctaaactatctatttaagaatacagatttacaagtttcctataactttaatatggtggcaatcaataataagcgacctgaacatgtagggctaaaaacaattttagaagcttatttagaacatcaacgtgaagtaacaactagaagaacaaaattcgatttggaaaaagctaaagctagagaacatatagttaaaggattaattaaggctttatctattctagatgatgttattaaaacaattcatgcatctaagaataagtctgatgctaaaaagaatttagtatctgaattttcatttactgaagctcaagcagaagcaatcgtttctttgcaattatacagattaacaaatactgatgttactgcacttcaaaaagaagcagaagaattgcaaaaagctattgctaattttgagaatatccttgctaatccaaaagaacttgataaagtaattcgcaaggaattaaatgctattaataaaaaatatggttcagaacgcttaactgttattcaagatgaaatttcatcattaaagatcgaaactgaagtaatggttgctcaagaagatgtaatgctacttgtttctcatgatggttatgttaaacgttcatcgcttcgatcattcaatgcatctgataatgatgagaacggtttgaaggatgaagtctatccaattttacaaagtgttgttaatactttatcacatctgtttattttcactaataaaggtaacctaatttatcgtcctattcatgaagttatagaatctcgttggaaagatacaggagaacatttatctcaaactgtaggtctaggaaatgatgagtatgttttaaatgcttttgtttttgaaagtatagatcaagatgcaaagttcttaatagctacaaaagagggatatataaaacaggtaaaattggctgatttaaaaccaggacgaacatataagacacgtgctagtcgatatgttaaattaaagactgatgctgatgaagtgatttcagtatctcaagttgaatctgataaatctcaagtcttttgtgcatcatatacaggatatggattgagatatagtctagatgaagtccctactaatggagctttagctgctggtgtaaaatgcatggatttaagagatgatacattagcaaatgttattttagtatctgaaagtgacgaagtttctatcttaactcaacgcggtagttataagaagatgaaagtagctgacgtaccattgactacaagagcaagacgtggtgttcaaattttaagagaattaaagactaagccacatcgcatagtttttgctgaattagttcaaataaatcaagagttagtattattattgtcagatggtaagcaagaaattgtaaaacctgaagatcaccaattaaatgacagatattccaatggatcgtttatagttgatgctgaaactgatacaattgaaaatatctatactaaaattattgaagattaa

SEQ ID NO: 826 - DNA, 1488 bp, Oribacterium sp.
  isolated from dental, Oribacterium sp.
atggcaactttgtatcgtagtacacgcgacgcttcagctaatagtatttcttcgtctcaagctgttcttcaaggaattagtcccgatggtggtttgtttgttccggttgattttcctaaattagatttagatttatcacaattgccatcgctatcctatcaagaactagcttacaaaattctccaaccttttttcagtgactttaccgaagacgaattgcgttcatgcatcaactctgcttatggcagtaattttactagtgaagagattaccccagtttcctatcatgctggtaatatttaccttgaactatttcatggtcctacaattgcttttaaagatgttgctctacaattattaccttacctattaataacatcagctaagaaaaataattctaatctgaagaacgtcatcttaactgctacttcgggcgatacaggtaaagctgccatggctggattcgcagatgtagaaaatacgcaaattattgttttttatcctaaatacggcgttagtcctattcaagaaaaacaaatgcttacacaaactggtaaaaatgtctatgtggttggtattactggtaatttcgataatgctcaaacaaatgttaagcaaatttttaataattcaactttaactgatgaactactaaaaagtggctatcaattttcatcagctaactctattaatattggtagattattaccacaaattgtttattacttctatgcttatggacaattattagctgataataaaatcaagttaggcgataatgttaatttcagtgttccaactggaaactttggtgatattttagctggattcttcgctaaaaaacttggcttacctattaataagctactatgtgcatcaaacgaaaataatatcttaactgaatttttcaagactggtacatataataagaaacgtgatttcaaagttacaaactctccttcaatggatatccttgtatctagtaacttagaacgcttattattctacgctacaaatggaaatgcagctttagtggctgaatggatgaaccaacttgaaaaagaaggcgagtatactgttgactcagatacacttaaattcctccaaacacatttctacgctagttcggcaagtcaaactgatactaaaaatgagattaagcaagttttcactgagagtaattatgctattgaccctcataccgcagttgcttcctttgttactcgagaatataaagaatcagctgctgattcttgtccaacagttacagtatctacggcaagtccgtataaattcccacaaacagttctagctgctttaggagtagataacgcaactggtgatttagatgacgtacaaaaattagttgatttaattaaactgcctctacctaagacggtcgccaatctatttgaagctaaacaattacatgatactgttattgaacctgatgagatggaaaattatgttaaagaattgctgatttaa

SEQ ID NO: 827 - DNA, 1065 bp, Unknownn
  isolated from dental, unidentified
atggcaatggaagattatcgtataaataaagaaaatggattagaatttggcttatattcactaggggatcatatgcctaatgctcttacaggtaaacgtgtttcagctaaagaaagaattgatcaaatagttgctgaagcaaagttagccgaagaagcaggattagatttcttcagtgtaggtgaaagtcaccaaaaatactttgttggacaagctcatgctgttattttaggagcagttgcccaagctactgaaaaaatcaaaattggttcatctgcaacaattgtttcaacatctgatcctgttagaatttatgaaaattttgcgacattagatttattatccaatggacgtgctgaaattattggtggacgtgcttcacgtttaggtttgtacgatttattaggctacaacgtgaatgattacgaagaattatttgaagaaaagtttgaattactactcaaaattaatgaaaatcatcgcgttaactgggaaggtaatttccgagcaccattaaaagatgcagaagttttaccaagaccattaaatgacaagttgccaatttggcgtgcagtaggtggaccagctgaaagtgcgattaaagctggattacaaggtgtaccaatgacaatcactttattaggcggtccattaccaatctttaagcgttcaatcgatgcttatcgtcaaagtttgaaaatgaagagctataatccaagtgattttccagtggcgacaacaggatttttctatgcagctgatgatacaaagactgctttaagagagctttatccttatgtagatcaaggaatgaagttagcaaatggtacaggttatcataagcgtttattcgctaatggcgcagacatgaatgatgtaatgctagtgggaagtccacaacaaattattgaaaaaatgatttatcaatacgaagaactaggccatcaaagatatttagcacaaattgattttggtggaatgccatttgaaaaagttatgaagaatatcgaaattattggaacaaagattttaccagaagttaaaaagtatacaaaggggaaataa

SEQ ID NO: 828 - DNA, 1119 bp, Unknownn
  isolated from dental, unidentified
atgaaccttcctgaatttggtgtagaagcctggttaaataagtgggaaaaaagtgctaaatatgatatatctcaaagttcaattgattctttaacattagaagaattaattggtttagatggtacaaaggtggaggatttttttgctcaacatagtactgataaattaaattatggttggattgaaggatcacctgaatttaaagaattagtagcagaactatatcaaaatatgcccgccgataatattttgcagactaatggtgcaactggtgctaacatgttagcaatctatgctttggttgaggctggggatgaagtgatttcgatgattccttcatatcaacaattatatgatattcctcgttctttaggagctaaggtaaaattgttgaacttggatgagaaacaagactggagttttaaaatagatgaattgaaggaattggtaactcctaaaactaaattaatctgcttaaacaatgccaataatccgactggaacagtgtttgacactgattttatggaagaagttgttaaaatcgctaaagaagtggatgcatatatattagttgatgaagtatacatgcctttaaataaagatagaaaatatgtttcgatagttgatatgtatgataaagggattgctacaaattctttatcaaagacattttctttacctggattgagaatagggtggacagcatcaaataaagaagtagcggatatatttagaaagttccgtgattacacagttatttgtggtggtgtattaaatgatgctttggcagtccatgcactgagaaatagagataaaattctacaaagaaatgaagaaatcgtcaagaataacttgaaaatagtagaaaattggttaaaaacagagcctcgagtaagttggtgtacaccacattccgtttctacatcatttataaagctagatattcctcaagatgattattcattttgtgaagatttgctgagagaaaaaggtgttttgttagttccgggaactgcatttgatagaccacaacatgcaagattaggatactgttgtaatcctaagattctacaacaaggtttagaaaagttatcagaatatttgagaaaatttgactaa

SEQ ID NO: 829 - DNA, 1329 bp, Unknownn
  isolated from dental, unidentified
gtgcttttcggtttaataagggaggaaattttaatgaagtatcaacgtcctaaaggaacagctgatattttgccaagtgagtctgtaaaatggcaatatgtagaagaaaaagctcgagaattgtttaaaaaatatcgctatgaagaaatgagaacaccaattttcgaaagttttgaagtcttttcacgtacatctggtgaaacttcagatatcgttactaaagaaatgtatgatttctatgataaaggtgatcgtcatataactctacgtccagaaggaacagctggagttgtaagaagttttgtagaaaataaattgtatggtccagaagttcaaaaaccatttaaaacttattatatgggtcctatgttccgttatgaacgtccacaatccggtcgtttacgtgagttccatcaaatcggtgtagaagcatttggtgttgataatccaacattagatgttgaagttatggcaatggcagtagatttactaaagagttttggtttgaatagtttacgtgtagctgtaaacacattaggagatcttgaaactcgtaacaactatcgtcaagctttaattgactatctagaaccatttgaagctgaattgtcagacgattccaaggaaagattacataagaatcctttacgtgtactagatagtaaagatgaaaaggataaagaaattgttgctaatgcaccttctattttagattacttaacagaagatgcacaaaaacattttgaaactgtaaagagtctattgaatgatttaggtattgaatatgtaatcgatagtaacatggtgcgtggtttagactactacaatcatactatctttgaaattatgagtgattccaaagcattcaatggtaaatggactacagtttgtgctggtggtcattacagtggcttagtagaacaattaggtggtccacaaacaccaggtgtcggttttggattaggtgttgaaagattactattaatcctagatgcagaagaagatgctttaccaattgagaatccactagatgtttatgtagtaggaattggcgatgtaactaatgcagcaactttgaaattagttcaaaatcttcgtcatcaaggatttacagcagatagagattaccttaatcgaaagcctaaaggacaatttaagtctgcaaaccgtttaaatgctagattcactttaactattggtgaaactgagcttcaagaacaagaagcaaatctcaaatttatggaaaatggtaatgaaatttctgtaaaacttgcagatgtagaaaatgattttgcaagtctagaaaaattagcagtaaaaggggaataa

SEQ ID NO: 830 - DNA, 741 bp, Unknownn
  isolated from dental, unidentified
atgaaaaaaaataatttaatttactggatcgttgcgattatcttagtgggaattgctggatggagtgcagtacatatgcaccacttggaaagtaaaaatgctgttaaggttagtcgtgaaatgaagataagttctagtattagccgacatataaagaagattactaaagaacagaaaaaggctatgcgcaaaaaagttgattggaacaagccatcgatgactaaggcatatccagatgtttctaagtataagaatgtgaaaaaatctaaccgaattagattggtagtatcttcagctaagcaaagagtatatgttatgagtggaccttatgttttatatacaatgtatgcatctttgggtaagaactatgattctaagacccctaactatcaagtaacacctgtaggaaagtttaaattagaagaagctcgtggagataaattctatgatgctacacgccaattaggtgggttacactggacttcttttaagggtaaaggtatgtatcattttcaatcagtacctgttgatgaaaatggaaaagtaattgaaaaagatgctaaacatcttggtagtacaaaaatcactaagaagaataatattaaagcatatggttctatatggttaactgtaccagatgctgaatggattcaaaagaatttaccagttgggactaaagttttaatctatggagaagatgctagttctgataactttatagcagataatgctaaacattaa

SEQ ID NO: 831 - DNA, 1389 bp, Unknownn
  isolated from dental, unidentified
gtgattattgtgagtgaaacaatagaaaattatatttattgccgtgttatttttgaagaaaatggaaaaagctattactatctaacagatgatgaagaaataaagcctttagatttagtagttgtgccggttggtattgatgggcatgaaaaaatagcacaggtgataaaagtagaaaaatatactatacacactgttccatatcctttagataaaataaaaaagattattcgtaaatgtaaattaacagattttagaaaattagaaaataaattagctgaagataagttaaagcgtgaatcaatagatgatgaagagttatcaattgatttattgaacttaggagtacaagcttatcgtcgaggagattatgaaatagctaaagaatattatgaggatgcggcacaactaggaaatagtcaggcagcctgtaatttaggttatatttatgcttatggaagaactggtgtaaaagatagtgaaagagcattttattattttgtccaagcatcattagatgggaatagtaatggtagttataaagtaggcgatgcatatttttatggtgattttgtagaaaaaaataaattactagcatttaaatattatcaaatatcagaagaacaattagggccagaagatcttgatattcgttcggatatttattatagattggcactctgttaccaccaaggcgcaggggttgttcctgatgatatgggtgccttaacttatattaatttggctcaaacaagtgcttattatgataggttaattggaaagtataattatgaagagttaaaaagaaaaattgaaaatttgcgtgaaaaaattctattaaatttaaatcatgtagataataaaacaaagattagattattgaaagcagacataacaaaagttgataatgttgatgcaattgttaatgctgctaatactagtttattaggtggtggaggtgttgacggtgctattcatcgcgtagccgggccattattattaaaagaatgtcgccaactaaatggttgtgaagttggacaagctaaaattacatcaggatataatttacctgtggaatatgttattcataccgttgggcctatttggaaaggtggtaatgctgatgaatcccaactcctagccgcttgttatagaaatagtctacatttagcccaaaaatgcaatattagaaaaattgcatttccagctatttcaacaggaatttatggatatccagttgttgaggctactaaaattgcatttcaagttgttaaagaatatgtccaagataatcctggagactttgatttagtagaatttgttttgtttgatgatagtacttataatgtttatctgaaagaaacaggaagtaatttgatagaattgtaa

SEQ ID NO: 832 - DNA, 1044 bp, Unknownn
  isolated from dental, unidentified
atggcagaaagaattttagatgttaaaaatttaaaagtggatttccacacctatgccggcgaagttaaagccatccgcgatgtgagtttccacttagataaaggtgaaaccctagcaattgtaggggaatcaggttcaggtaagtctgttacaactaaagcaataattggtcttttagcaaataatgctaaggttgttggtggtgaaattaacttcaacggacaagacattttgaaaaaatcagaaaaagaaatgcaatccgttcgaggaaaagagatttccatgattttccaagatccaatgacttctttagacccaacaatgaaaattggacaacaaattgctgaacctctaatgaaacataaaggcatgaataagaaggatgcttgggcaaaagctcttgatatgttaaaggctgttggaattacaaatgctgaaaaacgtatcaatgactatccacaccaattttcaggtggtatgcgtcaacgtatcgtaattgcgattgcattggtatgtgatcctgaaattttgattgctgatgaaccaacaactgcgttagacgttactgttcaagcacaaatcttggatttaatgaaagaaatgcaagctaaagtaaaaacatctattatcttcatcactcacgatttaggtgttgtagctggtatggctgatagagtagctgttatgtatgctggagaacttttagaatatggtacagttgatgaagtattttataacccacaacatccatatacttggggacttttgaattccatgccaactttagcaagtgataagttagaatctattccaggaacaccaccagatttacttgatccaccaaaaggcgatccttttgctccaagaaatccatatgcgatgaagattgatgctgaacaaaagccaccattcttcaaggtatcagatacacattatgctgctacatggttgttacatccagacgctcctaaagtaacaccacctgaagaaattgttagacgtcagcaaaagtatgcagaattaatggctaaaaagaaagattaa

SEQ ID NO: 833 - DNA, 867 bp, Unknownn
  isolated from dental, unidentified
ttgactaaattatacggagcaattgaagccggtggaacaaagtttgtttgtgcagtggctgatgaaaatttaaatatagtagaaagggtttcaattcctacaacagtaccagaagaaacaatgagcgatgttttcaagttctttgaaaagcatgaagttcaagccattggaattgcttcttttggaccaattgatgttaatcgcaaatctagtacatatggttatataaccaatacacctaagccaggctggaagaactatgatttcttaggtgaaatgaagaagagatttgacgtaccttatgcatggacaacggatgttaatggagctgcttacggtgaattgaaaaaaggtgcagctttaggtaaagatagttgtgtttacttaactgttggaacaggtatcggtggcggtgttgttatcaatggtaaagttatcgaaggatacggacatccagaaattggacatatcattatgcgtcgtcatcccgaagataagtacgaaggaaagtgtccattccatcatgactgtttagaaggtttagctgctggtcctgcaattgaagcaagacaaggtggtgttaaggcttatgatattcctaaagatgataaggcttgggaaattgtagcatattacttagcacaagcatgtgtagatttaactttaactttatcaccagaaaaaattatttttggtggtggtgtttctaagcaagaacaattattcccaatgataagagaatcatttaaaaagcaaattaatgattatgttccaacacctgatttagatgactatatcgttcatgtagaattaggcgatgatgctggaattacaggttgcttcttactagcaatggaagcagaataa

SEQ ID NO: 834 - DNA, 1527 bp, Unknownn
  isolated from dental, unidentified
ttgagtatacatattccagtacaggcggatgataaccgaccagttttgttagtgtatgatagtgaaaatatctattataacggttctaaaaaaatcgattctgtgcaaagaatgttaacggcagacggattaaagataaaaacagttatgttagaaaattaccgaagtggagaattgagcgacaacaaatatcggggagtagtaactctgattaattggcaggaagctgatttaagtaatgatagctttacacatgatagagctaaattctcaggtactaaattgcatattgggcctaatttacaagatgatgaattagaaggcttacatgcaaaaaaaggtatgattattaggcagcagttaacactgtcagatgatggaataacagaacagataccatatactaatcgaatggaatatttggtagacgttgctggtagtgacaaatatggtgttttgaatacgcaaaatgtaggaaatcaaaaaactttaccatatggggtcaaagtagatagtaatgccttcctaccattttggaatactagtggtttagcagttaattgtgaagagaaattaattgctgatttgtttaatacgaagacagatagtaggccattattagtaattaataatgttacaccaacaagtaatctagaatatcttgataagttagttgatgatttatatcgtaataatattccttttgcagtcagtgcaactaatgtcgaaggtaataccaatcaatttgcttataagaaatatatgtattctttaagaatgattgaattgaaaaatggaattatttttatgcgagtaccatatttatattcctatactggcaaagaaattaatgcgcagaatttaaaggcaacaatgagtgaacgtctgcaattaatggtaagaagtggtgtttatccaactggtttatctacgcctaatcattggaatcaggatgcagttttaggaaaagtcggattaaaatcagcttctaatgttttactattgccagatcctaaaacatatcccaaagttgagcaaacagattatagtcaagaattcgataaggcatattatgtaatgtctttaaaagatttggataaagctaaaacgacggtatctttgactaaagcaaataatttaaattacactttaccgacagcattgaatataaaaatgccacgaacattgtcggaattacgtaaggttgagaagagtgtttcgaaatcagaattaaattgggaaaatccagctgcagaagataattcaagggaaatgaattttgcaaaaatgaagttggaatatcacgcgggaacgtattttgttaatggtaatgaacaaaatattaacgatacagctccagttcaaaagaaacataaacacaaagaataccaagaaactggtttgaatttaatcttatcttatcaaggtaaattcttaacagtcttcattttagtaactttgataggctttgtcttacttatttataaaggtcgcaaagtttattgggataaatttaaaagaaagtag

SEQ ID NO: 835 - DNA, 1323 bp, Unknownn
  isolated from dental, unidentified
ttggaagaactttttgaaaaagctccagtcaaaaaagtctactatcaactagcattgccagtagtgtttagtatgatcattagtatgttatataatatcgctgatacatattttgtcgctaagactggaaacactgatttagtggcaggaattactgtaagttcgccactatttatgtttatgctagcaattggtgacatttttggcttaggtggaagtgccttaatttcaagactatttggacaaaaacgatatgaagaaagtaagcatgtaagtagctttagtttttatggagatataatttttacgattattttgacagtattgttattagtttttgaagcacctatcatgcatcttctaggggccaatgctcagacttaccaatatgcagctgaattttatcgtgtattagtaatcggctcggtttttatcacattatcattagttccaggtaacatgattagaacagaaggacttgcggttaagtcaatgatagcgacaatttctggaacagtactagcaatcattttagatccgatttttctatttggatttaagtggggtgctgctggggtagcatttgctaatgttttagggtatgcactaaatacaggattactaatctactttacttggaaggatagtaagtttttgtcatttaatcctaaatacattaaagtcagctggcatcattttaaagagattatcgcaatcgggattccaagctctgttactaatttcatgcaaacatttgggatggctttactaaataactatcttgttatttatgggaatgacaaggttgcggcgatgggaatcacgcaaaaggtgtatgggattgtaacacttgtcttggtaggttttgcttttggagctcagccattaattggatataactatggggctaagaatgcaaagagattccgagaagttttgcgttatgatttcaaggtggaagtagtttatgcgattattgcttccttgatcttgattgtactttctccattcgtaattaagttgtttatgaataatccgcaaatcattgctgatggttcctatatgttgagagtctgtctactaacaacgccatttattggagctatcttggtttatactactgtttttcaatcagctgggaaaggctggagtgccttggtaatgtcaatttctcgtcaaggtgtggtgtattttattagtatggtagtaatggttaagattctcggctaccatggagtagtaatggcacaaccagttgcggacattttaacttgtgcaattggttatttaatttatcagagagattttcggaaatttaagtaa

SEQ ID NO: 836 - DNA, 708 bp, Unknownn
  isolated from dental, unidentified
atgaatgctaaacttaatcgtaaaacagcaattaaagaagttcttcctactgcattcggctacattggtattggaattgcttttgggattgttagtaaagctgctggtttgtcggctttgcaagctggtcttatgagcttgattgcctacgggggatctgcacaatttattatcgtaagtatgctgttagtacatagtcctattatttctatcattacagctgcttttctcgttaattcacgtatgattttaatgagtttagtaactgctaaatacttcaaaaacgatagcatgttacataatatcctaattggatctttgttaacagatgaaagctttgctttggcaatgaataaactcaactatacaaataataaactcaattttgcttggtttgacacagccaattggttcgcatacttcgtctggtttttctcttcagttttaggtgctttagtgggaaattttatcgaaaatcccactaatctaggaatcgattttgccttagtagctatgtttataggtttgttatacctacaaatgatttctgataagtcattaaaattaagtctacagcttttagtagtagttgctacctttatccttgtttatttaggacttatttttatacctagcaatcttttaattattattatcacattattagggtgtgcagtagggatggtgttgaaacatgtcttcttttaa

SEQ ID NO: 837 - DNA, 1332 bp, Unknownn
  isolated from dental, unidentified
atgaatagtgaacaaacatatttttttgtaggaattaaaggaactggaatgagctctttagctttaattttacatgataaaggatataaggttctaggatctgacattgataagtatactttcacacaaagaggcttagagaatgctggaataaaaattttaccatttgatgaagataatattaaggaagatatgatcgtagttgctggtaatgcatttggtgatgatcaagtagaaattaaaaaagctcatgagatgggattgacagtacaaacatacccagaaacagtagaacaaattattgaagaaacaacaagtataggtgttgctggtgcacatggtaaaacaagtacatcaggtttactagctcatgtattaagcggagtatcaccaacaagctatttagttggcgatggttctggtaagggaactcctaatgcacgtttcttcgtttttgaagcagatgaatatcgtcgtcatttcgttgcatatcacccagattatgcgattatgactaatattgattttgatcatccagattatttcacagacattgatgatgttagagatgcatttgaaacattggctatgcagactaaaaaaggaatttttgtatggggcgaggatgaaaacttgcgtaaacttaatgcaaaagttccagtgcattattatggtactaagtcagatgatgattttagagctgaaaacattaaacgtacaacgaagggttctaattttgatgtctatttccatgatgaatttattggaaattatgatattccaatgtttggggaacacaatgttttaaatagcttagctgtaattgctgtttcatatatggaaaaagtagatcaacaagaaatcgctaaagaattgttaacatttaagggtgttaagagacgttttacagaaaaacgtgtggcagatatggtaattattgatgattatgcacatcatccagcagaaataaaagcaacaatagatgcagctcgtcaacaatacccagataagaagataatagcagtattccaaccacatactttcagtagaacaattgcgttaatggatgaatttgctgaaagtttaagtttagcagacaaagtttacttaactgatatctttagttctattagagaacatgatggaaaagtttcttctgaagatttaggtaagaaaattagtaaaggtggagaggttctaaaattagataatatgtcccctctactagatttccatgacgatgttgttatttttatgggagcaggagatattcaaaaatatgaacatgcatatgaagatttgctaagtaatttgagtctaaaaaataactaa

SEQ ID NO: 838 - DNA, 684 bp, Unknownn
  isolated from dental, unidentified
atgagaaagttctttttaagaagacgaaatattaagattagtgaagaaaatatcgctgagtatcatagaagaactgaagagatgcagaagaaacgtcattcttatttgaaacaaagattagaagctttaaatgacggaataattgcaattattattacgattatggtgttagaggtgccattgcctaatgggcaaaatatagcatcttattacaattttttaggtagtctatctgtgtttttggtaagtttcttcgttgtagctaatttttggtacgaattaggacaatcattggcgttggttgatgagattgataaaggaataatcatttttgattttgtttttctggcaactttatcattattaccgatactaacaaaatggatgatgcataatcctagtcagttagcagtggttaattatgggatagtctacatggtcgctaatttacttaaaacatggttagctcatagccaatttcgaaaagtactaggagccaaaaataatatttctgaaatgatgactaaagtgattattggtcgctttgtattaacagcagtatttaatttacttttgatagtagctgcttatttctatcctcaaattactttatatgcatacttggctttgccaattattgatttcttttttccagaagataaagcccctcaaaagaagttctag

SEQ ID NO: 839 - DNA, 1254 bp, Unknownn
  isolated from dental, unidentified
atggattttaagaaattagaccctgaattatggcaagccattgcaaacgaagaacaacgtcaacaaaacaacatagagttaattgcttctgaaaatattgtttcaaagaacgttttagacgctcaaggaagtgtattgactaataaatatgctgaaggttatcctggacgccgttattatggcggatgccagtttattgatgttgtagaaaatttagcaatcgatcgtgcgaaacaactttttggtgctaaatatgtcaatgttcaacctcattcaggttctcaagcaaacgctgctgcttatatgagtttggtagagcctggcgataccatcatgggcatggacttagctgctggtggtcatttaactcatggttctccagttaactttagtggaaagacatataactttgttagttatggtgtcgataaaaaaactgaaatgctagactacgatgaaatagctagattagcacgtgaacatcagcctaaattaattgttgcaggagccagtgcttattctcgaattattgatttttctaaattcagagaaattgctgatgaagtaggggcaaaattgatggttgatatggctcatattgccggtttagttgcggttggtcttcatccaaatcctgttccttatgctgatattacaacaactactacacataagacactccgtggtccacgtggaggaatgattttaactaatgatgaaaatttagctaaaaaaataaacagcaatgttttcccaggaactcaaggagggccattagaacacgttatagccggtaaagcagctgcttttggtgaagctttaacacctgaattcaaagaatatggtgaacaaattatcagaaatactcaagaaatggcactatgctttgctgataatgaaaaagctcgtttagtatctaatggttcagataatcatcttttactattagatgttagaaactttggtttaaatggtaaagaagctgaaaaattacttgatcaagtaaatattacagttaataaaaattcaattcctttcgaaacacttagtccatttaaaacaagtggtattcgtataggtacgccagcaattactagtcgtggctttaatgaggaagattcatatcaagttgctaaattaattcttacagttcttgaaaataaagatgataaacaagttttagctgatgtaaaacgtcaagttaaagaattgacagatgcacatccaatttatgctgaagattcaattagataa

SEQ ID NO: 840 - DNA, 624 bp, Unknownn
  isolated from dental, unidentified
atgccaacagttgcattattcaaacaagatggtaaccaaaatggtgaagttcaattaaacgaagctatttttggtattgaaccaaacaataatgttgtttttgatgcagttatcatgcaacgtgcatcattacgtcaaggaacacatgctgtaaagaatagaagtgcagttcgtggtggtggtaagaagccatggcgtcaaaagggtacaggtcgtgctcgtcaaggttctattcgttcaccacaatgggttggtggtggtaccgtatttggtccaacacctcgttcatacagctacaaacttccacgcaaagttcgtcgcttagctattaaatctgttctttctcaaaaagttgcagatgaaagcttggtagtagttgatgcattgaattttgatgcaccaaagacaaaggcatttgctgaagtattaagtaacttaaatgtaaattctaaagtgttagtagttcttgaagatgacaatacaactgcagcattagcagctcgtaacttgaagaatgttacagttattcctgctaagggattaaacgtattagacgttatcaacaatgataagttagtcatcactcaaggagctctttctcaagtagaggaggttcttgcataa

SEQ ID NO: 841 - DNA, 1083 bp, Unknownn
  isolated from dental, unidentified
atggataagttatttaatagattgcagatgttagaagacagatatgaagaattaggtgaacttctatcagatcccgatgtaatttcagatacaaagcgttttacaaagttatctaaagaaatggctgacttaagagaaactgttgaaaaatataataaatataaagaagtaacacaacaaatttctgatgatgaagagatgctaagtgatggattagatgatgaaatggcatctttagtgaaagaagaattgtcaaatgtcaaggatgagaaggtaaagctagaagaagaaattaaaattttattactacctaaagatcctaatgatgacaagaatattattatggaaattagaggtgctgctggtggcgacgaagctagtttatttgctgcagatttattttctatgtacagcaagtatgctgaacgtcaaggatggtcaattgaagttattgataagaatgtaacagaagttggtggctttaaggaaatagcacttataattaacggtaatagtgtatggtctaagttaaaatatgagagtggtgcccaccgagttcaaagaataccagtaacagaatctgcaggacgagtacatacatcaactgcgacagttgttgttatgcctgaagaagaagatgtagaaattgagctagatcctaaagatatccgagtagatgtttatcgttcatccggtgctggtggacagcatattaataaaacatcttctgctgtacgtatgactcacttacctacaggtatagttgttgctatgcaagatcaacgttctcaacaacaaaacagagaaaaagcaatgaaaatattaaaggctcgtgtatacgactactacgctcaacaagaacaaagtgaatatgatgcaaatcgtaaatctgcagttggtacaggggatagatctgaaagaattagaacttataactatcctcaaaatagagttacagatcatcgtataggtttatcattaaataaattagaccgcatcatgaatggtgagttagaggatgttattgatgctttagttttatttgagcaaactaaagcaatggagaagttggaaaatgaataa

SEQ ID NO: 842 - DNA, 876 bp, Unknownn
  isolated from dental, unidentified
atggcaaagatttctgctgctcaagtaaaagagttacgtgataaaacaggcgttggtatgatggacgctaaaaaagctttagttgctgtagaaggtgacatggaaaaagctattgatttcttacgtgaaaaaggtatggcaaaagctgctaagaagagtgatcgtgttgctgctgaaggtttagcaaacgttgctgtaaatggtaataaggctgttattgttgaagttaacgctgaaacagactttgttgcacaaaatgatcaatttaaagcattagtaaagcatattgcagacgttattgctgaaaacacacctgctgatgtagaagctgctttacaattaaagacagataaaggtactcttaacgatgaattaattgaagctacacaagttattggtgaaaagattagtttacgtcgttttgaagttgttgaaaaggcagacgctgacaactttggtgcatacttacacgatggtggacgtattgctgtattgtcagtagtagaaggtgctgatgaagctacagctaaggatgttgctatgcacgttgctgctattaatcctaagtatgtaaaccgtgatgaagttccagaagctgaagttgcacatgaaaaggaagttcttacagaagaagctaagaatgaaggtaagccagaaaaaatcattgaaaaaatggttgctggtcgcttgaacaagttctttgcagaagttgcattggatgatcaagactttgttaaggatcctgatttaacagttgcaaaatatgttgcttctaagaatggtaaggtaaaatcttttgttcgttatgaagttggcgaaggtattgaaaagaaagaagaaaactttgctgaagaagtaatgtctcaaattaaataa

SEQ ID NO: 843 - DNA, 2172 bp, Unknownn
  isolated from dental, unidentified
atggataaaaaagtcttaaaattaactaatgctaaattaaagtacaatcctaaaaaaatagaaaaagtaattgaattgttagaagaaggaaatactattccttttatagctagatatagaaaagaactaactggaagtttagatgaagtccaattaagagaaatccaagtaacttaccaaagaaatgaaaagatagaaacacgtaagagtgaagttcttaagaaaatttcagaacagaataagcttacagaagatataaaaaacaaaataaataatgcaagtacccttcaagagattgaagatatttatttgccttataagaagaaaagaaaaactaaagcacaaaaggcagttgcaaatggattagaaccattagctaagtggttactgagagtaaatagcaatgctccaatggtagaagctaagaagtatcttaataaagaagtacctaatgaagaagttgccttaaatggtgcagttgatattttagcagaggcatttggtgaagaagcacaattaagagattgggtgcgaaagcaaatgtctagaaaaggagtattaattgctaaggaaaaagatagtgagaaagatgaaaatggcacctatgaagattactatgattttgaacaagtagtgtctaaattaacatcatatcgaattctagcaattaatcgcggtgaaaaagaaggaattttacgagtaaaaataaatacagatgacgattatgcgctaagatatttacattctagaataattggtagtaaggaaagtacaagtaatgactatgtagaaatggcatatactgaagcgtataaaaaatttatcaaacctgccattgaaagagagcttcgagcaactttaactgaaaaagctgagaatgaggctattaaagtttttggtgagaatttgtacaatttattaatgcaagctcctttgaaaaataaaattattttaggaatggatccagcatttagaactggttgtaaattagcgattattgatgagactgggaaatttttagttaaagatgtgatttatccacatgaaaagcataaaggtgaaaagcccaaccttaaattaagaaaagaagctgctgaaaaattagagacgttgataaagagatataatgttgacatgatagcaattggaaatggtacagcaagtcgagaatcagaaaaatttgtagcagaagttttaaagaagatagataaagaagtatattacgtaattgtaaatgaatcaggagcttctgtatattcagcaagtaaagtagcaagagatgaattcccggattttaacgtagaagaacgttcggccgtaagtatagctcgaagattgcaagatcctttagcagaattaataaagattaatcctgaatcaattggtgtgggacaataccagcatgatttaccacaaaagcaattagatagcgaagttgaagcgactgttgaaactgcagttaataaagttggtgtgaatttgaatacagccagtatccaattactaacctatatttctggattgaataaaacaacagctcaaaatattattctttatcgtgaagaaaatggaaaatttcaaaatagaaaagagctaaaaaaggttcctagattaggtcctaaagtttatgagcaggcggcaggttttttaaggattattgatggaaatgaggctttagataatacagatatacatccagaaagttacatgctagcagaaaaattgataaaagatctaggtattactaaagaagacatgggaactaacactataaacgataagttagcgaaatttaatgttgaaaagtatgcaatagataatgaattagaagtaataactgttaaagatatcgtaaaaagtttgatgaaaccagggcgcgatggtcgagaaagtatgccaatgcctttattgaaatcagatattttaaaaatagaagatttaaaagcaggaatgcaactagagggtacggtaagaaatgttgttgattttggagcatttgttgatattggtgtaaaacaagatggactagtgcatttatcaaaattaagtaagaaatatgtttctaatccacgagatatagttgcggtaggacagatagttactgtttgggttgaagatgttgatttaaacagaaagagaattcaattaacaatggtaaatccaaatgaataa

SEQ ID NO: 844 - DNA, 1293 bp, Unknownn
  isolated from dental, unidentified
atgaaattagtaggaattatcggttcaattgccgatgaatcatataatcgtaaattaatgctatacatagcaagccattttaaagaaacaattgatattgaaatccttgatattagagatgttccaatgtttagagcagggatggaaatggggccagctgtagaatatttagataagaagatttctgcagcagatggtgtaattattgcaactcctgaacataatcatacaactacagctgctttaaagagtgtgattgaatggttatcttcaagtgtccatccatttgcagacaagccagtattgttggtaggtgcttcttacttcgaacaaggttctggtagagcacaattagatctacgtcaaatcctagaatctccaggggtaaatgctttggtaatgccaaaggatgaattcttattaggaaacgttaaatcagcttttgatgaaaatggtaacttaaaagaagcaagaactgttagcttcttagaaagtgttatgggcaatttcttgaagtggatcaaagttttgaaagctatgaagaaaaataacgatgtaaaaggtgactgggaatcagaagacttaactgcatctcaagaaattgatacaaccgttaaaggtgtagatatgaaggctgaagactgggtagaacaagctgcagctaagactaatgcagttgaaggtgatacttatgtcaagttagacagaggtcttttgacagttaaccaacttaactggttcttgaatacaatgccagttgaattgacatttgctgatgataataaccaatttatttactataatcgtatggatgaaaatcctaaagatatgttggcacctcgtcaacctaagcaagttggggatccgttagaatcagttcacccagaacgtgctttgaagggtgtaaaacatgtggttcatacactgcgtacaggtgaaacagatcttgtaagcatgccagtaccatttatcaataaggttaatgaaaagcatgtaatgcactattacaaggcaatgcatgatgaagatggtcgttaccgtggaattaatgaatgggtagttgatatttggccagtagttgaatcttatttgaagatgacaggtcaaaaattagtagctgatgaaaatgcaaaagtagatgcaacatccggagcttctgagaaaaaagaagaaccagtagctacacctgaaacagacgcaacatcaggtgcctctgaatcagaaacaaaggtagaagaagtaaaagttgctgaaccagaagtagatgcaacatcaggtgcttctgaatcttaa

SEQ ID NO: 845 - DNA, 1221 bp, Unknownn
  isolated from dental, unidentified
atgaagtttatagagttattgagaacagcctttcaatctttgaaaactaatcggaaaagaagctttttaacaattatcggtataatgatcgggattgctgccgttattacaattctgggcatgggtgatggtgttaaaaagacaatgtatgataagtttggtaattctaaacaaggacaacaaacgacagaaattggatattcttcagtagacatgggatcgacagtacatggctttactgaagaagatattgctaatattaagacggaatttggttcagaatttaaagatgtgaagatagaacatgattcattaatcaattctaagatgactattggcgatgaggaaaaatctgtaagtattaatttagaaaagaaacctgaaaagtcgattgacttaatagctggtagagagattactaaacaagacttacagatgaaagagccagtagcgatgataaaggaatccttggcaaaaaaagaatttggaactgctcaaaatgcagttggaacttcaatttcatctaatgagacaacttatcgtattattggtgtttatggtggcggaagtaaatatgatcaatatgggacattaagtgcaaaaggaactgatgttgttgttccatataagttatactacgatggtcaaaatgccaatgaaggtgatgtaattaaattaacattccctcaagatgctccggcaagcaaggtatctaaaaagattgctaagtatcttgaaaaaaatggaagtgccatgaataaaggaacatatacatattacgatatggaaaaagaactaaaggcattttcttcacaaattaatatgataacaggatttatcagtttaattgcggcaatttctttgttcatcgctggaatcggcgttatgaatatgatgtatatttcagtttcagaacgaactcaagagattggtatccgattagcggtaggggcaactccaactaatattatgttacaatttttaattgaagcgatggttctgactgtaactggtggtctaattggttttgttttaggtgcaggcttatcacatctactggcaccattgctaagcctaggtggaggaattaaaatcaaagcacatgttacgctaaatgccttcttattagcgtttggagtttctagtgctgttggtttgatcttcggtatattaccagctagacaagcagcaaataagaatttaattgatatattgagataa

SEQ ID NO: 846 - DNA, 813 bp, Unknownn
  isolated from dental, unidentified
atgactgccacagtattatcatttttaaattttaaaggtggcgttggaaaaactagcgctactgcattagtaagttacaacttagcaaaaatgggtaaaaagtgtctagttatagactttgaccctcaggctaatattactgccctatttttaaaaactaagtatcaaaataaagataaagttgcaactattgaatcatcattaatgaccgctttgaatagagaagaaagtttagattcaataacgattgaaattgaagacaacttataccttattccaaacgctgttgactttagtatgtatagtcgttttttggaaagaaactttatggatgaaaaagaacgtattggtttcttcaaaaagaaagttgattcattacgtgataaatacgactttatcttcatagatgttccaccaacaatttcattaccaaacgatacagctttctatgcatgtgatcaaattattgtagttcttcaaactcaagaacgttcgttgcaaggtgcagaagttttgattgagtatttacaaaatagtattgttgatgcatatgattctaaagttgatattttaggaattttgcctttcttatcaaaaagaagtgctagcgtagataaagaaattttggatgctgcttcagaagaatttggtgatgaaaatatctttaatgcaaaaattatgcaaatggaacgtgttaagagaatggatatgacaggaattaccgataatccaagtgattcgtgggataagaaaacacatgcagctttcaagggagttgctaatgaaattttagaaaggttaggtgaagaataa

SEQ ID NO: 847 - DNA, 1140 bp, Unknownn
  isolated from dental, unidentified
atgaaattttcaattcaacgagcagcatttatcaaatatttaaacgatgttcaacgagcaatatcatctaaaacgacaattgatattttgacaggattaaaaatggatttatcaaaagatgcattaactttaactggtagcaattcagatatatccattgaaacaatcatttcaattgcagatgataatgctgcattacaaattgaacaagaaggtgcagttgttttacctgctcgtttctttagtgaaattgtaaagaaattaccagaacaaacaatgacaattgaaattaacgaaagatttcaagcaacaattacttctggatcagcagaatttacaattaatgggttaaatgctgaagaataccctcatcttccagaaattgattcaaaagatcaattaactgttcccggcgatatactaaaacaagttattagtcaaacagttattgctgtttctaatcaagaaagtcgccctattttaactggtattcatttggtaataaagaatggagaattacttgcagtagcaactgactctcatcgtttaagtcaacgtatcatcaaattgtcaggtgctgacgatgcggtttatgatgttattattccaggaaaatctttaagtgaattatctaaaatgatttctgatagtgacgaaaacattgaaattcagatctcagaaaatcaagcattattcattctaggcaatacttctttctacactcgtttactagaaggaaaatatcctgatactgaaagattaattccaaaagtttcagaaattacagttgattttaatgcagtagaattacttcaatcaattgaacgtgcttcccttctatctcatgaaggtcgcaataatgtagttaaattagcaattaatccaagtgtacaaagtgttgttctttcaggtaatactcctgaagtcggaaatgttgaagaagaattacattttaaaaatttagaaggttcagagttagaaatttcatttaatccagattatatgaaagacgccctacgttcatttggtcaatcagaaattacaattgcgtttacacaaccattacgtccgttcacaattgtaccaacagaagataaagataattttgttcagttgattacacctgtgagaacattctaa

SEQ ID NO: 848 - DNA, 969 bp, Unknownn
  isolated from dental, unidentified
gtggtagcatttttaacttcagtatctagtgtagttgttatcgttttgatgatggcattaggatatattttacgaaagaatggatggtttgacgattcattttcaagtaatatttccaaattaatcacacaaattgctttaccagcttcaatttttatttcagttcaagatcatttgacaagagatggcttaggcaatttattccaaggattactatttccagctttaggagtagtaataggttatatcattgcttggttaacagttaagatttttaaaattcgtccaggtcgtcgaggcatctttatgaacacagtagtaaatgccaatacaatttttattggtatgccattaaacaatgctttgtttggttcaaaaggactatcttactttttgatttactatattattaatacagtttcaacctgggcatttggtgtttatttaatttacaatgatgatccagttgctaaaaacaaaaatgcagctaaaaagattaattggcgtaaattattaccaatgccattggtaggtttcattgttgcaattttatggttattgactggtatcaaagttccagcatttgcggctcaaacattgacatatgttggtggtttggtaacaccattatctttaatttatattggtattgtactttgtgatgcgggattgaagaattttaaagttgaaagagacacaattttaggtttaataggaagatttattctttccccacttgtattaattttacttataaaatttgttgctccagcagcaggaattcacatggtaagtttaatgagagaaacatttatcgtgcaagctgcaacaccagcattggcagtcttaccaatcttagcaaatgaagcacatggcgatgtaaaatatgccactgacattgttgttatgagtacagtattattcattgtagtagtaccaatcttaatgacaatcatccaatatatatag

SEQ ID NO: 849 - DNA, 996 bp, Unknownn
  isolated from dental, unidentified
atgactacaattagagatgttgcaaaattagctggtgtttctccatcaacagcttcaagagcgatgcacgatagtaatttaattagtgaaaagacaaagaaaaaagtaagaaaagcaatggaggagttgaatttttctcctaattacgctgcacaaagtttggccaatagattttcaaaaacaattggggttattttaccaataagagaagaatccgttggtaataatccattctttattcaaatacttcaaggaatttcgactatttgtaatgcacatgattatatagtttcgttagcgacaggccaaaaagaagaagagttaatccaaaatatagataatttgataaataggggtaatgttaagaactttatttttctttattcgaaagaaaatgatgcgattctagaatatgttaagaagcaaaaagatgtattttatgtgattgtgggtaagccatatgacaatattgaaagtacatcatatgtggataacgataatattcaagctagtagcgatgcgactaattatctaatcaataagggacatcaaaatatatgctatgtatatactaatctagacgaaatggtacaagatgatagatatgtaggatataggctagcggttaaagaaaaattatttaattcatataaattaaacttttcaagtgataatcgggaagaaaataaggaaaagttattaacttttatcaaagcaaatccacaagtaaatgggattgttgcatgtgatgatataacaggattaactgttcaacaaatattgatagaatctgggatagatttagaaaagtatgaaattgtaacatttaataattctatctatactcaaattgctaaacctatgataactgcagtagaaatttttccaagatttttaggatcagaagcagctgtcttagcaataaataatgggcaaaaaacattagatgtggggactaaacacataattgttccacataaaattatagagcattaa

SEQ ID NO: 850 - DNA, 1293 bp, Unknownn
  isolated from dental, unidentified
atgaaaagagaaattccagtaaatagtgaaggacattacacaattgggggacttgactctttagaactagctaaagaatttggaacacctacaattgtctatgatgttgctaaaatcaaagaacaaattgcaaagtttaaagcaggttttgaagaagaaaatgttaaatatcacatttcttacgctagtaaggctttttcaagtttagcaatgtatgacttggtagctaagagtggtattggaagtgacattgtttctggcggagaactttatgcagctttaaaaggtggaatggatccacaagagttggaatttcatggcaataataaatcccgtgctgaattagagatggcagttgatagcaatgttggttatataattgttgataatttttatgaaattgatttattaaatgaagtacttacagaaaagaataagacagctaatatcctattgcgtttagcaccaggtatccatgctgaaactcatgaatatatttcaacaggtcaagctaaatctaaatttggttttgacttacaaagtggacaagcaagtgaagcattagaaaaaacattggctaaccctcgttttaaagtactaggtgttcacagtcatattgggtcacaaatttttgcaactgatggttttgtagaagcagctaagaaattgatggacttcttaagtgcttggaaggaaaaatatgattttacagctgaagtgcttaaccttggtggtggttttggaattagatacactgatcaagacgaaccattagatgtaaaagactttgttaagatcattgtagaagcagtcaaagaaaagagtaaggaattaaactatccaatgcctgctatctggattgaaccaggtcgttcagttgttggtgaggctggtgtaagtttatacacagttggctcacgcaaagatgttgaaggtgttggaagctttgttgcagttgatggtggtatgggtgataatattcgaccagctttatatggtgctgaatacgatgctgttttagctaaagatcctaatgcaccaatcgcacaaaatgcttcaattgtaggtaagttctgtgaatctggagatattttgattaaggattatgattttcctaagacagaacctggcgatgtgattgcgatgttatcaactggtgcttacggctatgttatggcaagtaattataaccgcaatccacgtccagcaattgtttttgttgaagacggtaaagctcgtttggttgtaaaacgtgaaagttacgaagatatgattcgcaatgaaattctttaa

SEQ ID NO: 851 - DNA, 1335 bp, Unknownn
  isolated from dental, unidentified
atgcaagaatttaaaaatataatcattggatttggaaaaggtggaaaaactttagctaagaatttagctgctaaaggagagtcggttttagtagtagaaaagtctaagaagatgtatggtggaacatgtattaatattgcttgtttaccatcaaaaaacttgatcattaatgctcaacgtggaattaaatttgaagatgctgttaagcaaaaagatgaaatgacaacagctttaagaaataagaattatcatatggtcgcagatgaagaaacggcaactgttttagatgggacagctaaatttgttgataaccatacgattgaaattgttttggacagtggtgaaaagactaaaattaagggtgaaagaatctttatcaatactggagctactccgataattccacaagttaaaggtttgaaagaaagtaagtatattttagattcaacagcagctatggatcaaaattctttaccaaatgaattagtaattttaggtgctggttatattggtatggaatttgcttcaatgtttgctcgttatggggctaaagtaacagttttagacactaacgaaaaattcttaaagcgtgaagatgatgatatatcagaaatgatttttaatgacttaagtcaagatggtattgaatttaatttgggagtaaaagttgtagaagttagagatctatctgataaggtggaaattgtttacgaaattaatggtcaaaaacgaactgttaaagccgataaattattggtagcaactggaagaaagccagtaactgaaggtctaggattagaaaatactgatattaaactagatgaacgtggggcaattaaagttgatgattatttaagaacaactgcagaaaatgtatgggcaattggtgatgtcaaaggtggacctcaatttacttacatttctctagatgactttagaatcatttttgaccaactttatggaaaaggtgaaagaaaagttagtgatagaaagtcagttccttatagtgtcttcactacaccagcactatctagagttggtttaaatgaagtggaagctaaaaataagggaattgagtataagctatttaaattggcagctacttccattccaaaggctaaagtaataggaaatacccgtggaatgtataaaatcttggtaaatccagatacagaagaaattttaggtgcgacaatttacggtgaagaatcatatgaagtaattaatttaattgcgttggcgatgaaagctaaattaccatatactctgttaagagaccaaatttatactcatccgacaatgacagaagcattaaatgatgtattaaaagattaa

SEQ ID NO: 852 - DNA, 528 bp, Unknownn
  isolated from dental, unidentified
atgaaagggttgttatacttggaagatttaacatgtagacaaactctagctattactagccatcgtgttttagctagtgatttaaatgaacatgaaaccgtatacggtggtagactcttagaaatgttagatggcactgcctccatttccgccattcgtcttgctagagctagcaatgttacagcatcagttgatggacttaattttttagcaccatttatccttaatgattctttatgtatcgaatcatacgttagtggcgttggctctcgttcaattgaagtttttgcgaaaattatcggtgagcatttaactactggcgaaagatttttaggattaacggcatttttaacttttgttgtaccagataaacaaattattctaccccaaattactcctataactgaagaagaaaaaattatttgtgctggatacaaagatcgtaaactagaaaaatctaaaaaatttgctcgtcaaaaagaattaaaccagcatatatctttacatttaccttgggataagaattag

SEQ ID NO: 853 - DNA, 423 bp, Unknownn
  isolated from dental, unidentified
atggcagataatatcgtcttaaaaaacgaagaaacaaatgatttaggtagaatagagatggcgcctgaagttttagaaattattattgggattgcagctgctaaggttgatggagtttactcaatgagaggatcattggccaataatatttctgcacttcttggtcgtcaaaatcgtggtaaaggtgtaaaactaagtaatacagatacagatttagctgttgatgtatatactttccttaattatggtgtctctgttcctaaagtagctaatgaaattcaagaaaaagtacgacaacaagtattgtttatgactggaatagaattagcggcagttaatgttcatattcaaggtatggttccggaaaaagaagaacctacagttgatcctaacaacctgtttgaagaaaatggtgacgaataa

SEQ ID NO: 854 - DNA, 1500 bp, Unknownn
  isolated from dental, unidentified
gtggagattttggaaggaaataaaaagaaaatcacgacatttggcttagtcatgatgattattaccgctatctttggctttggtaatgtatctaatgcttatgcacaaatgggttacggtagtattatttggtatattttagcaggggtatgtttcttcttcccttgtggtttaatgatggcagaatatggttctgcatttaaagacgctaaaggtggtatttattcctggttagctgaatcaatcggagaacgtgcagctttcattggaacctttatctggttagcatcttggattgtctggatggtatcaacagcttcacgtatttggataacattctctgcattgatttttggtaaagatactacacaacattggtcaatgttaggtctatcgtcaactgaagttattggtattttaggaattttattcattttaatttcaacattctttaccacacaaggaatggattcaatttctaaagttggttctttaggtggaatttttacagttgtaactaacattatctttttaattgctagtttaatcattatttttgctaatcatggtcaattagctcaacctatccatggaatgaaagattttattacttcacctaatccacagttccaaacaccaattgctattatttcatttgttgtttatgcaatttttgcttatggtggtatggaatctttaggtagtgtaactgatagtatggataagccggaaaagactttcccacgtggattaattattgctagtttatttaccattggtgcatatgtaatcatgatctttatgattggtttcagtgttaactataactctgttgttgctaagcatggggtaaacttaggtaatatcacatatattgtctttaaccaattaggtgtctacttaggacactcattaggttggtcagcagctgcatctcatacaacaggtatgttaattacaagatttgtagctttaacacaagttctaggatttttaggtgcaatgttcattctcttatactcaccaatcaaatcatttattttaggttcagataagagattatggcctgaaaaattaactcgccttaacaaacacaatatgccagccaatgcaatgtggttacaagcaattattgtttgtgtaattatcttcttagtagcctttggtggatctgcagctcaaagattctatttaatcttaactgatatggcaaatgtatctactagtttcccatatctattcttagttggggcattcccattctttaagaaaaagaagattgaacattcatttgtagcttttaagaatccattctggactaatttattagtaattattattgaaattattttatcagcaggtattatctttacttgtgttcaaccaattttggatggcgactttgaaacagccttctggacaattgctggtccagtcttcttcggattagtggcattcatcttctatcaagtttcatcaaagaaacataaaatgaaataa

SEQ ID NO: 855 - DNA, 1335 bp, Unknownn
  isolated from dental, unidentified
atgtttaatcaagtagtaattcaaatgggcttttggacagcctggctagtgataccggcagtattcgaattatcaccagcaattgttgctttttttagaaatcatttcagtaaaatttcctcaaagcaagaataccatcctggaagaatgccacaattaacagttattgtacctatatataattctggggacaccttatatgattgtttaaaatctattgctgaatcaaattatcctaagcatttaattagtattatttgtacaaataataaaagtacagataatagttttgaagtatacaaacaagctcaaatggattttagaaatgttcgtatgcagtggcttgaagcaaatcaagggaaagctaaggccttaaatactgcaatttatggcagtacaggggattatgtttttaccattgatagtgatggtactctttccaaagatgcattacttaatatggctgttaactttaataaacatccagaagttatggcacaaacggggacaatcttgagtaataatgaattaatcaaaaattctaaaaagcatcgtctccttcgcctagaagaatattatgaatatgcaatcgcatttttagcagggagaacagtagaatctaaagatgatcaaatttttacaatgtctggagcattttcagcttttaggcgttctgctttaatgcaatcacgcttgtataatgtagaaactgttggtgaagatacagatatgaccttccaaatacgttattatttaaagggaagagttatgttatgtcctaatgctattttctatgttgaacctatttcagactgggacgagttatacgtccaacgtcaaagatggcaacgcggagaaattgaagttatccgtacttttttgagtgaaaagcttaatttaaaaagaatttggagtaatttcattgttcgaagacttttagttgatcataccgtagcttttctgaaagtaatctggctatttgcaatcttcgttttaattccatttggctattcaccaattttaattgtaatgtcgctattgttaatgtatctgttatacttattcatcggctttttaaatttcactaatgttatgcattatttgaaatttgatcctattgaaagaaaatatttcagaaatcattggtgggtaacgtttatgatgcctatttacaaccttattgttagtttctttagagttatgggcgttattaataccatgctaaaatctggaaaatggcaaacagataattttaaatctgaatatttagccgctaaaaaagttattaaacaagatctaaagagaggaaagcgtactaatgggaaaaatttatag

SEQ ID NO: 856 - DNA, 1137 bp, Unknownn
  isolated from dental, unidentified
atgaatgaaatggataaaatcaaagtattagcagatattgttgaaatcccatcagtaaacgatgatgaagtgagtgtagctaaatatataagggatttatttgcaaaatatggaatcgaatctaaaattttaaaagttaaaggaaacagggccaatttagttgcagaaataggagaaaaaggtcccattctaggattctcagggcatttagatgtagttgcagctaaggaaagtgatggttggcatagtgatccatttaaattagttgaaagagatgggaaactttatggtcgcggaacatcagatatgaagtctggggtagcagcgatgatcgtttctttaattgaattgcagcaaaaaggattaaaaaacggaagaattcgcttgatgctgataatgggtgaagaaataggggaagaaggatcagcatatttttacgaacatggctatatgaaagatgtttctgccttagtgattagtgaacctacgtattacagaataatttatgcggaaaaaggttcattagatttgaagattacttctagaggtaaagctgcacatagttcaatgccaaatcttgggtataatgctgtaaatccactaattgaattacttagtgaattaaatgaatttttcagtaatccaccaaaaaatgatgtattagggccacttacattcaatgtgacagtctttaaaggtggagaacaagtaaatacaattcctgattacgctgaagcggaaattaatgttcggacattacctaattttgacggaaatgatgtaattaagaagttagatgaatatcttgaaaagaaaaatgaaaatggcgctacattaacgagagaagttttaatgaatgaagatgcagtactaaaatcaccagattcagtaattgctgatttagctgctgaaattgttgaaagccgtggaagagaagtcgttaagaccattgcaccaggtattacggatgcttctaatttactaaaggaaaagaaagaagattatccatttatagtatttggtccaggtaatccattggtaagtcatcaagtagatgaatatgtggaaaagaaagcttatctagattttattgatatttatcaagagttagctgaaaaatattttattaatgattag

SEQ ID NO: 857 - DNA, 2145 bp, Unknownn
  isolated from dental, unidentified
atgaagataaaagatttttttgaaaagataaaggatgactttttagccaattctagaatttttggttcttggtttaagaaaaaatggacaagatatcaaggatggcgatggttaacaatagtctttttaagtatatttttcttaattagtagctatggagtttttttagccaaaaagacaaatgttagagggttgaaatcagcattacaaacctccactgagatttatgattataaaggacaaaaagcaggggcattatattcacaaaaagggacatgggtacctcttgataagatatctgataatgttcaaaatgctgtcttatctacagaagatcgtaatttctaccatgagtatggtttttctattactggtattggaagagctactcttttatatgctaaaaacaagattttacacagagattatataagtggcggtggtagtacactaacgcaacaacttgtaaaaaatgcatttctttctcaagaacagacattttcaagaaaaattaaagaaatatttattgctatgcaagtagaaaatgattactcaaagaaagatattttagcaatgtatttaaataatgcttattttggaaatggtgtttggggagtagaggatgcagctgagaaatattttggtgtacatgctagtgaattaagtgtgccacaagcagctactttagcaggtatgttaaagagtccaacagcttataatccaatagatcatccccaggcttcaagagatagaagaaatgtagttttgggattgatggaggataataaaaagttaagcgcagaacaagttagtcagtatcaagcaactccaatgacaacaaatgataactatcaatatacatctagttatagatatccatattattttgatgcagttattaacgaagcgatgaatagatatgggttaagtgaaacagatattatgaatagaggatataaaatatatacatccttgaatcaaaattatcaaaatgaaatgcaagatgattttgctgacagtagtttattcccatataatgcagaagatggaactaaagcacaaggggcatctattgctattaatcctcaaaatgggggtgtagctgcagttgtaggtggaagagaaggaactcatgtatttagggggtataatcgtggtacacaattagtaagatcgccaggatcaacgataaaacctctagctgtatatactccagctcttcaatcaggatatcattatgatactgatgtaaaagatgaattaaaggcatatggtaaagataagtatgagcctcataactggaatgacgtgtattctggagaaattcctatgtaccaggccctagctgaaagtaaaaatacttctgctgtatggctattaaataaaattggagtttctaaaggttataagtctgtcgaaaaatttggaataaagttaacttcagatgacgaaaatctaagcttagcattaggcggcttgaagaagggagtttcaccttatcaaatggctaatgcttatacagcctttgcaaatggaggaaaattatatactgctcattttattacaaagatagtcgatgcacagggtaaagtgattgtggataatacagagaacgattctaaaaaaataatgactaaaaaaattgccaatgagatgactagtatgatgatggatgtatatagaacaggtgggacaggtcaatctgctagtccaagtggatatacgattgctgggaaaactggttctaccgaaagtttaacagcatctaatagttcaaatgaaaacgatcattggtatataggatatacacctgatgtagtagtagcaacttgggtaggtttcgattctactaagtattcgttaagtgaagaaggtattagaggtggagcaagtctatttaagaatgaaatggaaggtattttgcctcatactgctggaaatacgtttactgttaaaccagcttcaactatggtagcccaagaaagtggagcttcttcgagttcatcaaatgtatgggatacatttagaaaagcaggtgaaacattagatgattcattctctaaatcagcatctgattggggaagtaaggcttcatctttgtttgatcaaggaaaacaaaaattacaagaatggtttggacaataa

SEQ ID NO: 858 - DNA, 1935 bp, Unknownn
  isolated from dental, unidentified
atggatcacaaaaaagttgctaaaaatgtagttgacgctgttggtagagataatttaatcgctgccgctcactgtgctacgagattacgtttggtacttaaagacgataagaaagtaaaccaagctgctctcgatgctgatccagatgtaaaaggaacatttaaaacaaatggacaatatcaagttatcattggaccgggcgatgtaaataacgtctatgatgaattgattaaagatacaggtttaaaggaattatctacagatgatttaaagaaagttgctgaacaaggtcaaaagtttaacccagtaatggcatttatcaagctattatcagatatttttgttccaattatccctgccttagttgctggtggtttgttgatggctttgaacaacttcttgactcaaccgggattattcggacctaagtcaattgtttcaacatctccagttattaagggcttatcagacatgattcaattaatgtctgctgctccatttatcttcatgccaattctagttgcaatctcagcttctaaacgttttggtgctaaccgtttcttaggtgctgctattggtatgattatgacttcaccagatttaggtaagactgctaaatactgggacatcttcggaatgcatgttgctcaaacaaactacgcttatcaggttattcctgtaatcgctgccgtatgggtacttgccttcttggaaaagagattccacaagtggttaccagcagctgttgacttcacattcacaccattactttcagttatgatcactggtttcttaacatttacagtaattggaccagttctaaaaactgtatctgatatgttaacaaacggtattgtatggttatacgacacaacaagttttgttggtatgggtatttttggtttaacatattctgcaattgttatgacaggtttgcatcaaagtttccctgcaatcgaaacacaattagttacagcatttgctaacggatatggtgccggtgactttatcttcgttgttgcatcaatggctaacgttgctcaaggtgctgcaacattcgcaatttacttcttaacaaaagataagaagatgaagggtctatcctcatctgctggtgtatctgctttactaggaattactgaaccagctttattcggggtaaacttgaagtataaattcccattcttctgtgctttaattggttctggtgtggcagctgcatttgcaggcttaatgcacattatcgcagcttcaatgggtgctgctggatttatcggattcctatccatttatccaaaatcaattccaatgtacgttgttgctgaattaatcagtttcgctgtagcattcgccttgacatttatctacggtaaaggtcacatgaaagaagaacaagtagctcctgttgtatctgcatccgaagctgctgaaacagaagcaaaagttgaagaacaagtagctgctgaaagcaaattaaacgatgaagttgttgcatctccaattagtggtgaatcaaagaaattaactgacgtaaacgatcctgttttctctactctagcaatgggtaacggtgctgcagttgttccaactgatggtacaatctatgctccagttgatggtgaattaacagttgcttatgaaactaagcatgcttatggcttgaaatcagataatggtgctgaagtattaatccatgttggaattgatacagttaacttgaaaggtcaacatttcgaatcattcgtaaaacaaggccaaaaagttaagaagggcgacaagttaggaactgttgatttagatgcagttaaagcagctggctacgacactacagtaatggttgttgttacaaacactatgagctatgcttctgttgatagaattgacaatacaaaagtaaatcatggtgacgatttagtagcagtaactgcaagataa

SEQ ID NO: 859 - DNA, 888 bp, Unknownn
  isolated from dental, unidentified
atgttatatcaacagatagcaaaaaacaaacgcaaaactgttctagtaatggctggctttgtatttttagccggactaataggagcagcgattggatacgcctttatgggaagtgctcaaacggggattattattgcagttgttgtcggcatagtttatatgttcgtgattttaggtcaatcaacagatgtagtaatgagtatgaataatgctcaggaaataaccgagcagcaagcccctgaattatggcatattgtagaagatatggcgatggttggcaaagtaccaatgcctagggtgtttatcattgacgatcctagtcctaatgcttttgctaccgggcctgatcctgaacatgcggcagtagcggcaacaactgggattctacaaagacttaatcgtgaggaattagaaggtgtaatggcacatgaagtttctcatattagaaattatgatattagattacaaacatatgctttggctcttgcctctgtaatttcattcttagcaaacatgggaatgaacgcgatgtggtggggtggaggtagacgcgatgatagagataatggtaatgctggtcaagttataatgctattattatcagttttagcaattatcttaggaccgttagcggcatctatggctcaaatggcactatcaagaaatagagaatatttagctgatgcatcggctgttgaacttactagaaatcctcaaggtttgataaatgctttaagaaaaatttctatgagtgaaccaatgcaaaatgcagatccaagtagtgcttcgatgtatatcgctaatccgtttaaagatggctcatggacacatctttttgacacacatccaccaattgaaaagcgaattgatagactagaacatatgtaa

SEQ ID NO: 860 - DNA, 468 bp, Unknownn
  isolated from dental, unidentified
atggctaataaactaaatagtttagcccatacaacatggttatgtaaataccatatcgtattcactccaaagtatagacgtaaaataatatattatcaataccgaaaagatttaatagagattataaagttattatgtcaatataaaggagtaaaaattatagaaggacatatgatgccagatcatgtacatcttttagtaagtattcccccaaagcagagtgtatcaagttttatgggatacttgaaggagaaaagtgcattgatgatgtttgatagacatgcgaatttaaagtacaaatttggaaatcggtatttttggtctgaagggtattatgttagtacagtaggattaaatgaacaaacaattcgaaaatatataagagatcaagaaaaacatgatttatcgatagataaattgacaactaaagaatattcagacccttttaagggtaataagttaaagtga

SEQ ID NO: 861 - DNA, 1224 bp, Unknownn
  isolated from dental, unidentified
atggacgaagcacaacgagaaaaaagcccatggaaacgtaatttatacattctatgggtttgtacttttatcgctggcattgcttttagtgagcttatgccatttatgtctttatatgtcagtcaactaggacatttttctaaggcacaagtctccttttatagcggtttggtctatgctgctacttttctagtcactgccatcgtttctccattatggggaatgctagctgatattaaaggacgcaaaatcatgttaattcgcgcttcctttggtatggcctttgctatgtttttaatgggacttgtcactaacgtctgggaattaattgccttacgtgcccttcaaggtttattttcaggtttcatttcaaatgctcaagctttaatagcatcgcaaacacctagaaagcatagtgggaaagctctaggaactctagtcactggctcaacttctggaatgttaatgggacctatcatcggtggtgcattagcccaattcttctctattagagacactttttttatcaccgcttccttactagccctagcaggaattttatctgccactttagttaaagaatactttgtacctattaaacgagaaaaaaattctgaagaacatcgcggtttattatcacaatttcaaaaccctcggctaatcattgttctgcttatttctactatgatggttcaattggggaatatttcaattgcccctattatcagtttatacatcaaagaacttatgcataatcagggcccaattgccttagtggctggtattattgctgctttaccaggtatttccaatattatttcagctccacgcttaggagcttatggtgatgctcatggatcaaataaagttctaatggcaggttatctttttgctgttatcatgtatttcccacaaggattcgtttcaagtatttggttactaggaattttacgtttctttattggtatttctgatggggcactatttcctaccatccaaactttactaacaaagaattctcctacatcagctacatctgccgtcttttcttggaatcaatctttccaagctttaggtaatatgtttggctcacttttaggtggttctttagctggactatttgattacaatgtcgttttcatttctacagctactctactactacttaattttttaattttatggtttactgagccaaacttgcgtttgaaatttaatagataa

SEQ ID NO: 862 - DNA, 1026 bp, Unknownn
  isolated from dental, unidentified
atgcctgaagataacttatatgatatttctattattggtggtggccctattggtatgtttgccgctacttatgcaggaatgcgttcagccaaagtccaattacttgaaagtttaggacaacttggaggacaacctcaagctttgttctcagaaaagacaatctacgatattcctggatttagttccatttccggtaaagacttaattagaaatttaaatacacaattacagcaatttaatgttgacgtatatgttaatagtcctgttttaaatattcaaaaaactgagaaaaaccaatttaaaataattactaataatagaatcagttatagtaaatctattattatttctaccggaattggttcattcgaaccacgtcgccttagaatagcgaataccgaagcactagaaaatgataaattattttatactgtcaacgatccatcaatatttgagaacaaaactattgctattgcaggtggtggtgattcagctatagattgggcattagaattaaatactattgcaaaagatactattgtcattcatcgtagaaatcaatttagagctatggaatcaaatgtagataagttaaaagagtctggttcaaaaataatgaccccttacactatagataatcttagtacagacaattctcataataaccttactatacaacttaaaaaagtacgtactaaagatactgttgaattatcagtagatgctttattagtaaattatggttttatgtctaacaatagcattttaaagtcatgggatttagatctaataaccaccaaaaataatttaatccctgttaattccaaattagaaacaaatcttcaaaatgtttatgctattggagatattgctaattatcctggtagaatagatttgatagccgttggtatgggagaagcacctatggctgttaataacgcattggaatcactttatcctgaaaaaattcagccaaaacatagtactcaacttgttaaaaatattaaaaataaagaaaataactaa

SEQ ID NO: 863 - DNA, 1092 bp, Unknownn
  isolated from dental, unidentified
atgacaacaaattatatgagtaactatagctatggcccagattgttttaaagagattccagaagttttagataaatataaagtacataaaatcgttttcattggtggagaaaaagcattaaagagttctcaagaagatgtgaaaaatgttctagaaagtaatggattctatgtaactggaagttttgtttacggaaaaaatgcaactcagtctaatatagataaattggtagaaaaatctgaagttcaagatgcagatataatttttggttttggtggaggtcgagcattagacactgtaaagatggtggcaaaagctttagataagactatttttacattcccaacaatctgttcaaattgttcagctgggactgctattgctgttttgtataaagatgatggttcatttgataagtatggatatcctgatgttccagcacatgttttcatcaatacaagtgtgattgctaaagcaccgaaagaatatttctgggcaggagtaggcgatggtattagtaaggctcctgaagtagaacatgcagtagctgcagcagttgaacgtggtgtggaattgcctcatacagcagtattaggtgcagcaattgcggcttcttctaaagatgctttctataagtatggggaacaaggaattaaagatgtagagaatggaactgtaagtaaggctatcgaagaagtagctctggatattgtagtttcaacaggttatgcttcgaacttggtaaatcaagatgatttttactataattcatgccatgctcatgctttctacaatgcaacaacagcgattaaaaaggaaaaagaaccattgcatggacaagttgtttcctttggggtaatggtgctacatgcttatttcaatgagttggaggaattaaagaaagtagctgtttttaataaaaaattgggattgccagtaacattggaagaaataggattaaaggttagcgatgcagaaaaaataacagaacttgcgatgcaaactaatgaatataagcagaccccatttgataaggaaaaatacatagaagcaattaaattggcagataagatgggtagtgaaaacgcctaa

SEQ ID NO: 864 - DNA, 1281 bp, Unknownn
  isolated from dental, unidentified
atgagtaaatatcaatttaaattgccagatatcggtgaaggtattgcagaaggtacaattggcgaatggcatgttaagcctggtgacaaggtggaagttgatggagatttagttcaaattgaaaatgataaatctgttgaagaaattccttccccagtttcaggtacagtaacaaaaatattggttgaagaaggcgaaactgctgaagttggtcaaccattgatcgaattagaagttgcagaaggagaaggcaatgtagctgacgatgctcctgctgcagaaactgaaaaagaagaaaaagtggaagctgcaccagcaccaaatacacaaccaactccacaagttgcagatcatagcttaccagttcttgcaatgccagcagttcgtcgctatgcacgtgaacaaggaattgacttgaagttagtaccaggctctggtcgtcatggtcaagtattaagaagtgatattgatgcctttaaagctaatggtggtgcagttgccgctgcccctgaagcaacaccagttgtggaagaagcagcaccacaaccagctcctaagttacctgctggagatgctcaatggcctgaaacacgtgaaaagatgtcaggtattcgcaaagcaacagcaaatgcaatggtacgttcagtatctcaaattccacatgtgcatgtctttgatgaagtaattgttgataaattatgggcacatcgtaagaagtacaaagaacttgctgcagaacgtgatgttcgtctaacattcatggcatatatggtaaaagcattagccgtagttatgaaagaattcccaattttcaattcatctgtagatatggataagcatgaaattgtttataaggattacatcaatgtaggaattgctacagatacagatagaggattatttgttccaaatgtaaaacatgctgatagcacaagcctatttggtattgctaaacaaattactgaaaacacagctaaagctaaagatggtaaattaacagccggtgatatgagtcacacaggtatgtcaattacaaatatcggttcagtaggtggcggtcactttacaccagtaattaactggccagaagttgctatcttaggtatgggtcgtattactgatgaaccagttgttgttgaaggtgaagtaaagatcgctaaagtcttgaagttatctttggcatttgatcatcgcgtaattgatggtgcaacagctcaacgtgcaatgaatcgcttgaaagaattattaagtgacccagaattgttattaatggaaggatga

SEQ ID NO: 865 - DNA, 819 bp, Unknownn
  isolated from dental, unidentified
atgattttgatgagtaataataaattaacagtaaaagaaagaaaaaatatgtttagaagatggattttttctgcaggattggggtataactatgaatctcaacaggcaccatctgttgcattttcaatgagaaaggctttaagaaagatctattctaatgatgatgaatatattgatgcgatggataatcactataaatattttaatgtaactccacaaatgggaaatataattttaggagcaactttggcgatggaagaaaaagatggtattgaagctaaagatgctgttcaatctctaaaaacatcattaatgggtcctctttcaggtgtaggtgattctgtattttggatattaattccaactattatgggatctattgcaggatatatggcacttcagaaaaacgctgttggagcagttttatggatgttaatgtatatagctttttattggctaaaaatgtggttatttaatttaggatatgagtcaggaacaaaattaattactacgcttggagaaaaaattaatgtatttacagatgcaatttcaatcatgggattgatggtggttggatcattagtaccagcagttgtaaaagtttatacaccattaaaatttgctacgggtaaagtttctttgtccttgcaaaaaggaatatttgataaaatcatgccaggattacttccagtttgtttagcattattagtgtattggcttttaggaaagaaatcatggacaccaactagaattattttattaattatcctaatttgtttgattggtgcagcaacagggattttaggtatagctgcataa

SEQ ID NO: 866 - DNA, 1494 bp, Unknownn
  isolated from dental, unidentified
gtgagtgctatcattatttttattactcatccattatggattattacaattattttctttgctaacttgatagcagctatttggacagtttttcgtgaaaaacgagatattgcaaccacatgggcttggttattagttttaacattactacctataatcggcttcactttgtacctttttgctggtagaaagatttctaatgaacaaattttcagtatgaagaaggaacaacaggaacaaattaccaagttagctaatgaacaaaaaagcctctggaataagcattctctaattccatccgaaaaaactactgatactggtcgtgcactaattcattttttccttgaatcagaagatgcctttataactcaagataatcaggtagaaatttttactgatggaaaagaaaaatttgaatctcttcttcgtgatataaagaatgctaaacatcatattcacatagaatactattcttttatcgctgatgatattggtaataaaatactaaaagctctagaagaagctgctgctcggggagtagaagttagagttttatacgatttattcggttcacacggaactacctataaattcttcaaacatttagaagaacttggtgggtatgctcaagcctttatttcagcatctaaggcattaatttcaacacctagactaaattaccatgatcaccgaaaactcgttattatagacggtaatattggctatattggtggctttaatattggagaccaatatttaggaaaatcaaaaaaatttggttattggcgtgatacccatcttcgtatcagaggttttgctctttttgaaatgcaagcacgtttttcaatggattggaatacaacttgtcgtaaaactaaaaaacctcgcttagatatttcaactaaagaatatatgccaatagcttctaacgaacaagctcatggttctaccagaatacaaatcgtttcttctggtcctgatagtgaacgtcaatcaatcaaacgtggatatcaatacatcattgcaaatgccaaggattatgtttatatacaaactccttacttaattccagatgactcggttttagaagcactcatcatttctgccaaagccggtactgatgtccgaattatgattccatgcatgcctgatcatatttttgtttatagagccactcaattctatgctaagtatttagttgaaaatggtgttaaagtctatcaatatgataatggtttcttacatgctaaaaccgttgtttctgatgaccacatctcctctgttggttctgccaacatggactttcgtagttttaaacttaattttgaaggtaatgctttttgttatgatgataagttatcaaaagatttaaaggctatctttttaaaggatttggataattgtacagaattaactactgaattttttgataatcaatctagttggttaaaattcaagcaatatttctcaagactgctttctccaactctataa

SEQ ID NO: 867 - DNA, 894 bp, Unknownn
  isolated from dental, unidentified
atgatggcaaacgaattacctgaaattgctaatccaacacgtacaagagcaattatggaaacatatggattgacgtttaaaaagagtttaggtcagaactttctaacagatattaatattttaaaaaatattgtagctgcagcagaagtcagtgaggaagataatgtaattgaaattggaccaggaattggggctttaacagagcaattagcaaaaagagctaacaaagttatggcattggaaattgatgatagattactaccagttttggcagatactttatcgccatatgaaaatgttgaagtggtccatcaagatattttaaaagcagacttgaagtctttgatagctgaacattttgaacctggtcataagttgaaattggttgctaatttaccatattacattactacacctattttgatgcacttattagattcgggaattgaatttgaaacaattgtagtaatgatgcaaaaagaagtagctgaaagattagctgcaaaccctgggacaaaggcatatggttctttatctgttgtggttcaatatgaaatggattcagaaattgcttttattgttcctaagacagtctttgtgccacaacctaatgtggattctgcaattattgttttgaataaaaagaaagttaaacctaaagaaccacaagatgagaagcattttaagaaattagttaagggcagctttatgcatagaagaaagagcttatggaataatcttcaaagcctttacggaaaagatcctgaaactaaagagaaaatgttacaagctttggaagttgcagatattaagcaatctataagagctgaaaaattaacagtagctgactttataaatttatcagatgctctagtaaaaatggggattaattaa

SEQ ID NO: 868 - DNA, 1356 bp, Unknownn
  isolated from dental, unidentified
atgagcgaaaaggcgcaaagttcacaagcaacaaaaggtttgcctgacgttagtagaagtttaatttggatgataaactttggattcttaggagttcaaacagcatttacgttacaaagttcgcaaatgtctcgaattttccaaacattaggtgcggatcctaatagtcttggttggttcttcattttaccacctttagctggcttattagtgcaaccggttgtagggtattattcagaccgtacatgggcaccaaaattaggtggtcgtagattgccatatttactattaggtacattaattgccgttattgtaatgattttattgcctaattctggtagttttggttttggatatggttcattagcagctttgctatttggtgctataactgttgcgttcttagacgtttcatctaacatggctatgcaaccatttaaaatgatggttggtgatatggtaaatgatgatcaaaagagttatgcatatggtattcaaagtttcttatccaacacaggggctgtaatcgcagctgttcttcctttcttatttgcatatatgggattaaagaatacagctgctaaaggggttgttcctcaaactgttgtggtagcattttatgtaggcgctgcattacttatcattacaagtttgtttaccatctttaaagtaaaagaatatgatcctgaaacatatgctttatatcatggtatttctacagaagcaaatgaagaaaaagttagttggattcaattgttgaagacagcacctaaagcattctggacagttactttagttcaattcttctgctggtttgcattccaatacttgtggacatattcagctggtgcaattgctgaaaatgtatggcatacaacaaacgcaacatctcaaggatatcaagcagctggtaactggtacggagttttggcagcggttcaatctatcgcagctgttgtatggtcatatgtattagctaaagttcctaataaatatcacaaagcaggttacttctcaagtttattactaggtgcattaggattcttatcaattttctttgtttctaatcaatatgttttgattgtttcttatattcttgtaggtattgcatgggcaggtattaatacatatccattgacaattgttacaaatgcattatcaggaaatcacatgggaacatacttaggtttatttaatggttcaatttgtttaccacaaatcgttgcatctttactaagttttggtttattccctctactaggcggacatcaagcaaatatgttcttagcagccggaattgttttagcattaggtgcattttcagtattactaattaaagaaacacatgaggcataa

SEQ ID NO: 869 - DNA, 1452 bp, Unknownn
  isolated from dental, unidentified
atgtctgaaaatagtaatcaaggagaaataaaaagatccttgaaaactcgtcatgtttctatgattgcccttggtggtagtatcggaacaggtttgtttgttgcaagtggttctgcgatttctacagcaggacctggtggagctttggttgcttatatagcaatcggattgatggtttacttcttaatgacttctttaggtgaaatggcaacatatttgccagtcacaggttcatttgcaacatatgcaggaagatttgttgatcctgctttaggatttgcgatgggatggaattactggtttaactgggctattactgttgcggttgacgtttctacaagtgcaatagtgttacgttattggttccctaatattcctagttgggttttcagtttgattgtattattagtaatttttgctattaatgccttgtctgtaaaatcttttggtgagacagaatattggttagctttgataaaggttataacagttattgtctttttgattgtaggtttattaacaattattggaattattgggggtcatgcaacatatttagaaaacttcacttataaaaaggctccttttgttggtggtataccggcagtcttaagtgtattcgtagttgctggattttctttccaaggaacagaattgataggtattacagctggtgaatctgcaactccagaaaaaagtattcctaaggctatcaagcaagtattttggagaatcttattattctatattctagctatttttgttatagcttgtttgattccttacacaagtcctaatttattgggatcagaagctactgatattgctattagtccatttactttagtctttaaacgtgcaggattggcttctgctgcagctgtgatgaatgctgttattttaacctcagttatttcagcagcaaattcaggaatgtatgcttccacaagaatgctattttctttgagtttaactaaagatgcacctagagtattctcactcgttaataatcgtgggataccaatgccagctttattaggaactacatttgttgcgttactaacatttttatcaagtatttttggtgataagatttacacattcttggtaagtgctagtggtttaacaggttttatagcatgggtaggtatagccatttctcactatcgtttccgtagggcatttaaaaaacaaggtcatgaacttagcgaattacgttaccatgctaagtggttcccattcggtccacttttagcattagtattatgtatcttagtaattgtaggccaagatttgaaatcatttgctaatcttgattggcaagctataagtgttacttacatgtctgtaccgttattcttgattttatactgttactataagataaaatataaaactaaagtaataccactggatgaagttgatttaacacctcataaagtagaaaaataa

SEQ ID NO: 870 - DNA, 1203 bp, Unknownn
  isolated from dental, unidentified
atgccgatagataataaattaattgatgatgccgggaaaaagtaccgtcagttaacagaatggttttatctatgttgtctggcaatattttttataactatttatattaatggcacaacaatggtggatcaaattacatactttaataagttgattttccttcgaattgagcaggcagtaacgcttttagtgatgggaaagatagtattattagataaatatccacgaaagctaacaataaaattattgttaatttttatgctgataacctatatttgttatcgagctcgtgcctatgagccattattctataccgtatttttgataggtgccaaagatgtcgacttcaggaaaattcttaaattgtacttaacctttggaattccaatttttatagtaagtgcctggttagctctgaatgattatatactgaatttaactcttcaaagaccaggagataatacggttagaatagctttaggaaactattctccatcagatgctgcagcgcacgtcttttattttatgttagcatatgctttacttaaacgatttaaatggaatataccggagatcgtctcagggatagccttgttgatatgtgtctatacattaactgcaactaaactagatgaaattttgattattttgatactactcctatgtgcaggaggatataagtatgcggtaaaatttatccaaagattcagtttaaaacaagttagatggggattgtggatatacgcagttatcaatgttatgttgcctttgatgtttaatccaaatagcagaatctggagtattataaataccttgagttctgcgcgtttattcttcgggcaagttgcatatcatgattatgcaattcctttgtttggtcaatttgtttatcaaaatgggaatggtagcattaagccaggggaagcatactttttcattgattcatcgtttgtaagggcgttattaatgtatggcttagtattctttgttgttgcgatgttttacataattagtagtatcgaaagtaacattaaacaaagaaattataatttagttatagctttgatcctagttttattaagttctgcaattgataatcatttatgggacatggcatttaacattgtatttttaggaatgtttgcagatgtacagtcagataatgagatagtagggatagagaatgaaagtaacacaaaatag

SEQ ID NO: 871 - DNA, 993 bp, Unknownn
  isolated from dental, unidentified
atggaatggaaaattggtgatatagttatccctaatcaagttgtagtagctcctatggctggggttacaaacgttgcctttcgtatgatttgtaaggaatttggtgcaggtttagttgtttgtgaaatgatttctgacaaaggaatccattttagaaataagaaaacgttagacatgctatttgttgatccaactgagcatccagttagtgtccaaattttcggtggtagcaaagaaactttagttgaagctgctcaatttgtggcagaaaatactgcgactgatattatcgatataaacatgggttgcccagttcctaaagttacaaagactgatgctggtgcaagatggcttttagatccagataagatttatgaaatggttcatgcagttactagttctatagataagcctgtaacagttaagatgagaactggttgggatgaagatcatattttagctgttgaaaatgcattagcagcagaagaaggcggagctaaagcattagcaatgcatggacgtactagaaagcaattatatacaggacatgcagattggggaattttaaaagaagtagctgatcatttaactaagattccatttatggggaatggtgatgttcgtacaccagaagaagctaagaagatgttggatgaagttggagcagatgcggtaatgattggtcgtgcagctttaggtaatccttggattgttaagcaaacaacacattaccttgaaacgggagaaattttagaagaacctacacctgcagaaaagattaaagttgctaaggaacatttacatcgtttagttaaagctaaaggtgaagttattgggccaaaggaattccgttctcaagctgcatattatttgaaaggaatcccacgttccgcacgtactaaagcggctttaaattctgcagatacagaagcagaaatgatcgatatttttgataatttcttagcagatacattagcacgtcaagctgtttag

SEQ ID NO: 872 - DNA, 1242 bp, Unknownn
  isolated from dental, unidentified
atggcaaaatatgaaaatttagttactagatttttgaaatatgtaaaaatagaaactcgttcaaatgaggattcaacaacaatcccttcaactcaaacacaagttgaatttattaaggaacttgctaatgagcttaaaggattaggactacaaaatgttcatatttctgatgaaagtggatatgtatttgctactttaccaagtaatttagaagatgatgctaatactaaagtagtaggttttatttctcacgttgatactgcagactttaatgcacataatgttcaacctcaaatagtagaaaactacgatggagaatctgatattaagttagatgaagcaggtaattttgtgttaacaacagcagaatttcctaacctaaagaattataaaggtcatgatttgataacaacagatggttcaactttattgggtgctgatgataaatctggtgtagccgaaattatgtctgcaatggaatatttgcaagcacatccagaaattaaacatggcgaaatcaaagttggttttggtcctgatgaagaaattggtacaggtgctgataatttcaacgttgaagacttcggtgctgatattgcctacacagtagacggtggtcctttgggtgaattagaatatgaaactttcaatgctgctcaagctaagttgacattcaaaggaaaagatgttcacacaggtactgctaagaatgtaatggtaaatgctattcaattagcaattaattatcaaaactcacttccagcagatgaagttccagaaaagactgaaggtagagaaggattcttccatttatttaaatttgatggatctgttgaagaagcacatacaacttacatcattcgtgatcatgatagaaagcattttgaagaacgtaagcaattgatgttagacatcgctgaaagaatgaatactgaactaggtgaagaacgtgtagttattgatttacaagaccaatattacaatatgcgtgaagtattagaaaaagacatgacagcagttgacattgctaaagaagctatggaagatttaggaataactcctgaaatttatccagttcgtggtggtacagatggttctaagatttcattcatgggattgccaacaccaaacctttttgctggtggcgaaaatatgcatggacgttatgaatatgtatctacacaagtaatggaaaaagctacagatgtaattttagaaatcgttaagttgttagcaaaataa

SEQ ID NO: 873 - DNA, 1392 bp, Unknownn
  isolated from dental, unidentified
atggataaggatttagaagaaagattagcagttaaagatagctatatcactattcatgacttttatgtgttaatggcattttatcaatcaatttcacaaaaagttttacgaaaatttgataaagatggcagcattttagaagtacaaaaaaaatatgaagaaagtagggagactgttcaggatgctcaattcgtaatagcgccacaagatacatattatcatcattaccaaatgtataaggccaataaatttgaatatgttgaactcgtaaaatctctatataatatagaagaaaaaaatccaaaattaaaaaatatcttccaagatgttagcggaagtacttcaagtttaccgagtgaaactgcttttgaaaagatagattcacgtaatgaagtaagttttgaagaaaatttagaaataattaagcgaagcagtggcgctagggataattacgattatacttcgaaaaatatccgtaagttgattactaaattagttggaagtaaaaaagaaggagtatcaatttatgatccagctttgggaacagcgagtttactgttaggtataaatcgagatgcacttaaagaaaataaatattatggacaagaaatcaatactcaagtgataaaaatagccattatgaacgcaatagttaatgatgtagatgatgataaatttgaatttaagaatgaaaatacattggctaataactgggaatttggcaaggttgatatagtagtgtctgatccacctataaatatgaaatggaatgttgatagaaatttaagtcaagatagacgttaccgagattatggtgagatgcctaacaaagctgattggggattcattttagatggaatagataaattatcagacaatggcatgatggttgtgtcagttgttcaaggtacgctgtttagaggagccaaagaatacaatattagacgtaaacttctagaagatggaaagattagggcggtaatccagttgccagggaatacaaaaatttcaactacaatcgcaacttgcttattagtgcttagaaaatcatcagaagataaagatgtcttctttattaatgcaagccaagagtatgagaagaaaggcttggaaaatattctaacagaagccaatgtcgataaaattgtagatatttttaatgaaaagaaagaagaaaaaggattctcacatgtagcgagctatgaagaaattgagaaaaatgattttaacctatcagtagcacgttatgtaaatcagtataagtttaaagaaaaattagattatcaagaagaaataaaaaatcttgaaaagttagatgaaaaactaagtcaaactgatgcgacattgaagaatttgatgggtgatttaggtttgatggagattaataactag

SEQ ID NO: 874 - DNA, 885 bp, Unknownn
  isolated from dental, unidentified
atgcagaagatagtatattatggatataatgaaagcgtactggactttctgaaaataggcataaataatgacactaagttatattttaattggcaaattaatgatactgatattcaggatgaaataaataatttggtagagtgttcacgtctgctatcacctaatttttatttttatataaatgaaactgtaaattgggatgaaattgacatgatgctactttcaattgatgtggatagagataattttgctcaaaagaatagttggatccaaaaagtggtcactgaagctgtagctaatggatttaatggtatagttgtattagatagtaataaggactatttattgattaatgaaattttaaaatacacagggctttcatctagacaagtgttgggattaggaacttctatagaatcagaagttgtagctagaatggttgcaaagaaattaggaattaatagtaattatattcagacgagtgtaattggaactagagataagtcttttgttttgtggagtaagggtagagttgctgaagcatcacttatgagtttaatagtgcaagaaaaaaatatgtttagtataaaaaatatgcaagagatatctaaagagtataaaggattagctgaaaagactcgaaagttaattttttcttctgtattaaataagatattaatggcgatggatacttccgaacagtttataataactctggttcatagtaggaatgaagagattgaaagttatagttcacctgtattagttggaaagatgggagttatagaattaataaaagtgaattatacagaagatgagcaagatgctttaaatgaggtaaaaaaagctattaatgatgagttagatagatataaattaagatga

SEQ ID NO: 875 - DNA, 1737 bp, Unknownn
  isolated from dental, unidentified
ttggaaaagcaaaaacttattaaattgatagatgtcgctgcaggtcgtaaaaaagctgatttagttttaaagaacgcaaagattgtagatgtttttcaagctaaaattttaacaggagatattgctatttctgacggatacatcgccggaattggtgaaagctatcaaggtgtagaagaacgtaattacacaggtaagtatgttgcaccaggtttcattgaagctcatattcatatcgagtcatcctatgtttctccagaagaatttagtcgagtttttattccaagaggaacgacaaccatcttggctgatcctcatgaaatcgtaaacgttgccggattaaaaggtttagattatatggtaaatgctgcaaagaacgcaaagatggatgttcgctacatgatgccaccatgtgttccagcaactaattttgaaacttcaggtgcagatttatatgctgatgatatggaagatgcactaaagacaggtgaagttgatggcttagcagaactaatgaatttcccaggagttattaacgctgatgataagatgattgatgaaattcttatggctaaaaagtatggtgctcgaattgacgggcatgctcctcaagtagtaggaaaagacttaaatgcatatattgctgctggcccggccaacgatcatgaatgttcgactttagaggaagctgaagaacgtttagcacgtgggatgtatcttttgttacgtgaaggttcagttacacaagatttacgtaagttattgccaattgttaatactgctaattcacgtcgttgcttgttatctggcgatgatgtacaggcaaaaacagcgattaataaaggacacttagataatagtattagaatatgtattgatgaaggcttgaatccaattactgctattcaaatggctacattgaatccagctgaatactgtggcttgaatgatagaggagcaattgcaccaggtcgtcgtgcagatatggtcgtttttgaaagtttagaagactttgctgttgaagaaacttatattttaggtgaaaagttaagccaaggaaatgaatatttaggtgaagttaactactatccaattgatagtgttgaatcttctatgcatgttaaggattttacacgcgaaaagcttcaactacatttaaatagtgacaaagttcgtgcaatcggagtagtaccaggtgaagttttgacaactgaagagcatgtgacagtaagacgtgatggcgatgataattttgtatacaacgatcaagaagatgtcacaaagattgtcgttgttgaacgtcaccataacactggaaatgtaaatgtgaacctattaagtggatatggtattaaagctggagcaatcgcaatttctattggacatgactcacataatattattgctactggaactaatgatgatgacatcttcatggctgttaacgaacttatcaagcaagaaggtggagcagtcgtagttaaagatgaaaaagttatttcacgtatggaattgaagattgcaggattgatgtgcaatttaccagctgagaaaatgattgctcaacaagatgcacttgatgaagctgttcatgaagaattaggtgtaccagataatgttaacccagtaatgactttgagtttcatgccattagcagtaattccaaagctaaaaattacagataaagggttagttgatgttgaaaagaatgcttttgtcagcaatgagttagactaa

SEQ ID NO: 876 - DNA, 1566 bp, Unknownn
  isolated from dental, unidentified
gtgattatagcaattacaatcctcgccatcgccattgcgactttagttatcggttttgcgttgggggtagcttatcgtaagcgtagttatgaacaagctttagatgtagcgacacaaacagcaactggtatcattgaaacagcaaaaaaagaagctgctgcaagtaagaaggaagcgattattgaagctaaagaagaaaatcatcgttaccgttctgaaatagaaagtgaactaaaggaacgcagatctgaaattcaacgtcaggaaaatcgcttgttacaaagagaagaaattctcgatagaaaagatactgctttagataaacgtgaggacgttttagagaaaaaagaagcacaattagattctgatcaaaaagttgtaactaagcaaaaagaacaagcatctttgttagtaaaagagcaacaagataaacttgaagaaattgcagcattgacaagacccgaagctaaggaattaatcttgaatgaaactaaggaagaattaattcacgagcgtgcggtaatgattaaggaaagtgaagaagaaactaaagctacagttgaccgaaaagctaagagtttaatcgcccaagctattcaacgtagtgctgcagatatggtatctgaaacaactgtgtctgtagtaaatcttccaaatgatgagatgaagggtagaataattgggcgtgaaggtcgaaatattcgtactctagaaacattgactggaattgacttaataatcgatgatacgccagaagcagtcgttttgagtggtttcgatccagttagaagagaaattgctaaaatggccttagaaagattaattcaggatggccgaattcatccagcaagaattgaagaaatggttgataaggctactaaagatatggatgcaaaaattcgtgaaataggtgaagaagttatttttgacctaggaattcattcaatgcacccagacttgattaagactattggtagattaaattatcgtacaagttatggtcaaaatgttttgaatcattcaattgaagttgcaaaaatttcaggaatactagctgctgaattaggcgaagatgtcatattggcgaaacgtgcaggattattacacgatattggtaaagctgttgatcatgagattgagggttcacatgtcgaacttggtgtagaactcactaagaaatataatgagagtgagacagttgtcaatacaattgcttcgcatcatggagacacagagcctaaatccgtaatagctgttttagttgctgcggctgatgcaatttcagctgctagaccaggtgctcgtagtgaatcattagaaaattatatccatcgtcttgaaaaattggaaaatatttcaaacgaatttaagggtgttcaaaagagttacgctattcaagctggtcgggaagtcagggtcattgttcaaccaaatgaggttagtgatttagaggcaactgttttggctagagatattcgaatgaagattgaagatgagttagagtatccaggtcatattaaagtgacagttattagagaaacaagagctgttgaatatgctaagtaa

SEQ ID NO: 877 - DNA, 1713 bp, Unknownn
  isolated from dental, unidentified
atggttttattttttgtagttattgtggcggtcgccattggaatatatgttggagtcatatattttcaaagatcgtttagaaaacaaataaatgagtatcaaactcagcttgaagaattgagcaacaatactctagatagcgaaataaataaaattgaaaaattacatttaacgggtgagagtctacgtgaatttgaggaactcaagaaaaaccataagaaacttactaaccgtgagatgccagaaatttcagaaatgattttggatttaaatgatttgaatgagcgttataagtttatgcaagaacgttcagaattgttagaagttggatccaaattacaacatgttaaagaagaaactcgacaacttgaagaagctgtcaatgaaatgaaagaaaaatctgaggaacatcaaaaagccgttacagaattaaaagataagtatcgtgatattcgtaagactttattggctaagaacttttcatttggaccaagcattgataaattagaagaaaatctttctaagttagaagaagactttgataaatatgctaaattaactaaaagtggagattatgtaacttctgataaaccgttaaatcaattaaaagaagatacagcaagcatggaacgtgatttagaagttattcctggaatttataagaatttaaaaaatgttttccctgatcaattatcggagttacgccaaggtgtagctcagatgcaagatgaaggatttgcatttgataaagacattttgggacaattaaaagatttagcagaacaatgtaatttaaataatgaaaacttgaaagaattacgtgttgataatgctaaagtcttagatgaagatattgctaataaaattgatgctatctatgaaactttagaagaagaatataaggctaagatttttgtacaaaagaaaatttcaacctttggtaaattcattgaacatgctgaaaagcaagaaaaaaatttattgttggatttagatagattaaaacaaaactacacactcaatcatgatgagattgaaagtgcacaaggcttagcggataggttaaagggaattcgtagttggtatgatcaatttattaaagatgctgggacaaaagcaatcctatattcttctattgctcagagaatagaaattgatatgcaagctctaactgatatagaaaagaaacaaaaagaaatcaatgatagcgtggcaagtttatggaaagaagagcgcgaagcacaaaatgcggttaagaattttgacttggaaattcataaaatgaagcgtgaaattgaaaagcttaaccttccaggattatcagatgattacttggattatttctttaaggttagcgatgaaattgaaaaattagataaagatttaaatcgagttcaaattaatatggatgaaattacaaaatcgttgataaatactcaaagtgatttagatattttgggtgaaaagactgatgaattaatttctagttcaattttaacggaagaaattttacaatattcaaatcgttatcgaaacagatacccagatgtagcagctgcttacaatcaagcagtgcaattatttgagaaggaatatgaatatgtaaaagcattggatacgatctctcatgcagtagataaggttcaagaaggtgcatccaaaaagattatggaagagtactcaaagaatcatccaccaatattttctaaataa

SEQ ID NO: 878 - DNA, 618 bp, Unknownn
  isolated from dental, unidentified
ttgatatatgctatattcttctctaaaggaggatgtggcgtgaatttaaatttagataatattcttttagagaacttcaaagaacaacccagcgatgataattttaacaaactatttcaaaaatacactcctcttgtttttaaattaataagtagttatcattttactttttacgaacgagacgatttaattcaagaagctaaaattgtttgttattcttcagccttacggtataggttgccatctaatattacttttggatattattttcagattaatcttcgcaataaatacaattccctctaccgattagaacatgcctataagcgtaaatccgaaagggaatcaacctcctacgaacaattgtcttctaacttaaaagaagtcgtcattggttctgattataaaaatcacgctcctgataagaatattctggtgaaggaagctattcaggcatttcttcactctttagatgaaaaaaattgtcgcttatttagagatataatttctggtaaagttcaaaagaaggatattttacaagactccaaattacgttatcgctattataagcttaaaaatcaatataaaaataatgtatttgatatttttttcaagtaa

SEQ ID NO: 879 - DNA, 702 bp, Unknownn
  isolated from dental, unidentified
atggacaatttggatagcacaaaacaaaagagtattactttagcacaaaagattaatgtattgagagcagcagttatgggtgctaatgatggtatcatttctgttgctggcattgttttaggtgtagctggtgctgctagttcatcatttgctatcttaatatctggattagctggaatgttggctggaacaatatctatggctatgggtgaatatgtttcagtgcattctcagagcgatgcagaagtggctgctgttgtgagagaaaagaagatattagatactgattatcaaaaagaatttttatttataaagaataagttattaaaagctggaatttcagaagaattatctcacaaggcgactaaagaaatgatggacagggatccattaaagtctattgtcagagaaaaatatggttttgagttaaatgaaaaaactaatccttatgcagcagcaattgcttcgatgatttcttttccactgggagcaacattgccgttactatcaattttaattttcccagttcaatatcgtatttttggaactatgttagcagtgataatatctctagtatttacaggatattttgcagcacaattgagccattctagcaaattacatggaactattagaaatgttatttctggtatgctgacaatgatagtaacatattttatcggtgtaatgtttagcttatag

SEQ ID NO: 880 - DNA, 1188 bp, Unknownn
  isolated from dental, unidentified
atggaaaaagaagaatttatcaagaaatacgcagttgaacgtcgtaacactaactcatctaaatgggatggcttagaatctcaattcggtgaaactgatcttttacctttatgggtagcagatacagaattcaaggttcctgaagcagcacgaaaagcattggttgaacgtgttgaacatggtgcttttggatattctttagtgccagatagctattatgaagcatactttaactggcaaaaggaacgttatgggattgaattgcataaagattggatgagatttggtacaggggtagtgcaatcattaagtactttgattgaaaccttgacagttccaggtgaagcaatcatggttttacaacctgtatattatccattcatgcgagtaattgaaaataacaatcgtaaattagtaatttctgaattggtaaatcatgatggacattacgaaatggattacgaagatatccaaaagaagatgcaagaaaacaatgttaagttactaattttctgcagcccacataatccagttggtagagtttggtctgaagatgaattagaaaaattactagcaatctgtcacgatgaaaaagtaagagttattgctgatgaaatccaccatgacttaattattggggataagaagttcacatctatgttatcaattaaagatggtttctaccgtgataacttagtaatggtagatgcaccttctaagacatttaatatggcatcattattaaatagtcatgtagttattcctaatcctcaaattcgcgatttatatgatgaagtagtgggtcgtttaagcgctcctcaaggcagtctattaggtcgtgtagctgcagaagccgcatatcgtgaaggtgcagaatggttagataacatgatcgaagtaattagagataactttgtttatgtgcgcgatgaattaactaaagcatttcctgaaattaaagttagtgatctagaaggaacatatctcatgtggattgatttatcagtacttgttccagctgataaagttgaaaagctagttaagaaacaagctaaattggcagttgattttggtgattggttcggtgaaagtggtaaaggccatatccgagtaaaccttgctactacacctgaaaatatcaaaaaagcagtatctgcattagtaaatgctttaaaatcagaaaattaa

SEQ ID NO: 881 - DNA, 552 bp, Unknownn
  isolated from dental, unidentified
gtgattaatagagctattctagtaggtcgtttaacaagagatcctgatttacgttacacggcttctggagctgcggttgctacatttactgttgctgtaaatcgtcaatttactaaccaacaaggtgaacgtgaagctgatttcattaactgtgtaatgtggcgtaaaccagcagaaaattttgccaactttactcataagggttcattggttgggattgacggacgaattcaaactcgttcttatgaaaaccagcaaggaacaagagtatatgttacagaagttgtagccgagaatttctcattgttggaatcacgtgccgaagcagatcgttatcgtgaacaacatggaatgacacaaaataattacggaaataatgctccttcgcaaaatcaagcatcacagtttgatagcaatccattcggtgattctcaatcaaataatagttttggtggaaatacaccagcaaataatggagcagataatagtgctgatccatttgctgataatggacaatctattgatatttctgatgatgacttgccattctag

SEQ ID NO: 882 - DNA, 1029 bp, Unknownn
  isolated from dental, unidentified
atggaagaaaaattaaaattaagtccagatagtttcgaacctttggcaaaaggcgaagctcaagataatgaaaaaatcgctgctccctcacttacctttactcaagacgtatggttaagattgaagaagaacaaaggtgcagttgtctctttggttgttatcttattgatggtgattgtagcatttggttcaacaccattcattaataaaagtacattagttaagtctcagccacaatatgcaaacttaccagctaaggttccaggtctagatgcaattaatggtcttaacggtaagattaagcaaggcggtgtctgggtagatgcttatgctaaaaatgatgttccaaaagacaagtatttctatttaggaactgattatttaggacgttcattagctcaacgtattatttacggtacaaaagtttcattgattgtagctttagtcgcaacattctttgatttaacagttggggtcgcctatggcatcatctcaggatggaaagggggtagagtagataatgttatgcaacgtattatcgaaattatttcctctatccctaaccttgttatcgttgttttgatgctggtagtattgaagccaggtatgacttctattatcttagctatcgcaatttcttcatggacaaccatggctcgtatgattcgtgccgaaacgctgtccttgaaaacacaagaatatgtattagccgcaagaacattaggagagtcacctacaaaaattgcatggaaacacttggtaccaaacttatcaagtatcatcattattcaaacaatgtacacaattccatcagctatcttcttcgaagcattcttgagctttatcggtatcggtattacagctccagaaacttctttaggggtattgttgaatgaaggacaaaagaacttccaattcttaccatatcaaatgtggtatccagcaattgtattgtgtgtattgatgattgcatttaaccttttaggtgacggtttacgtgatgcattcgatccaaagacaagaaggtag

SEQ ID NO: 883 - DNA, 1830 bp, Unknownn
  isolated from dental, unidentified
atgtggcgttacttaaaaagattacttattggggagccgcttaagacaacagaagaaggcggccaagcgttaacaaaatttaaagctctagcattactttcatcagatgctttatcctcagttgcttatggtacagaacaaattacaacagctttatttgttttatctgcagcagctacatggtatgcagttccagcagcagggatagtattgattttactttttgcaataactatgtcatatcgacaaattatccatgcgtatccttctggtggtggtgcttatgttgttgctacgcagaactggggaacaggtgcaggattagtagctggaggttctttattagttgactatatgcttacggtagctgtatctgtaacatctggtacagaagcaattacttctgcaataccttctttgagggctcatagtgtaggtatatctattttaattgtcctgttcattatgactttgaatttaagaggattgcgtgaatcagcttcatttttgacggttccagtatatttctttgtaattatgattgtagctttggtgggttggggattatttaatatcttcacaggtaatattcactatgctgcagcagcacatgtcggtcaagcagttcctggaatgtcagtacttttattcttaaaagctttttctgcaggttcttcctcattaacaggggttgaagctattagtaatgcagttccaaactttaagaaacctaaacgtaaaaatgctgctaatacattaggaattatggcattgattttgggtatcttctttgctggaattacattcttaagttactacttaggtattttacctaattccaagcaaacagttttatcacaaataggtattgctgtatttgggcatggagtgctattttatctattacaattagcaactgcgatgattttagctgttgctgctaatacaggtttttcagcatttccaatccttgcatataatcttgccaaggataaatttatgccacatatgtttatggacaagggtgatcgtctaggatactctaatggtattattgcattagcaattggtgcgattactttgattttaattttccatggacaaactaatctattgatacctttatatgcagtaggcgtgtttgtgccatttactttatctcagtccggaatgattattcattggtttagagaacgaggtaaacactggattttaaactcaatatttaactttgtaggtgctctaatttcattagctctagttattttcttgttctggttacattttgcaaatgtatggccatatttgattattatgccagcattgatttttggattctataagatacacgatcactatgtgaagattgccgctcaattaagattaagcaatgatgctcaattgcacgattatgacggttcaactgttattgtattagttagttctgtaactcacgtaactactggtgctattaactatgctcgttcaattggtgactatgtaattgcaatgcatgtttcgtttgatactaaccctaaaaaagaacacgaaattgctaaggaatttaaggaatcatttggcgatgtgagatttgttgatttacattcatcttatcgttcggttcagactcctgttattagattctgtgatgttattgctaagaaagctgctgaaagaaattattcagttacagtcttggtacctcaatttgtacctaagaagccttggcaaaatatcttgcataaccaaacagcattacgtttaagaacagctttgaattctcgagaaaacatcattgtttcaacttataattatcatttgaaaaaataa

SEQ ID NO: 884 - DNA, 993 bp, Unknownn
  isolated from dental, unidentified
atgatagaagaagaacattttggatatattggaaataaagaaatttcaaaatatattctaaaaaataagcaacaaacacgagttggaattttaaatttggcaggaataattcaagaattctcaatagtagtaaattctaagcagaaaaatttggttgttaattttgacacacctaatgagtatgtagaaaataactttcaaatttgtaagcaaataggaagagttgctggaagaataaaaggtgcaagttttgaacttgataatatgcaatatacagtagaagctaatgaaggttctaatgcattgcatggaggctcacatggtttaagcacccaaatcttggatgccaaaattacaggaaacactttaatcttatttacgagattaaaacatgaagtagatggttatccaggagatatagacttggaaataagttatagtttggatgatgataattgcttgagtgtgggatataaggctaaagcaattggaagtacagtttttgatccaacggtgcatgtctattggagattaccacaagggttgaagaattccaagttgataattcctactggtcaacatgtagaaacagatgtggaaaatattccaactggtaattttgatacgaatgagaagtataatttacaaaaagaaaaatatttatcaaatgtaatagaagaactaagatctgatgaaattgcaggtttagacgatatctataaagttgatgctagtgacgataaagtggttgctagacttaccaatatggaagataatattaatatagatatttttagtaatagaaatggactgattgtttttacagctgatcctatagatgtagctaatcatgacaagggtatttacaatgcagtggcaactgaagctcaaacagtttctgattcgttgcatcatccagattttggtgatataaggttgtatgatggtcaggaaaaaaattacgaaataaaatataaagtaagtatagtttga

SEQ ID NO: 885 - DNA, 2037 bp, Unknownn
  isolated from dental, unidentified
atgttggtgaatttgggtgattcagtcggagttttacgaggtgttggtcctaagaagatacaggctcttaataaattaggagttaatacgattgaagatttattgacattctatccttttagatataacgatattgcggtcaaaaatttagaagagataaatagtcaagaaaaagttacactaaaaggaatagtggcatctgaacctgttttagtaagatttggtagaaaaaagagtaggttaaattttaagttattaattaatcatgacgtgattggtgtaacgttttttaatcaaccatggatatcaaaacaggtaactacaggacaagagctagctgtatatggcaaatatgatgctttgagacaaagtttatctggtataaagataatctcaagaaagactaatgattttgtgggagtatatcgttcatctaaagatatcaaggaaagtgtagttaagcaattagtaaaacaagcatatgaagaatataattcctatattagagatgttgttcctgaaagtattcgtataaaatatcatttagagaatagaaagcaaatgattcatgatatgcattttccttcgacgaaaaaagaggcagattcggctagaagaagtgcaatatttgatgaattttttagttttgaagctggtcttcaacttttaaaaagggataatcataaaaatatggggttgaggattaagtataataatgagaaattgaaagagttcattaaaggattgccttttgaattaacgaaagcacaaaaaagagtagtaaatgaaatttgtgcagatatgttaagtccaaatcatatgaatagattgctacagggtgatgttggatccggtaagactattattgctgcaattgctatgtatgctacagtaactgcaggttttcaagcagtattaatggctccaacggaaatattagctcagcaacatgcagaaaaattagctaatttatttgagcaatatgggataagtgtagctttaatgacaagttcttcattgagcagagtaaaagttaagagagaattattaaagcatttaaaaaatggtgatattgatattgtcattggaacacatgctgttatccaagataatattgaatttcacaatttaggattagctataactgatgaacaacacaggtttggtgttaatcagagaagaattttaaggaaaaaaggagttaatcctgaaattttagctatgactgctactcctatccctcgtacattagcaatcactacgtacggtgaaatggatgtgtctataatagatgaacttccaaaagggagacaacctgttaaaacaagctgggttaagaagaaacaagtaaaaaatgtatttgaattcgttaaaagacagctcgaattaggaacacaagcctatattatttcccctttggtagaagaatctgaattattagatttacaaaatgcagaagaagtttttgagaaggcaaaagaatactttggttctgaaaaagtagcattattacatggaaagatggatgctaatgaaaaagagcaggccatgcaagcttttaaaaataaagaggtttccatccttgtttctacgactgttattgaggtaggggtagatgttcctaacgctactgtaatgatcattttggatgcagatagatttggtctagctcaattacaccaacttcgcggaagggtaggacgtggtagtaaggaatcatattgtattttagtggcagatcctaagagtgagtatggtaaagaacgtatgaaaataatgacgggaactaatgatggattcctaatttcgcaaaaagatttagaattgcgaggtcctggtgaagttctagggaaaaagcagtcaggtttacctgaatttaaagtaggggatccagtagtaaatttgaatatattacaagttgctcaagaggaagctcataatgttgtttttagtcctaattttaaaacaaaggaagagaattttgaattaatcaagtatttgaatagacagtttgcccaagaggaaattattgattag

SEQ ID NO: 886 - DNA, 1116 bp, Unknownn; identical to SEQ ID NO: 186
  isolated from dental, unidentified

SEQ ID NO: 887 - DNA, 249 bp, Unknownn
  isolated from dental, unidentified
atgagtttagattcattcaaccataaaaaagacgaagaaatgagagaaagttacgaaactacattgaaagataacaagaatgacgcagtagcatttttaaaaaatatcagtcgaaaagaagtagagcgtaagcgatcagtaaccttctcaattactgaaagtcaattaaaaaaaatggacacggctgcccgaaaaaacggatttaaaaatcggtcagaattcttagcttcaatcatagatgcaatttaa

SEQ ID NO: 888 - DNA, 4590 bp, Unknownn
  isolated from dental, unidentified
atggaaaagttgctaggtgaaaaacgtcgctacaagctttataaagctaaatctaagtgggtggtgtcagcgattattactatttctggagttacatttttagtgacaagtccagtttctaacgctcaagccgataccgttaatggtagtgaaagtgtaaaaacagaagctactcaggcatcaagttcgagtgtgcagaataatgcgacagctcaaacaactgttacaaccaatagtaatagtcctaacaatgtttctaatgttcaaactgataccgtaaaagaagcaacaacaagtgatgttgactcagtagctagtcaaaatcaagctacaacagctcaacaggctaaaactattgctgatactgctgatcagacagtgccaccaacaacctataaagaccatgtcaaaggaaatgttcaaactgcatgggataatggctataaagggcaaggtatggtggttgctgttattgattctggtgctgatacaaaccataaagatttctctaaagctcctgaatctccagcaatttctaaggaagatgctgacaagaagattagtgagctaggctacgggaaatatgcttcagaaaaattcccatttgtatataattatgcgagtcgtgacaacaactgggttaaagatgatggcccaggtgcatcagaacacggtcaacacgttactggtatcattggtgctgacggccaaccaaatggcaatgaacgctatgcagtaggggtagcacctgaaacacagttaatgatgatgcgagtatttaatgatcaattcgctgatgaaaatactgatgatattgctcaggcaatttatgacgcagttaaattaggtgctaatgtaattcaaatgtccctaggtcaaggcgttgcagctgctaatttgaatgatgtagagcaaaaggcagttgaatatgcaactcaacatggtgtattcgtctccatttcagcttctaacaatggtaattcggcaagcgttgatggtgaaaaagttccttatgaaccaggtggagcagatggaaactttgaaccattctctagtagtacggtagctaatccaggtgcatcgcgcaatgcaatgacagttgcagctgaaaactcagttgtaggtgacggcgatgatatggcagacttctcttcttggggtcctttacaagatttcactttgaaaccagatgtatcagctcctggggttagtgtaacttcaacagggaatgacaatcgttacaatactatgagtggaacttctatggctggtccatttaacgctggggtggcagctttagtaatgcaaagattaaaagccactactaacttaagcggagcagatttagttcaagctactaaagccttaatcatgaatacagctaagccaatgacgcaacaaggatatgacactccggtttctcctagacgccaaggtgctggtgaaattgatgcaggtgctgcaactgaatctccagtatatgttgtggcagcagacggcacaagttctgtatctttgagaaaagttggagattcaactcaattcgcactaacatttaagaacttatccgataaagatcaaacatatacttttaatgattttggtggtggattaactgaagtgcgcgatgctgatacaggaactttccacgatgtttatctggcaggagcacatgtctatggagataagacagtaaccgttaaagctggacaaagtgcaacttataatttcacattatctttaacaggtttgaaagaaaaccaattagttgaaggttggttgagatttgttggaaatgatggtcaaaatcaactagtagttccatatcttgcatattatggtgatatgacaagtgaagatgtatttgacaaagctgctaatcaagaaggtacagtctatggtggtaactactttgttaatgaagacaactatccaagaggggtagctgatgaagattccttaaaggctttagtaaatcttgaaggtaattataattggcaacaagttgctaaattatatcaagatggaaaagttgcattctcaccaaatgctgatggtaagagtgacttattaaaaccatatgcctttgttaaacaaaatctaaaggatcttaaagttgaagtattagataagaatggaaaagttgttcgtgtagttgcagatgaacaaggtctggataagtcttactatgaaagtggagttaataaagatgtaactttatcagtttcaatgcgtaataatccaaatactttagcttgggatggaaaagtatacgatgataagaccggtgaaatggtaaatgcagcagatggtgaatatacatatcgttatgttgctactttgtataatgatggtgcaaataaggttcaaacagctgattatccagtagttatcgacacaacaactccagtattatcaaatgttaagtatgatgctacgacacatactttaagctttgattataaagatacaggatctggctttacagattattcttatgcagtagttaaagtcaatgataagacatttggctataagttaaatgatggcaagaattcgaaattcttaaatgcagctaaaacatcaggaacatttaaagccgtattagatagtgatactttagcagcactaactgcagcaaagaatgctttatcagttgcagttagcgatgtagctgataatacttcaacagtaaccttactggtaaatggaaacaatgatgcaacaactagagtatctgtttggaatgcaactaacggattagaactcgatcaaagttctccagattatcaagcaacaacttcaacttataacttacgtgggaatgcaacatctgatttctattacaatggtgcattagttcaagttgataacagtggtaattttgtggttcctgtaagtacaagtgatactgcggttgtcttcacatcagatgcagctggtaagaatgtagtatataaattgaatacagcaactccaaaggctgtttttgcatggcaagtaaataatactgttaaggaaaactttggtattgttttagatacagtcgtaagcaacaacaaggatgatgtagtcgtacaagcagcggttactaagggggataatgttgaagcttatgcacgtgactacttcacaggtgcagtatataaagcagatgtaaaagatggattagcaactttccatgtgaaagtaactaataatagtggtagaactgtattgttaggatggacagaagttgtgggaccaacatttaatgatgtccaacaaacatctgcaaatggtgtatatttaggagttgacgcatatgcaggaaatccggcaccagcaccagcctttacaaatgctgatcaattaggaacaaatgttgttcaagaacaagctgattctgctacaattggtaatccaggagatttgccaggacacagtctaaaggatctaacaacacgtgcagatgctaacccagatatccactttgactacttaaaagataatgattacaactgggtaggagcacaagctgttaaagatggtgtatataatccatcaacacaagtatttactttaacaggtaaggttgatccaaatgttaaatcattggtggtattaggagatagttacaatgaagctgatcctgtaaataaggttaacttaaatagtgatggaacatttagtttccaattccatacagcaccaacttcacaaagacctgttgcttacatctatacaaaagatgatggttcaacaactagaggtacaatggagttaatcttagatacagttcttccaacacttagcttaaataatgtggctaatttacaattagatagcaatggtgattaccaagtctacactaataataaagactttagtgtatctggagaagctactgataatttggacggatattgtttcttcttcaatggagataatgattatcgcgaattccacaattctggtgtgaactttgttactgaagcacatcaagatggaagcacagtaactaatccatatccagcatataagtttagcaagacatttaatttagctgatacaactggcgaaacaacacacgtatatacattgagtgtagttgacttgacaggtaatactgtaactaggaagttctatgttcactatcaaccagctagtgatacagttaagactgtaacaactgataaagatggtgcaactaaagtactagtagattacagtaacaatacattgcaagtaaaagataatactggtagctgggtaaatgctactggagtcgaagctgctaaggattatcgagtagttaatgaatacggtaatgtagtgttgctactaaatgttcttgtagataaagaacaagacaataataaagtacaagttaatgaagttacaaataataaagtagaacaaacagtagtaactaagactgtttcaaataaatctgtagctaaagtgggcaaaaaagctgcagaaccagtaaaagtattaccacaaactggtgaaaataacagtaaatctacttctgttctaggtgcagtcttagcctcaatcgcaggattcttaggtgcattaggcttaagacgtgttaaaaaagattaa

SEQ ID NO: 889 - DNA, 690 bp, Unknownn
  isolated from dental, unidentified
atgaaaattttaattgttgatgatgataaagatattgttgaattattaagtatatatgttgaaaatgaaggatatgaagtagaaaaagcatataatggtaaagaagctttgtctaagttgaacatgaatcctgacattgcattgatgatcttagatgtgatgatgccacaaatggatggaatggaagtaattcgtgaagtaagaaaagaatcacaaattccagtattaattttatctgctaaaacggatgacttggataaaattcaaggtttagtacaaggtgcggatgattatgttacaaagccatttaatcctttggaagttatggcacgtgtaaaatcattattgcgtagagctgaacataatgttaaaaataatgaaccagatcaaatagaaattgggccactcattataaaaaaagattctcatgaggtaaaaacattagaaggtaaggaaatcaaattaactgcactagaatttggaatcttacatttacttgctagtcatcctaatcgagttttctcagctgatgaaatctttgaaagagtttggcaacaagagtctgttgtgtcagctaagaccgtaatggttcatgttagtcatttgcgtgataagattgaagatgcaactaatggagaacaagttatccaaactgtttggggtgttggatataagatagagtcacactaa

SEQ ID NO: 890 - DNA, 993 bp, Unknownn
  isolated from dental, unidentified
atgaaaatgtctataacggaaagacaaccatttttaacgaaacattttgcaaaattgattagggaaaacaagctggtacatgcatatttactatcaggagctgaaggtactggaaaaatagaattagcaaagtggattgctaaggggatattctgtttaaattcacaaaatggagtaccttgtttaaagtgttctgaatgtaatagaattgagaataataatcacccagatgtagttactattatgccagacggattatcaataaaagttgagcaaataagatatttgaagtcggagtttaataagagtggggtagaaagtgataggaaagtatttattatccaagatgctcagaaaatgtcaattggagctgcaaatagtttattgaaattcttggaagaaccatctggaaatataacagcttttttattaacatccgaaccacaaaaattgttaccaactattatttcaaggtgtcaagaagttgaaatgcaacaacttacttctggacaattggagcaagaattaatttcagaaggtatttctgagaaaaatagtcatattttagccaatcttgctcaaagtgtagttgaggctaaaaaaattaatgataatgaaaattttgataagattttagcaactgtcaataattggtatcgaaaattgttaagaaaagatttattatcatttgtaatgattcaatcaaaaattatcggacttattcaaaataaagaagatcaaaatctagtattacaagttataatattaactgtacgtgatacagttttagaacgttttggattgacagaagaaatagtctttaaagaaaatatagattttatccaacaaaatactgcacagatagtaaatagtaaattggttaatggcttaaatttggtggtagaaagcaatagaaagttagcaagtaatatatctatgcaaaatatgttagaaactttaacgttaaatttgtttgattgctattttaaataa

SEQ ID NO: 891 - DNA, 519 bp, Unknownn
  isolated from dental, unidentified
atggctttagatttaagaaactatattgcaagtattgaaaattatccagaagaaggaattatatttagagatatttctccattaatggcagatggtgaagcttatcgccaagctactgaccgcattgttcaattcgctaaagataagggcgttgaaatgattgttgggccagaagcacgtggctttatcgttggttgtcctgtagcttatgaattaggtgtaggctttgctccagcacgtaagaaaggtaagttacctcgtgaaaccgttaaggctgactactcattagaatatggtacggcgtcactttacatgcacaaagatgcagttaaaccaggacaaaaagttttagttacagatgatttattagcaaccggtggtacaattggtgcaacaattgacttagttgaacaacttggtggtgttgttgtaggttgtgcattcatcattgaattagaagatctacatggccgtgacaagattaaaggttacgatactttagctttaatgaaatactaa

SEQ ID NO: 892 - DNA, 858 bp, Unknownn
  isolated from dental, unidentified
gtgtttggtaaacgaaaagattctaaaaataaagccatgagagataatgaagaacttacgccttgggaaagacagcaattgttgcgagaagaaaatatagagaaaaaacaaaagaaatctaaaaaaatcttggtaagtagcaatttagttaaattcaatggtcttagaaaaagaagacttcaaaagcgagtaataactctagcatcaatttttggaattagtgcaataatatctttatacgcaatccttccagttagtagagtgagtaatatagagatagaaggcacagatagccaaacaaaaactgctattatagaggcaagtcaagtgaaaaaaaacgaatctttattcgcggttgtacctactaaatttttgattaggcaacgtataaaaaatgatgtagcaactgtcaaagatgtcaatatctctttgaaaaaaaatgtcgttaaatttaaagttactgaatatgatattgtcggatatattcaaagaaagaatacttattataagttaacttcaaatggacgtgaattaaatgtaggtcaaaaggcaaccaatggaaattacccgttatttcttgatttcaaaaagaaaactttattacatgaagcagcacaacaggtaggagagatgcctaaaaaagtaagatttggaatttctgaaatacattctagtccaacaaaggtaaaccctaaacgagtgagattagtgatgaatgatggaaatgaagtaataggaagtatagatactttagcaacaaaaatgagttattatccaagcatggctaaagctctaggtaaaaaaggtgtgattgatctagaagtgggtgcatatgcttatccttatgataataagtaa

SEQ ID NO: 893 - DNA, 834 bp, Unknownn
  isolated from dental, unidentified
atgtataaattagtagcgattgatatggatgaaactttattgaatgatgacgctgaaattacacctaaaaatgtatccgttctcaaaaaggcgattaaagacggagtaaaggtggttttaaatacaggtcgaagctacctctctgttcaagaaaatttgaagacattaggaatttaccaaactaaagatcaatatgtagttagttttaatggtggagcgattgttgaaaataaagatttaaaggtggtacatgttgaaggattggcctttgatattgttaaacaattgtttgatatcagtttgagatattatcctgaaagctgtatccacgtttatactttggatgaattgtacatgtggaatgtcaatcaagacgaaaaagattacttgcaaccacgtggagtagagtggactgaattgcaagaacctaatattgatttcttaaaagatacgcctattactaagattatcatcaatgttaatgatatggataagagacttgcctttaatgagattgcacgtaaagaaattggagataagttcaagaccacatattcttcaggtcgttatattgaattcaataacatttcaacagataaaggtacagggatgttgaaattagctgaaatgttaggaattaagccagaagaaacaatcgcgattggtgataatagtaatgacttgccaatgattgaagctgctggagttggtgtagctgttagaaatgctaatgaacaagttttatctaaagcagattatatttgcaagcgagataataatcatgatgccgttgctgaagcagtggataaatttatttataataaaatagattaa

SEQ ID NO: 894 - DNA, 597 bp, Unknownn
  isolated from dental, unidentified
atgagaaatgtttcaattaaaagatatgcaataattgcatgtcttgccgctatttcatatttactaatgtttatttcattcgcagttatcccaattgtgccatatatgaaagtagactttgcggatattccaattctattaggattcttcgtattaggtgttagtggcggtattgaaatcgcagtattgagatcagttctatactttttgattaccggtccatcaatcgcaagtttgattggaattggaactaatttattagctacattaacaatttgcttgccaatgtattatatcttacatgaaaagcatgacttgaagagatacattattgcgattgttgtatcaactatctcattgacattctggttatctataggtaactggttagtgattacaccattatacatggcagtgttaggtatgaagttaactttacctttaagtcaattagtgttatatggagtattgccattcaatcttattaaaggtgtaattgttggaacagtcttcgtactagtttacgcaaagattcatgtatggttggacaacaaagcaaatgaatttcttgctgaaacaaaaacaaaatcaatctag

SEQ ID NO: 895 - DNA, 1203 bp, Unknownn
  isolated from dental, unidentified
atggctaaacttattgtttcagatttagacgtaaaaggtaaaaaagttcttatgcgtgttgactttaatgttcctattaaaaatggagtaattggtaacgacaaccgtattgttgctgctttaccaacaatcaactacattattgaacacgatggaaaggctattttattctcacacttaggacgtattaagaaagaagaagataagaaagaattatctttacgtccagttgcagaacgtcttgcagaattattaaacaagcctgttacatttgttcctgctacacgtggagcacaacttgaagatgctatcaacaatatgaatgatggtgacgttcttttagttgaaaatactcgttttgaagatttagatggtaagaaagaatctggaaatgatccagaattaggcaagtactgggcatcattaggtgatgtatttgtaaatgatgcatttggtacagctcaccgttcacatgcttctaacgttggtatttctgaagctatgaaagctgaaggtaagcaagctgctgcaggttacttacttgaaaaagaaattaagttcttaggtaacgctgttgacagtccaaagcacccatttgttgctatcttaggtggtgctaaagtttctgataagattggtgttattaaccacttattaggaaaagctgataaagttatcgttggtggtggtatgacctatacattctacgctgctaagggtatcaaaatcggtaactctttagttgaaaaagataagatcgaattagctaaggaaattatggaaaaagctggcgataagctagtattacctgtagacaacgtatgtgcaaaagaatttaacaacgatgcacctagtgaagttgttgaaggtgatattccagatggttacatggctctagatattggaccaaaatctgttgaattatttgaagatactttgaaagatgctaagacagttgtatggaacggacctatgggtgtatttgaaatgagcaactttgcaaaaggtacacttgaagtaggtaagttcttaggtactttaagcgatgctacaacaattgttggtggtggcgattctacagctgctgtacaacaattaggtgttgctgacaagttaacacacatttctactggtggtggtgcttcccttgaatatctagaaggtaagacattacctggtatcgctgcagtttctgataagtaa

SEQ ID NO: 896 - DNA, 1203 bp, Unknownn
  isolated from dental, unidentified
atgcaaggagaattgcttatggtaaatttgctatactttatgattataatgattactatgtttcttggtgaatgggtttctaaaaaaactcattcctggattccatccatttttatcactgctattatttttttgattggcttttggacaatctttcctaaagatttaattaccaaagcatcatacactaaagattttataacaattacaattggacttctcttagttcatttaggaactttaatgaatatcaaaaaattaattcaacaatggaaggctgtttgtatcgctattttaggaatgttaggaactttaattttcaccctaactattggcttagcattttttggtcatgatttagttatttcaactataccaactctaactggaggacttgttgctgctgctttaatgactcaaggcattgaaaaagaaggcctattaacattagtagcttatcctgtagcaatgtttgtttgccatcatattattagttttccaatgatttcagcctgtcttcgaaatgaaggctctcgcctcaaagcagtctttagaaaagatcctgataccgctaaggctatggttgccgaagatacctcttcttcttcgactaataattggcaacattactttagcttaggggaaaaatatgatactcctgcctttatcattgctaaagttgcagctattgctgtttttagtttttgggtaggaaatttacttaatggagtaattaactcaaatgttttatgcttagttttcggtgtcattgcccatgcaattggatttttacctagcaatgctttaaataaagctggtgtctttaattggctaatgtatggattattaacctttatcttagctgagttaaacgcaactactccatcaactattggcaaaattcttcttcaagtacttgtattaatcgcattaggattgtcaggtatgtttttagcatctgtactattagctaaaccattcggtatgagccgttctatggcatttgcatgtgctctaactgccttatgtggtttccctgctgactatattttgactaacgatgttgttaatagtttgactaacgattccgatgaacaacaatttctactagacaatatgcttccgaaaatgttagttggtggatttgcaactgtttcaattgcttccgttttaatcgcatctttcttcttaaatatgctttaa

SEQ ID NO: 897 - DNA, 870 bp, Unknownn
  isolated from dental, unidentified
atgaatgttaagataaaaaatagagtctacactgtagtaggtggtataggcaatttctatcttttatatgtagcatggcgtttctttgcgaatggttttatcggaagaggacttctttttattttagcattcctagtgttgttatattttacttatcttaatgcaatatattggtttacagaaaagaaagctaagtgggatatttctcctaaaatcgaaaatgctttaggaattaagcctaaggatcctgaagaagaagctcgcaaaaaagttgctagaatgagacaagcaggatttgtgcaaactaatggtatttttgatgaaaatcaagatttcttaccggcagaaataacaacttctgaagcggagttagctaatattcaaattgttgctgacagtttgaagaagattaattatcttcatcttgattatgatggaaagagtaagaataccatctttaaagaaataaaaagcgatggaaaagttagatatgctttaggtgagacaccacaagcattaccatattttgaattgaaaaatgtagaaggtaaattagttatttatggtggtattaatcaaattgaaagttaccaattaggaactgtcaaaacaattggattaatgccagctagtgaagcagctaagaaatatcatatttatttggcaactgttgtattaacaggtggaccatttatgatagcaggacgctctacagcgatggaagataatgaaccgtttagaattgatgcaaaaattgcatatactagtcgcgaaaaaaaggctgcacctaaggttgattcttcttactatgaaagaacttcaagtattgaagatgaacatttaagcagacgtagagacagaagaaggtaa

SEQ ID NO: 898 - DNA, 630 bp, Unknownn
  isolated from dental, unidentified
atgaaaggaaaaatggaaatatttaaacaaagtaaaatacaaattatatctttgatatcgttggtagcaatgatattactattaatattaggtggaaatattgcgaaagctgatgatgttagcagttctagcagtagctctacaaatgagacatcatcaagtgtagttgttaaaagccaagattcttcaaatgtttcacgtgaaacaagtagttctgctactagttccaacagttccagtagcgtatcgtcaactagtggaagttctagttcagttcagggaaatgctacttcaaaagcaaatacgcaagtctacgtggtagcaacagttgataattctaaggctaataatacagataaagatactgatcaacaagcagatgctagttcagttgaagtggtagtagctgataacgaaagtcaacctagtgagtatgctagtgtaaaagttagcaataagaatgtaaagaaacattctgaattatcaatgcctaagatagaatccactaataactttcctaaaacaggagataacgctaaagaatggttgccagtctggggtgcagttgttctagcagttggaagtatcctagcaagtattttatatgcacaagagaaagaaggtaaataa

SEQ ID NO: 899 - DNA, 867 bp, Unknownn
  isolated from dental, unidentified
atgtcagtattcgtaaacggtaacgcaatctttaacgcagctcgtcaaggtcactatgctgttggtgcgttcaacacaaataatttggaatggacacgtgctattcttaaggctgctcaagaaactaacacacctgtattgatccaagtatcaatgggtgctgctaagtacatgggtgactacaagttagttaagaagttagttgaagaagaaatgcgtgtaatgaacatcactgttcctgttattatgcacttagaccatggtaactatgaagctgctaaggaatgtatcgaagcaggctattcatcagttatgtttgatggtcatgacttgccatttgaagaaaacttagaaaagacagcagaaatcgttaaattagcacatgctaagggtatctctgttgaagctgaagttggttctatcggtggtgaagaagacggaatcgttggtgaaggtgaattagctagcgttgaagaagctaagcaaattgctgctttaggcgttgattacttagcttgcggtatcggtaacattcacggaccatacccagaaaactggaaaggtctacactttgatcgcttacaagaaattgcagatgcaatcgatacaccattagtattacacggtggttctggtattcctcaagaacaaatcgaaaaagctatcaagatgggtatttctaaagttaacatcaacacagaaaaccaacttgcatttgctgctgcaacacgtaagtacatcgaagctggtaaagaccaagaaggtaagggttatgaccctcgtaagttacttgctcctggttcagaagctatcgttgacacagttaaggaaatcattggctggttaggtacaccagaagttaaataa

SEQ ID NO: 900 - DNA, 2157 bp, Unknownn
  isolated from dental, unidentified
atgaacacaaataataaacgtcctataaaagaaagacaacaaaggatgatgtacaatcgaaagtattttgggaggggaatattttttattgttcttatcgtttttattgtttttatcggacgtttttttcgtgtagctgtaggacataaaatatatggtgtggatctaaataagagtacacaacagctatacgcaagtaaaactgagataaaagcgaaacgtggaacaatatatgatgcagctaatcaaccaattgctgaggatacgactacttactcaatatatatagttctctctaaaagtgcagttgcttatggaaaaaaagaatatttaccggattcccaaaagaagaaagctgctaaagttttaagtgataatttaaatattagttataaaagagtattacaaattttgaatcctaaagataagaatacttatcaagttgaattaggaaatgttggtaagaatatctctcttgaaactaagaaaaagatagattcttatcatttaacaggtataaaatttacaccatcacagtctaggttatatcctaatggtgtttttgcttcacatttgatagggttagctgaatcggaggataaaaagctagtaggtattatgggactagaaaaagtatttaataaacaattatctggtcgcgatggaataaataatactgctacagatagttacggtgttcagttgccgggatcttctaaaaagaaacgaagcgttcaaaatggcgatgacatctatacaacattggatcctaagattcaaactgccttagaaaatttacttacacaaaagcaaaagaaatttaaggctgcatcaattaatgcggttgttatggattcacatactggtaagatagtagcagctagccaacgtccgacatttgatgctcaaacaaaagaaggtttaacaaatgtttggagaaatacactgttagaggatgcatacgaaccaggatcaactatgaaagttttgacagttgcatctgcaattaatagtggaaattatgattcaaatgcaacttatagatctggatcatatgtgattgatggatctacagtgtacgactggaatcgttctggatggggcaatattacagttaaagaaggctttatgcgttcatctaatgctgtaatggctcaacttgaacaaaaaatgggtaagaaaacctggatgagttatattagaaaatttggtttacttcgcccagtaggtgcaggtttaggtgcagaatctagtggtaatatcaattacacatatgcatttgatcaagctaatacggcttatggtcaagggatagatgttactgttattcaaatgatgcaggctttttctgcaattgctaataagggtaagatggttaagccacgcttggtagataaaatagttgatcctaatacaggaaaaacagtttataaatcaaaaacacaagtggtcggtaaaccaattactgcaaaaacaagtaagaaagttttagatatgatggaagctgttgtctatgacgaaaaaggtcttggacaagattatgcaattgatggctataagatagcagctaaaacaggaactgcccaaatcgctaattcaaacggaacaggttatttgagtggtagttctaattatatcttctcagttgtaggaatggcgcctgccgataatccaagatatattatgtatttgactgtaaaacaaccaaaatcatttggaaataatgatgctactaagaatctatcaactattttcaacccaattatgaaaaaagttttagattcaagtcaagtaaacaatactaatcctggtacagttaaagtcgaaaatgttgttggaaactcagttgatgatgctaaagataaaatttcaaaacaaggcttggtacctgttgtagttggtagtggtgataaagtagagaaacaatcagtcgagggagatcagactgttatttctggagaaaaagtattattattgacgaatggaactaaaactatgccagacataaatggatggtcaagaaatgacattgctaaactggctgatttaactggaattacagttaattatactggatctggttatgcatactatcaaagtatagcggctggaggagcacttaagaaatctgatatagttgaagtaaaattaaaatag

SEQ ID NO: 901 - DNA, 1140 bp, Unknownn
  isolated from dental, unidentified
ttgaaaaatgataatacgaattatccaagccgttctgaaaaattgaaaaagcaacgtggaatagctggtaaaattgtttcatggattgttggaattttagtggtattagtagttttgatgggagtgatgggatataagtatattcattcttctttacaaccattgaacgccaatagtactaaaaaagtagaagtgaaaattccaataggaagttccaataagcaaattggagatattttagagaaaaataatattattaagagtggtattgtttttgattattatgtaaagactaataaagtaggtaatttcaaagctggatattatcaattaagtccgtcaatgactttggatgaaattgcaaagaaattacaacaaggtggtcaaagtaatccccattctaatggcacaattctaattaaagaaggtgctagcatagatcaagttgctgatgtagttcaaaagaatactaagtttaaaaagcaagattttctaaagctaatgaatgatgcaaactttttgaatgagttaaagaacaaatatccgcaattgctatcttctgctgttgatgctaaagatacaaaatataagttggaaggatacttatatcctgcaacatatacagttggaaagcacgacaatttgaaagcagtagttgaacaaatggtagctaagactaatatggaaatgaaaccatattttgataaaatttcaaaatcaaaatattcagttcaacaagttttaacactggcatcgctagtagaaaaagaatatggtagtgctgatgatagaggtaaaattgccggagtatttgaaaatcgtttagaacaagatatgccgttacaatctgatgtagctatccattatgctttaaataacagtaaatcaactgtatcatatgatgatttagaagttgattctccatataatctctataaaaataagggattaggcccaggaccatttaataatccaagtattgattctgtgaaggctgttttaaaccctgttgataaagacaaaggatatttatatttcgtagcgaatattaagacaaagaaagtatatttctctaagacatatgctgaacatcaaaagaatgttaaaaagttgcaaaaagcaaatggatatgaaaattaa

SEQ ID NO: 902 - DNA, 1353 bp, Unknownn
  isolated from dental, unidentified
atggctcatatttcatttgatagctctaacttaactaagtttgttaatgacaatgaacttggcgaaatgcaagctttagtaactgctgttgataaagaattacgcgaaggtactggtgcaggtaatgacttccgcggtttcttaaatttaccagttgattacgacaaggacgaatttgacagaattaaaaaagcagctaaaaaaattcaatctgattctgaagttttagttgttattggtatcggtggttcttacttaggtgctcgtgcagcaatcgatttcttacatcaccaattcttcaacttattaccagctgaaaagagaaatgctccacaaattttcttcgctggtaactctatttctggttcttatgtacatgacttaatcgaattaatcggagatcgtgatttctctgttaacgtaatttctaagtctggtacaactacagaaccatcaatcgcattccgagtatttaaggaaaaattaattgctaagtacggtgttgaaggtgctcgtgaacgtatctatgctacaactgatcgtgctcgtggtgctctaaagactgaagctgacgcagaaggttacaaaacatttgtaattcctgatgatgttggtggtcgtttctcagtacttacaccagttggtttattacctatcgcagtctcaggtgctgatattgataaattaatgcaaggtgctgctgatgctcgtaaagaatattctgatgctgatttaacaaagaacgaagcataccaatatgctgctttacgtaatattttatatcgtaaaggttatacaactgaaattcttgaaaattacgaaccaacattacaatactttgctgaatggtggaaacaattgatgggtgaatctgaaggtaaagatggtaaaggtatctatccttcttcagcaaacttctcaacagacttgcactcacttggtcaatacatccaagaaggtatgcgtaatttaatggaaacagttatcactgtaggaaatccaacaaatgatacagatattcctaaagaagaagaaaatcttgatggcttaggttacttagaaggtaaatccatgaactatgtaaactcaaaagcattccaaggtgttgttcttgctcatacagacggtaatgttcctaacatgattgttaacattccagatcaaacagaatacacattaggttacatgatctacttcttcgaaattgcagttgctatttctggatacttaaatggtattaatccattcaaccaacctggtgtagaagcatacaagaagaacatgtttgctttacttggtcgtccaggttacgaagaattaacaaaagaacttcaagatcgtttgaataaataa

SEQ ID NO: 903 - DNA, 876 bp, Unknownn
  isolated from dental, unidentified
atgagagtggtgatttctttgaagaaaattgtaaaaattattacttgcttgttagcattcttaatagtaggagcaactctagcaggttgtacaaatgttagaaaacgtgctaatggtcaagataattggaagaagattgagaagaaaaagaaagtagttattggtttagatgatagttttgttccaatgggatttcgtgaaaaagatggttctttagtaggatttgacgtagatttggctagagaagtattcaaacgttatggaattgatgtagattttcaaacaatagattggtctatgaaggaaaccgaactaagaaatggaactattgatctaatttggaacggatatacagtaaatccagagcgtaaaaagactgtagctttcagtgttccatatttacgtaaccaacaagtgcttgtatctaaaaagaaagaaaatgtttatgatgctaagagcatgaaaggaaaggcattaggactacaatcgggttcatccggttatgaatcctatatgtcacaacctaaattgttaaagaactacgtaaaagaagcagttcaatatgatacattcaataatgcatttttagacttaaatgctaatagaattcaaggattattaattgacagtgtttatgcagactattatgttgcacacgaacctgatcctaatagctaccgtattagtgatgttggatttgaatccgaaaattttgctgtaggtatgcgtaaaggtgataaaactttacaaaagaagattaatgtagcattagctcaaatggcaaaagatggaaccttgcaaaaaataagtaataaatggtttggtactaccaaaatggtacctttgaaagagattgagaatcaaaaaattgattaa

SEQ ID NO: 904 - DNA, 1950 bp, Unknownn
  isolated from dental, unidentified
atgtctagtataaaaattacatttccagataattcagtaaaggaatttgatgctagtgtaacaacagctgaaattgctaaatcaattagtattagtttagctaaaaaagctgttgcaggaaaagttgatggtaattttgttgatttaaatcaaccattaaaagaagatggatctattgaaattattacaaaagattctaatgatggattagttgtattgtggagaacagcagcacaagttttagctaatgcattgcatgaattatacccaaatatgaaatttggtttgggtgatgttacagagcatggattctattttgatactgataattctgaaggtcaagttgcagaaacagattttgaaaagatttctcaaaaaatgtctgaaataataaaggcaaacttacctatagaacgagttgagttttcagaagaggaagctttgaatttagtatcaggtgacgaatatcaagaagaattagttagagatgtagctaataaaaataatggtagagtagttgcttataagcaaggtgatttcattgatatcactgatggagtagttttatcttcaactggtgaagtaaagatttttaaactattatctgttgctggtgcatactggaaaggtgcttcaagcaatccaatgttacaacgtatctatggtacagctttttataagcaaaaagatttggatgctgaattacaacgtcaaaaagaagctcgtgaaagagatcatcgtgtaattggaaatgaattagatttattctttgttgatcctaaagttggtgcaggattaccatattggatgccaaatggtgcaacaattcgtcgtgtaattgaacgatatataattgataaggaagttgcatggggattccaacatgtttacactccagtgctagcaaatttgaacttgtataagcaatctggtcattgggatcactatcgtgaagatatgtttccaccaatggatatgggcgatggtgaaatgttggaattacgtccgatgaactgcccatcccatattcaagtttacaatcatcacaagcgttcatatcgtgaattgccattacgtatcgctgaattaggtatgatgcatagatatgaaaaatctggagcattaacaggattgtctcgtgttcgtgaaatgactttgaatgatggtcatgactttattgaaccagatcatattgaagatgaaattaagactttaattaaattaatgacggaagtttataatgactttgatattacagattatcgtttccgcttaagttatagagatcctaagaatacagaaaaatactttgatgacgatgaaatgtgggaaaaatctcaaagtaagttaaaagctgctatggatgatatgggactagaatattttgaagctgaaggtgaagctgcattctatggtcctaagattgatgtccaaactaagacagctttaggtggagaagaaacattatcaactatccaattagacttcttattgccagaaagatttgatttgaagtacattggtgctgacggtgaagaacatagaccagttatggttcaccgtggaattgtttcaactatggaacgttttacagcttacttaactgaaatgtataaaggtgcatttccaacttggttagctccacatcaagtagatattattcctgttaagaatgatttacatatggattatgtaaatgatttaagcagtaagttgagagcacatggcattcgcgttactgttgatgatagaaatgaaaaaatgggatataagattcgccaagctcaagtaaacaagataccttatacacttgttattggtgatgaagaagtttcaaatggaacagtaacagttcgtaaatatggtgaagaaaagactaacactatgacaaaggatgaatttaagaatcttttgtttgaagatatagaaaattatagtagagaaaaataa

SEQ ID NO: 905 - DNA, 2004 bp, Unknownn
  isolated from dental, unidentified
atgaagggattgaaaaaaatgccagtaatagaattaaaaaatgttactaagacatataagatggctggtggaggaacctttgaagctttgcgaggaattagtgcaagttttgaagctggagaactggtagcaatcgttggtgaatcagggtcaggtaaatctaccttaatgaatgcaattggtggattagattctgattttggcggagaaattatttatgaaggaaagaatttacgtaatttttcaactcaagaattagttgactatcataaaaagagtataggatttatttttcagaactttaatttgatctcacatttaaatctaatagataatgtttcaatggcgatgacattatcaaatgtaagtgaagatttcaggaaaaaacgtgcaaaagaattattacgtaaagtaggattagaaaaacatatgtataaaaaaccagatcagatttctggtggacaaaaacagcgtgtagctattgcgcgtgcattggttaatgatcctgatgtaattattgctgatgaacctacaggagctttggatgcggaaacgacagataccattctcgatatgattaggggaattgcagaagaaggtaaattagttttgatggtaacccattctgacaaggtagcctctcattgtagtcgagttttgagaatagataatggtgagttaatttcagatgagcatcaattggacttggaatacacagaaaatactcgtgaagatattaaagtaaagaatatgagtatgtggaaagcaattaagctagcatttctaaatatgaaagccaagttaggaagaaatttactagtagcacttgggtctagtatagggatcatgtcagtagtattgatgttagccttaggtaaaggtgtaacaagctatgtaagtagtactatgaagtcatatactaaccctaatattactgaagttcataagaagagtagtactcaacaaacgacaaaaaatccacaaaatatgagtcgtgaagagatagctaagcaacagcaagagaatatggctgccttaacggggtcaggaactaatacaggttttacaaaaaaggatatagaaaagttaagtaagataaaacatgtagatagatatcaaaaaggttatagttcattttcactaggaactaatacagttaaatataataataagcaagctagtttaatgatgttgcagacaatgtctgatagtatttctaagtcgagcattgtggaaggaaaagctcctaagaataatcatgaaataatgttagatagagctactgcggatttactaggaaagaatattttagacaaagaagttactttgactttgaagataggtgaaaagacaattacacaaaactttaaagtaacaggtttatatgaatcacaaagtcaaagttcaagcacagttttctttacttatgcaggtttacaagatctatataagacaaaccaagaaaaattattgccaaatgtagtatatctacatacagctaacaaagacaacactaagatgattaaggacaaagtaaaagatcttggttatacaggttcaatgcaagaacaaatgacggaaatgtttacgaaaatgttgaatattattacttgggtattaactgctatcgctgctgtttcattagtggtttcagcaattatgatattggtagttttaaatatttctgtagttgaacgtacaaaagaaataggtgtacttaaagctctaggtgctagaagaaaagatattagaagaatatttgcttctgaggcatttttaattggaattacatcaggagcaattggcgtagttgtaacttatgttctaggtttcttcattaataactttacgaaagcggctttcgaagtaaatgttgtttccatgactactaaatatgcaatagctggaatagttattagtgttgttatcagtatgattgccggaattttaccatccaatagagcatctaagctagatccagtagaagctttacgcaaggaatag

SEQ ID NO: 906 - DNA, 1101 bp, Oribacterium sp.
  isolated from dental, Oribacterium sp.
atgagagtaaagaaaaaatatttaatagaatggctattaataattttaagtggtattcttatctatttttttgttgataatgatgcttttttatataaggatccagttgctcaaattgtgagtgtaacaaattcaaaagcaactaaaacagaagatacatataaaaataaggatatgacgacggaacaaactttaaaagtgaaagttcttaacggtcatagaaaaggagaggtgttaacagccaagaatactttttctaaatcaggcgggtatgatcagagattttaccgtggacaaaaagtttttgtgaagtttgagaattcaaatggcaaagtaatggcaatgataaataattataagcgggatgtttatttaataatgctatgttgggcggtagtagtattactattcttagtcacacaaattagaggatttacttcgttaattagtgtcattttgaatttcataattttcttgctatgtgtacaactagatgttaaatggaatattaataatttcttctggatattcgcaacagttgcggtaatttttctggctttatctttggtgttagtaattggttttaattggcaatgtctagtaacatttagttcaatatttatcggaacaactttagcgatgataattggagtagtggcgatgcaagtgactaatgataaaggagttcattatgaggctctagactttgctactcagtcaccaaaacaactatttttagcggccactgtgattggattattaggggctgttatggatgcagctactgatattgtatcaaccttatttgaaatgaaacgtactcaacctggaatttctagaaagcaattatttatttcaggacaaaatgttggaaaatcaataatggggccattggtaaatgtcttgttattaatcttttttgccgaaactgtaacaatggcagttttatttttcagaactggaaattcaattgcatatacgtttgaatggacaatgtcattaggcattattcaaagtttaattagtgggatagggattacgttagttattccttcagctagtttactgagctcattagtattgggtggtgataaaaaatga

SEQ ID NO: 907 - DNA, 597 bp, Unknownn
  isolated from dental, unidentified
gtgataattgaaaggggtggcgatgtgtctgaagaaaaagtaaaagcttctgagcaaaatgaagatattgaaaaagaaattaaagaagatgataaagcttcatctgttgagaatgaaaaatcagtagaggagacagatgattcttcaaaagcattagatgaacttcaaaagaagtacgatgatattgaggataaatatttacgagctgaagctgaaatggctaatatgacacaacgttttaagaaagaacaagaaatgttgttgaaatatgaaggtcaagatttagctcgtgatattttaccagttattgataatttaaatcgagctttagaaattgaagtagataatgatgcatcacagcaactgaaaaaaggtatagaaatggttgctcgtgatatggaaaaagccttgaaaaacaataatgttactaaaatagattctctaggaaaggtgtttgaccctactttacatcaagctgtaaagacagttcctgtcgaagaaggacaagaaccagaaactatagtacaagttttccaagacggatacatgctaaaagatagagtattacgaccagcgatggttgttgtagctcaataa

SEQ ID NO: 908 - DNA, 1431 bp, Unknownn
  isolated from dental, unidentified
ttgaataagaaaacattttggaaaaaaataacgcaaaagcaaaatcctaaactatatgcagcgaaagattcaaaattaattcctagtttaagaactctagatttaattggtctgggaactggaatggtagtaggcactgctatattcactttaccaggtatcgtggctgctgaatatacaggtcctgctgtcccgttggcatttattataggagcaataggtgctggactttcggcacttgcttatgccgagatggcttctgttttgccgtttgctggatctgctttttcatggataagcgtactctttggggaattctttggctggattgcaggctgggcgttattagcagaatattttatttctgtagcgtttgttgcttcaggttggtctgcatatatgcaaggatttttaaaaagtatgggtatttatttgccagtagctcttagtgggggttttaatcctaatactggacagatttttgacgctttggcggcttttgcaattttgttagttactgtcttattgtcaaaaggtgtaaagcaagttgccaggatagaaaatggaatagtaatgttaaaattaatagtaattattatttttattgcagtaggagcaacggctattcatcctgataattatgttccatttattcctgctcataaagctggaactcattttggtggcttaacgggtattttagcaggtgcatcacaaatattcattgcttatgttggttttgatgctattgcagcaaatacagctgaaactattaatccacagaaaacaatgcctaagggattattagggactctatttttaggaacaggattttttgtactagtttccctagtattagtcggaatgtttaaatatagtatttatgctggtaatgctgagccagcagcttttgcattaagaaaagcaggacattattttacagcaaatttattatctttagtagctataataggtatattttctgctttaataggtattttattggcttcatctaggttgatttattcatttggtagagacgggcttttatcctcaaaattagggaaaattaatactaaacatgttcctaaaaatgctttatggtcaatttcattaggtgcattaatattagcctccttttttccattcgattttcttgcaacattagtatcagcgggaactttagtggcatttatttttgtttcaatagggatttatgctctgagaaagagagaaggaattgacctacctgaagctaaatttaaaatgccaggatatcctttgttaccagctatttcagcattagtgtcaattataatattttggaatttaaatattgatgcaaaactactaatgttggtttggtttataataggtattgttatttattttgtatatgggatgcatcattcaaatttgaataaaaaataa

SEQ ID NO: 909 - DNA, 558 bp, Unknownn
  isolated from dental, unidentified
atgtacaaagaaaaactattaattttattagaaggcgctttgatggctgcgattgccactgtactaagtgctgttgtaccaacggtcgaatggttcgatatttctttaggaattattccaatcgtaatttttagtattcgccgtggtctaaaagctggtcttttgtctggattactttggggattacttccaattttaattggtcgtgcttctatccttacagttactcaaggaattttggaataccctgtagctaacatggttgttggtttagctggaatttattccaatcaaattaagcaagcactaagcaacaataattggcatgtagttttcagtcgcagtttgttagctgttttcatcgccgtatttgctaaatatttctgccacttcgttgctggcattattttctggggatcctatgcacccaaaggcatgagtcctgtactttactctttatttgttaatggtggtagtttcctatttaatttagtcttagctggcatcgttgtcgttgctttagaaagaaaagcagatcgaatatttgcattatcttaa

SEQ ID NO: 910 - DNA, 804 bp, Unknownn
  isolated from dental, unidentified
atgagtgagaactggctgaacttaaatgaaaaggtgtacattgtaacaggtggttcttctggtatcggggaagcaattgtaaaagaattattaaatgacggcgcatatgtatatgatgcagatttacaaccagctaaggaagaacatgatcatttaacatttgtagagacagatgtaacaaataaaggacaagttgatgcattagttgctagagttgttgaagaacatggacatgttgatggtgttgtaaataatgcaggtattaacttaccaagattgttagtagatgctaaggaaagcaatagcaaatatgaattaactgaaaatgattttgacaagatgtttaatgtcaatgtaaagagtgtatttttgatgtcacaagctgttgctcgtcaattagtaaaacaaaaatcaggtgtaattgttaatatggcttctgaagctggtctggaaggttcacaaggacaaagcatttattcaggaactaaagcagcaatcgtaggtttaacacgttcatgggcaaaagaattaggtgaattcaatgttcgtgtagtaggtgtagctcctggaattatggaagcaacaggtttaagaacactagcttatgaagaagctttggcatatacaagacataaaacggttgaagatgtccgtgcaggatacaagagtaagagtactacaccattaggaagaagtggtaaattatcagaagttgctgatttagttgcctactacttatcagacagatcaagttatataacaggtgttacaacaaacgttgccggaggaaaatctcgcggatag

SEQ ID NO: 911 - DNA, 222 bp, Unknownn
  isolated from dental, unidentified
ttggcacaaaaagtgaagttgaagacagactatataactttaggtcaattattaaagattgttgacatcattagttctggtgggcaagcgaaatggttcttacaagaaaatgatgttttgatcaatggtgaattggataatcgtagaggtagaaagttatatcctaacgatttagttgaaattcctgaatatggaaagtttatgatggaagctgacaaataa

SEQ ID NO: 912 - DNA, 978 bp, Unknownn
  isolated from dental, unidentified
atgagaatatttagaaataagttgttgatcattttatatgtctgcttattagctttttgtagtgtttgggtattctttaagattcaagaacgcgatattgttaatcaattgaacaatcataacctttcacaaaacgcctatgaagtagtgatgaaaggaacaacttctttggaagatattaataataagatttctaactctagcaaaattgatgatgttcaagttcattatcaagataagaagaatagtaatctaacttatttctttggaaaaggtgattacagcactacaccaatggtttctggcagcttttttgctgataatgactttaattcagaagttacagtagctttagtaggaaagaatattgctaaaaaactatacaaacctaaagatcaagattatttaaaagtaaactcaggttatttgccagtattaggagttatgggagaaaaacgaagctcttcaagtttagatgatcagatttttatttcaggtgcaatttcaactttaaagactttaacaagtaacgattatcgaattgtgatagattctgaaaagcctttagatgcaaaagttattaaacatgtcttaggtgccaaagaagttaagacaatgtttactaactcattgggtattcctaagggtgtatggttaacttccttagttcgtaaattagttgcgctattgtttatttttgcagctttcttggcagaagcaattttatggggtgtatcttacaagagaagatattctattgcacgtgcaacggttaatcgtgccactttccaagaatggcaagtctttacaattttagcacttgtaggaatgagtgcagggacaattttaggcttaatatattttacgctatatagttatactggaactatcatttttaactccttaatgttaataacgggaagtatcgtttgttacttaacaatttatgataggataaaaaaacaagtaaaggaatag

SEQ ID NO: 913 - DNA, 1749 bp, Unknownn
  isolated from dental, unidentified
atgagaggtaagaagatgcagattttgatggcacattttaagaactataaaaaagaagttcttagtgcaattatttcaatttttattgtcgcatttgtcgcggtttggcaaccgagattactgcaatatgtgctgactgcaatagtgcaagataatcaagcagaagttagaaactacggaattcaattaataattttggctcttgtgggaattatcgctgggattgttaatgtctactcggctgctagagtggcacagggtgtaaccagtgatttgcgtgaagaagtgtacacgaagattcaaaatttttcttttggaaatattgagaaattctccaccggtagcttagtggtacgtctaattaatgatatgaaccaagttactaatatgattatgaccatatttatgcaagttttccgggtacctttaattttagttggtgcttttattttgggaataataaccgttcctcgcttatggtggctagaagttctgatggttgtcttaatcatgggaataacggcaattattttcaaaaagatgggatctttattcgataaagtccaaaatttaatggataagatcaatacgcaggctaaagaaaatttacaaggtgtccgtgtagttaaatcttttaatcaagagggacaagagattaataaatttaatcaaacttccgatacgttaaataacgttaatttaaagataggatacctcttttcaacggttattccatcatttgaattaatcgcgtatgttattattgcggctgcgatttacctgatcggtggctcaattcttgaacatccaagtgatattgcagtgattagttcctatgtaacatatattatgcaactattgtatgccattatgattggtagctttgtaatgtctattttcgctcgtgggggcgtttctttaaaacgtattaaagaagttctggagactcaacctgatgttgtctttaaagatgatgcacctgcagaagaactggatggggatgttgaatttgacaatgttatttttgcttatccagatgcagataaaccaatcttaaagaatatctcttttaaagttaaatcaggcgaaatggtgggaattgttggtgcgactggttcaggaaaatctagcttagctcaattattgccacgtttatacgatccaactgaaggaacagttaggattggcggacatgatttacgtgatgtaaatgagaaatcattacgtgatactgtgtcgtatgttctacaaagagcaattttattttcaggtacaattgctagcaatttgcgtcaaggaaaagccgacgctactaattatgaattagagcgtgcatcgcaaatcgcacaagcacaagaatttatcagtcgttacaaagatacttttgatcacgaagtagaagaacgttcatctaacttttcaggtggacagaaacaacgtctttcaatagctagaggtgtagttggaaaacctaagattttaattttagatgattcaacttcagctctagacgctaaatctgaaaagctagttcaagaggctttagaaaaagaattaaaagatacgacaacatttattattgctgaaaagattgtgtcagtaatgaatgcagataagattattgttttggataatggtagattggtggctcagggaactcatcaagaattactagaaaattcaccaatttatcaagaaatttatgcaactcaaaaagcacgagaaaaggcaggtgatatcattgagtga

SEQ ID NO: 914 - DNA, 897 bp, Unknownn
  isolated from dental, unidentified
atggaatataattttgaaaacaaatttgttgaaactgatgaagcaattatctttttcgacaattatattaatgttgatagtcctaaagagaaatttgtgattattagtcacttatcagctgataacttagcttatttgcaacaagcaactttgcccgaaaaaacatttgtatctcaaaatttatttttactattacaaaaattaactaaatttgaactaatagctaatttaaatttagatctaaaggttcttccttatggattcgctgtgcccgttgctgatttgaaaattactgcactcaataacgatgatggtttatggggatcaatagctctctatttggaacatgatcatcaaaaattaggctatgttgctaaatttgatattcatggaatccacaaaaaacgtattaaagcttggaaaaagttcttttctcaacaaaaattagactacttgattttaggttatcaagatcgcgatgatagtgataattatctctctaaaactggccagttaaaaaatattgagaaaactttagaacaagcagatagtactcaaatttatttggaaatgactccttttgatcctgaacaattggtaaaaattgacgatttagcacatcgcctagattatcaaattaagtggctacctggctatgctgagttaatttcttatttcaaacaacttgattttaaagaagactctcctgctgcaacagataaaactttaattcaacgtgaagctcaagctcatattactgatgatttaaccattagttctccattattagcagaagatggcaagattgattttatgaataattttgcttatccaactgaagctgagctaaaagaaattttgaaatatatcgcagctaaacaagtatattttgtttaa

SEQ ID NO: 915 - DNA, 3600 bp, Unknownn
  isolated from dental, unidentified
gtgaacaacttggcaggacacttagtaaaatacggtaaacaccgtgtacgtagaagttactcgcgaattaaagaagttcttgatctacctaacttgattgaagttcaaactgattcttacaagtggtttttagatgaaggtcttcgtgaaatgtttgatgacattatgccaattgaagattttcaaggtaaattatcacttgaatttgtagattatcaacttttagaaccaaagtatacagttgaagaagcacgtcaacatgatgctaattattcagcaccattacatgttactttacgcttaatcaaccatgaaactggtgaaattaagtcacaagatgtattctttggtgatttcccattgatgactaagcaaggtacattcattattaacggggcagaacgtgttattgtttcacaattagttcgttctccaggtgtatacttcaactccgaattagataagaatggtcgtactaactacggtacaactgtaattcctaatcgtggggcttggttagaatatgaaacagatgcaaagaatgtagcatatgtacgtattgatcgtactcgtaaaattccattaacagaacttatccgtgctttgggatacggttctgataatgaaattgtagaaattttaggatctaatagcgatagcttgatgcttactttggaaaaagatgtacataagaatatggatgattctcgtgtagaagaatctttgaaagatatttatgaacgtctacgtccaggtgaaccaaagactgctgattcatcacgtagtttgttaacagctcgtttctttgatccaaagcgctatgatttagcacctgttggtcgttataagattaacaagaagttagatttaaagacacgcttattgaatttaactgttgcagaaacattagctgatcctgatacaggcgaaattattgtaaataaggatgaagttattgataagcaagttatggataaattagctccatacttagcaagagatgacttcaagacatttactttccatccatctgaagaaggtgttgttcaagaaccaatgactcttcaaattgtgaaagtatattcaccaaaggatccagaaaaggtagtaaatgttattggtaatgcaaatgttgatatccaattcaagcacattacaccagctgatatagtagcttccatgaactacttcttcaatttacaagaaggtatgggttcaacagatgatattgaccacttgggtaaccgtcgtactcgctctgtaggtgaattattacaaaaccaatttagaattggtttatcacgtatggaacgtgttgtacgtgaacgtatgtcaattcaagatacatcaactgttacaccacaacaattgattaatattcgtccagttgttgcttcaattaaagaattcttcggaagttctcaattgtcccaattcatggaccaaactaatccattgggtgaattgtctcataagcgtcgtttctctgctttgggacctggtggtttgactcgtgatcgtgctggatacgaagttcgtgacgttcactatacacactatggtcgtatgtgtcctatcgaaactcctgaaggtcctaacatcggtttgatcaacagtttatcttcttatgctcgtattaataagtatggttttgttgaaacaccatatcgtcgtgtatcttgggaaacacataaagttacagacaaaattgactacttaacagccgatgaagaagataattacgttatcgcacaagctaactcaccattaaatgatgatggttcctttgttgatgatgtagttatggctcgtaagaaagatgatgacgttgaaatttcaactgaaaaagttgactacatggacgtttcacctaaacaagtagttgctgttgctacagcatgtattcctttcttggaaaacgatgactctaaccgtgctttgatgggtgctaacatgcaacgtcaggctgttcctttgattaagccacatgcaccattagttggtacaggtattgaatacaaagctgcacatgactctggggtagcattgatttctgaacatgaaggtacagttgaatatgtagatgctcgtgaaattagagttcgccgtgacgatggttctttggacaagtataaattgatgaaattccatcgttctaatggtggtaagaactataaccaaacaccaattgtacgtgttggagatagagtagatgctgatgaagtattagctgacggaccagctatggaaaatggagaattggctttaggtcaaaatccattgattgcatttatgacatgggatggttataacttcgaagatgctatcgcaattaacgaacgtttagttaaagaagatgtttatacatctattcatattgaagaacatgaatctgaagctcgtgatactaaattaggacctgaagaaatcacacgtgaaattcctaatgttggtgaagatgctcttaagaaccttgacgaatttggtattatccgtattggtgctgaagtaaaagatggagatattttagttggtaaagtaactcctaaaggtgtaacagaattatctgcagaagaaagattgttacatgctatcttcggtgaaaaagcacgtgaagttcgtgatacatcattacgtgttcctcacggtgcaggtggtattgttcaagacgttaaaatctttactcgtgaaggtggagatgaattatccccaggtgtaaatatgatggttcgtgtttacattgctcaaaaacgtaagttacaagttggggataagatggctggacgtcacggtaataaaggtactgtttctgttgttattccagaagaagatatgccatttatgcctgatggtacttcaatcgatatcatgctttctccaatgggtgtgccttcccgtatgaacatcggacaagttttggatcttcacttaggtatggctgctcgtaaattaggtattcacgtagcttcaccagttttcgatggtgctcgtgatgaagatatttggagtgcattacaagaagctggattacctggcgatggtaagactgttttatatgatggacgtacaggtgaagcattcgataaccgtatagcagttggtgttatgtactaccttaaacttgcacatatggttgacgataagattcatgctcgttcaattggaccttactcattagttacacaacaaccacttggtggtaaggcacaatttggtggacaacgttttggtgaaatggaagtttgggcattagaagcttatggtgctgcttacacattgcaagaaattttgacttacaaatctgacgatgttgttggacgtgttaagacttatgaagctatcgttaagggcgaaccaattccaaaaccaggtgttcctgaatcattccgtgttcttgttaaagaattacaagcattaggtatggatatgaaagttcttgatgctgataagaatgaaattgaattacgtgatatggatgacgaagacgatgatattgttaacgttgatgcattgaagaaattcgcaaaggaacaagaagaaaagaaagctaaagaagcagaacaagaaactgctgaaaaagaagaaactaagacagaatag

SEQ ID NO: 916 - DNA, 2439 bp, Unknownn
  isolated from dental, unidentified
atggtaataaatattctaaaagaaaggatcgttattatgaaattcaatcaattcgctcatgtcaaagttccttttgaacaaaaattagcagaactcaatcgtattgcttttcttcacgctggtgatgaagatttagctagcaatcatatttatcgcttatttttggagcgtgctttcccaaatttcaaaactgaaacagctaaaaatcacgctctttccaatctagcagctactgagaatgctgatattttaacttatttaaactctagtaaaataaatgcccgcgttttctatgctgttggattacaactcttaggatttgaagctgagcttgattttgatttaaaagatccattttctgcaatggataagctaaacttgccataccaaaaagaaataaatcatcgcgatgatgttattaatgcttggtatgatttactatgtacttcaactaaaaagggacaaaatttactcgatattctagctaatcgtggatatttcacacaattctaccaattgaatctgacagaaccaattttctttaacggaaaggctcaacctgtttttgatacaaataaacttatccatgaagtagtctatgttgaatcagaattagataccgatcaagatggcaagcgtgatttgctaaaagttatcattactcgtccagcaatgactgataatggtatgaaagtccctactattttcacagctagtccctactatttaggaactaatgatgctagtgctgagaaaatgatgcacagtgtcgacttaccaattaagcgtaaggaagttaagcctctttcttatcaggatattgaataccataagccagaaactaaacttcctaagaaacgtcctgttgtgatctctactaaaaatgctgaagaaagttgggaacacttatttacatatacttttaacgattacatgttagctcgtggatttgctgttgtttattctggtggagttggaactctggattctgatggctaccgtacttgtggcgatgaagctgaaactctaggagctaaagatgtagttgaatggttaaacggaaagagaacagccttcacaactaaagaagctaataaggctattccagcttggtggtcaaatggaaaagtagcgataactgggaaatcatatctaggaacacttgccacagctactgctactactggtgtagaaggattagagactatcattagtgaagctgctatttctagctggtacgactactatcgcgaaggtggccttgttattgcacctggtggatttcctggagaagatgccgacatcttagctgaagaatgttttagccgtcaaaaaagtgctggtgactataatcgtgctaaagatggttttaacaaattcctatcaactattactaaagaccaagatcgcactactggtaattacaatactttctgggatgcacgtaactatttaaaagatgtgggtaacattaagtgtgacattgtgatggttcatggtctcaatgactggaatgttaagttaaagaatgtatttaacttatataacaagctcagtgatgttgaagtaacgaagaaacttatcttacatcaaggtcaacatatctatatcaacaatttccaatcacttgatttcacagatatgatgaatctttggttaagtcataaattgtatggtgttgagaataatgctaaagaattactcccagatatcttagttcaaaataatactaaagaaagtacatgggaaacttattctagttggcaaagtaagaattttactaagttatacttaaattctgattctctctctgcacaaaaaaaagaaaaacaaattttagaatttagtgatcatttgccagaagctacatttaaacactatcaagcaaatattaatagttggaaagaagatattcttgcaccaactagtccaaaacttgaaaataatcgtttaatcatcactagcgaacctttaaatcatgaaactttacttaaaggtgtcgctaaaatcaaattaaagatcgctagtcaacttgatcatggcttggtcagtgttaagttggttgattatggcgatgctaagcgtctaggagctactcctacaattcttgaaagacgtggtttagacttaggttatcattggcaagaagataatttagtagaatttaaattagccaagaaaacaccatttaagatgattacacaagctcacttgaacttacaaaatcgtcataatgactttagtacagatgaacttgaagctaataagttctatgatgttgaaattactacacaacctatgttctatcatcttcctaagggacataagttaggcctagtaatctatgcaactgatatggaaatgaccttacaaggcaatgaagaaaattcatatcgcattgatactgccggctcatattgcttacttccaatagaatag

SEQ ID NO: 917 - DNA, 2913 bp, Unknownn
  isolated from dental, unidentified
ttggacaaaaatacatttgaacaaaatgatgaatatgctgccaaattaattgctaataccaaagatgaaacaatgtataatcgtatcttggatgaagttcaacattgtaaatcttttacatttgcggtggcttttattgagagtggtattcttaattctttaaagacagttttgaaagatctgaatgttcaaggaagaatattgacatctgcatatctatactttaataaacctcagatgtttagagaattattaaagctaccaaatgttgaaataagagtctatgaacagaatcatggtaaatttcatgcgaaaggctatctatttcaacatgaaggttatcagtctgcgctagtgggaagttctaattttactgctggtgctttaaaagtaaataaggaatggaatttactttttacttctcataataacggaaaactcacagaagacatagcttcagaaatagaggaacaatggaaaggagctagcaaattatctcctgagtggattgatgagtatgagaaaaaatacaagattcaaaataaacctgcgataaaagttgtttctcaatcggtagatgaagataacagtaattactctataattaaaccaaataagatgcaaaaagaggcattgaaaaatctacaaaaattaaggcttttgagagaaacaaagggtttaattatctctgcaacagggactggtaaaacatatttagctgctttagatgtgaaaaattataatcctaagcgttttttatttgtggctcacagagaacaaatattaaagaaatccttagatagtttccataaagtactaggtggagataaaaagacaaattatggaatattatctggaaatgctaaaaatacagatacaaaatatttatttgcaactgttcaaactttgagtaaagctgaaaatttgaaccagtttaaaagagatgaatttgattatattttaattgatgaagctcatcacgttggaagtaaaatatatgggaaattactagactattttactccagatttcttgttaggaatgacagccacacctgaacgaagtgatgataagaatatttatgaattatttgattataacgttccttatgaaattagattacaagaagcattggaagaggaaatgttagtacctttccactatataggtgtatctgattatacatataatggcgaagttattgatgataatactaatttgaaatatctggttagtgaagaacgagtaaaatatgtcgtggaacaaagcaagtattatggctatgatggtgatgtactacatggcttagttttcgttagtagaaaagaagaagcagatgaaattgctaagttattaaccaaaaatggatatccatcacaaatgttaagtggtgaagatagtcaagaacaacgtgaacaagccattgaaaaactaaaaaatggagaattaacatatctggttacagtagatatttttaatgaagggatagatattccttttataaatcaagtaattatgatgagaaaaacagaatctgtaatagtatttgttcaacaattgggtcgaggtttaagaaaagctcaaggaaaagaatatttaacggttatagatttcattggtaactacaagaataattatttgataccagtagcgttgacaggtgatcaatctaggacacgtgaaggtattagagaacacgttgaaactggacaaatagaaggtttatcgacaattaattttgaattagtcgcgaaaaaacgaattttgaaacagttgagaggaaagaaaaatctctttactttagaaataaaaaaagattatcaagaattaaagagacgtttgaataaaacaccattgatagccgattttataaagaataacatggttgcttcgcaagctattttgtctattttaaataaaaagggtaattacaatgattttcttcttaaggttgataaagacgctgcttactcatgggaaaatgattatttggataagacccttacttttattacatcagaatttttaagtgggaaaagagtacatgaattattgttattgcaaaaacttttagacaatggtgtgagttctagatcagagttggaaaaactagtagttgataatggaagttactgtaatgatgatgtattggatagtgtggaaagaattctaactctagagtactacaaacccaaaagttatgatgataagaacgataaagagaaaaataaaacagaatttgctaagttaggtgggcaagcattaattgaaatcagtaataataaggaatatcgtttcaataaagagatctctgaattattggaaagtgatcctggatttaaaaatctctttgtagatgttatcaaggctggactattaaatgcgcgtaaatatgataaggaaaatacctttacgatagaaaaaagatacactagatcagacgtcaatagattattgaattggcagagaaaaataccagctcaaagtatagggggatacttcattgaaaatgggtattgtccaatctttgtaacttatgtgaagagtaatgatatagatgattctattaagtatgaagatagatttatatctaatagcaaaattcattgttatacaaaaaatggaaggaaattaggacaaggtgagacattaaagatgtttgccggagttagcgaaggaactcccaaattaacatatttacttttcgtaaagagatcagatgctgaagatgatgatgaatttgtttacttaggaacaggtaaagtaacagctgattctctgaaacaagaatacagagaaatagataaaaaaggtaagttagtaaacacaccaattgtttcgtatgatcttaagttagatacgtcaatctcacttgcaagatatagaatgctaactgaaggaagtaatgaataa

SEQ ID NO: 918 - DNA, 1119 bp, Unknownn
  isolated from dental, unidentified
ttggcaaaagaaattttagaaaataaccctgcattcacaaaagctttacgtgatttaattcgtgaatataagccacaaaaacaagttaattataaggtacttacagataagttagttacaccatttaagttggatgcagatcaaatggatcaattaattggttctattgaagatagagggatttctgttgttgatgaaaatggtgaaccaagtgctcacagtttgaaggcagctacaaaagaagcagaaaaggcagaaaatgataaggatgtttctgcaccatctggcgttaagattaatgaccccgtacgtatgtacttaaaagaaattggacgagtaaacttgttgactgctgacgaagaagtagctttagctttgaagattgaagaaggagatcaagaagctaagcaacgtttggcagaagctaacttacgtttggtagtttctattgctaagcgttatgtaggtcgtggtatgtccttcttagatttaattcaagaaggtaacatggggcttatgaaagctgttgaaaagtttgattatcgtaaaggatttaaattttcaacatatgcaacatggtggatcagacaagcaatcactcgtgctattgccgatcaagcacgtacaatccgtattccagtacacatggttgaaacaatcaataagttaatcagaattcaacgccaaatgttgcaagatttgggtcgtgaaccaatgcctgaagaaattggtgctgaaatggatatgccaactgaaaaggtacgtgaaatcctaaaaattgctcaagaaccagtatctttggaaactcctattggcgaagaagatgattctcatttgggagatttcattgaagatcaagatgcaacaagtccagctgaacatgcagcttatgaattgttaaaagaacaacttgaaagtgtattagacacattaacagatagagaagagaatgttttacgtctacgctttggtttagatgatggacgcacaagaacacttgaagaagtaggtaaagtgtttggtgttactcgtgaacgtatccgtcaaattgaagctaaagcattaagaaaattacgtcatccatctcgttctaagcaattaaaggacttcttagaataa

SEQ ID NO: 919 - DNA, 549 bp, Rothia mucilaginosa
  isolated from dental, Rothia mucilaginosa
atggctaaagcgctcttaattattgactatacaaacgactttgtggctgataagggatcactaacggttggcaagccagcgcagacgttggccccagaaattatgcggttagccgatcaattcttaagccagcatgattatgtgatctttcccactgatggtcaccggcttaatgacccattcaatccagaaaccaaactatatccggcccataatattattgggacgaccggtcagaaactatacggccaagtcggcagctggtttgatcaacatcatgacgattcccatgtctacaaattcaataagaaccgttactcctccttccaaaacaccaatttggataactacctgcgggaacggcggattgatgaagtctggattgctggtgtctgcactgatatttgtgtcctccacaccgcaatcagtgcctacaacctggattaccacattgtgattccacaagcagccgtggccacgttctcaccagctggtgctgaatgggcgatgaatcattttaaaaatgtattaggggccacaattcgataa

SEQ ID NO: 920 - DNA, 1116 bp, Unknownn
  isolated from dental, unidentified
atgcttctatttgctgatagaactgtaatgaatatctctatggcatacataggaaaggaatttcaaattagtccagccgcattgggtgcgacagctagtgccttctttctaggatataccttaatgcaaattccaggaggtatagtcactgatatattaggtagtaaaaaaacggttataatatctttgatactatggtctttattaactgcttttacaggcttagctacatcattaatgacattagttgtgatcagatttttatttggtttagctgaaggtccttatccatcagcagctctaaagcaaatttctgaagagtatgataagagtgatcgttcacaagctacatcagttacaatttcatcaaactatgctggtgcagctattgctccattaattattgttccaattattgctagtcatggttggagagtatcattttatttcttgggaattctaggcttgatattagttggtctatattatttaattgagcgaccaattaaatctaagaaggaaataacaactgctaaaaaaattaattggcgtgaaatcgataagagaatatggatctttgtaataataggtttagtattgaatgttattacaaaaggtttagagacctggatgccaatatatttcttacaagctcaacatattaatttaaagaacttagcatggttggttccattgccagtaatagctggtggtattgcagcatttattagtggctttgtaatggttcatattttccgtaaacgtgaacgttggatgatctttatttcttcattgctaacactaatatttatgtttggaatgtataaatcaactacactagtatggattgtcatttttgaaattttagtatatttcacaaaatctctagcatttacaggaatttttagttttgtcgctcagatcttagatgaaaagacttatggatcttcaattggagttgtaaacttcggtggtcaattaggtggatttatagggcctttattgatcggatggttagttcaattgtcaggctcatatagcgttgcctttgtaggtttagtagtatgtgctctaatcgcagcaataacaagtacatttgtaaaaaatattaaataa

SEQ ID NO: 921 - DNA, 1164 bp, Unknownn
  isolated from dental, unidentified
atggatataggaattgataaaattaatttttttacttctaatttatacgtagatatgactaaactagcaattgccagaaatgaggatccagataaatatcttataggtataggtcaaagtaaaatggcagtaattccacctactcaagatatagttacgatgggtgcgaatgctgcagaatctatgctcacaaatgaagataaagaaagcattgatttggtaattgtgggaacagaatcaggaatagataattctaaatcagcagctgcttatattgctgatttgttaggtctaagagatgatattagaacttttgaaataaagcaagcatgttatggtgcaacagctgcgttacaaatggctaaagcacaaattgcgttaaatccggatagtaaagcgttaattataggtgcagatattgctaaatacggattgaatactcctggtgaagtaacacaaggtggtggagcagttgcaatgttagttagtgctaatcctaaattattgtcatttgaaggaggttcgacatatctatcacgtaatataatggacttttggagacctcttggacatagcgaggctttagttgacggaaaatattcatcaaacgtatatttagacttttttaataatgtttatagtaattataaagataagactggatttactattgataattttgaagctcttttatttcatttgccatatactaaaatgggattaaaagcattacgagaagcacaaaaagatgcagatgctaaagtgtcagctaaattagctcatagatttgaagattcacgcttgtacaatcgacaagtaggcaatttgtatacgggttccttatatttaagcctattatcattattagaaaacaatgatgatttaaaatctggtgacagattaggtctatttagttatggttctggagcacagggagaattctttgctatgcttttgagaaaggattatcgtaaatatttaatgaatacaacaaatgagtttctacaaaaaagaacacgtatttctgtcgaagagtacgaaaaaatttatttaaggagcttacattatgaaaataatagtgaattagatttagatatggatgatgctcaatttgttttaacaggcataaaggaaaatcaaagacaatataaaaatagaatttaa

SEQ ID NO: 922 - DNA, 1527 bp, Unknownn
  isolated from dental, unidentified
atgaatattattaaaaagattgataattggggaactacctctcccaataaaatcgcctatgactatctaggcactacaaatacttatgctgatttaaaaaattattctgataaattagctacatatttaaatcagttaaacttagatactaaaaatccaattatggtttttggtggacaagactttaatatgattgctacatttttaggaattgttaaagctggttatgcttatattcctgttgatacacattcaccagtagaaagactaaatgttatcaatgacatcgctaaaccagctgcatgtattgctgttgaagaacttcctgaaggttttaacggccttgaaagtttacctattgtagatcaagctaagttagaagatattttttcaaatggcgacgtagtaataaatgaagaaaaatatgttagtggagatgataatttctatattatcttcacatctggaacaactggtgtacctaagggtgtacaaattagtcatgataatttgttaagtttcttaggttggatggaaaaagactttggaattaaagaagatgtaaactgcatttctcaacctccatattcctttgatttatcagtaatggacttatatccaactcttactagaggtggaaaattatcagttcttcctaaagaaacaaccgataattttaaagaattatttgctactttaccaaagctgcatgctaatgaatgggtttcaacaccttctttcatggatctatgcttgttaaatccagcatttaatgaagaaaatttaccagaattaacacattttctattctgtggtgaagaattaacccatcaaacagcgcaaaacttgcatactcgttttcctaatggacatatctttaatacttacggtccaactgaaacgacagtcgctgttacacaagttgagataacagaacaagttttaaatgattatccacgtttaccaattggtataacaaaagatgatacaaagattgtattgctagatgataacttaaaagaagttgctgcaggagaagctggagaaattgttattttaggaccaagtgtatctaaaggatatatcaataatcctgaaaaaactcaagcagcgtttattgatttccaaggtcaaaaagcttatcgtactggagatttaggtcaatttgatgagaatggtcaattgttatacaagggtcgtatcgatttccaagttaaattacatggattccgtatcgaacttgaagatgttgatcatcatctcgatagagttagcttggtatctcaagcaacaactgttccaaaatacgataagaatcataaagttcaacaattgattgcctatgttgtagctaaggaaaatgattttgaagatgaatttaaattaactcaagcaatcaaaaaagaattaagtgaaactatgatgagctatatgatgcctcaaagatttatctatgtagattcattgccattaacaaataatggtaaaattgatcgtaaatctttaatgaaagaggtcaataaataa

SEQ ID NO: 923 - DNA, 8628 bp, Unknownn
  isolated from dental, unidentified
atgttaggaaggaaaaatataaaattaagaagagaaaaattttatgataagaagcaagtttatggcttgaaaaagttatcaatagggacagtctctgttcttttgggaatgacatttattgtttttgataatcacacagtttctgcgaatacaacagatgccgtccaagagtctgaaagtacaaatagtagtgctacatcaatccaaaagaaggcgttaacattaaaaacaagtgcgacttcaacatcagatgtaagtacagcagatacaacatctaccagttcaagtactaccaacaacgcaacaagtaatgaaacaaatacaacatcaaccgcaacaagtactactacttctactagtgaagaaagtacaagtaatcaaaataatcaagttgctaattctacaactgtagaactagaaaataatgcaactatgaatagtgcagaaaatcttgatgaaagtaaagctacatcaagcatgcaaaatggaacacgacaaactactataccaacacatactgcgacatcttcaacagatgttaacggctttattttgtcaatcaatcgtacaactgtcggtaatgatggtgatgctggaaaggatctaaatataacgttaacgggtaccttccaaccaggggacatctatactattaaggtcccagtaactaactttgggattaatgatagtgcctttacgcctgaaaaattgggtggtcaagctgaaattgttaagtctgatgaaatcattgatggagaaaaatacaaggtatataaagtaacatctagtggatcatatacagttacagacggacttaggatagtagttccagatggcaataattatgctggacagcctaatgtaaattcttcaaatcatttggatccaaatggtccaattaagagacaaatattttggagttatcaaaatagtgatgatccaagtaaggtaattaataattatccactggaatttacttcggttgttcagacttctatggccccaactattcgtcaagttaagccagaccctgaatatgtaaagaatttacgagtagatacaagatatgattttgaaattgatattaatcagcctacaggggtaggggaaaatggttatagttcaaataaagttaataatgctcaaaacttaggaacaacaattacagttccagtacctggcaattttctccttgatcctcaagcaagtatggatgctagcaagctaggatctaaaagtggcgtgactttcactcaagataaagctggtggtgatgtaattattacaattccggctggttcaggaagtcaatattaccagtacgatacaggttatcatttagtaggtaaatttatacaaacaatagagccatttggtaaaagagattacagtgcaaatggattaattactgttgatcaaaaaataagaaccactgatggagaaaagaatttaactgcacaagttaataatccgtggacagtaactttagttggtcctaaatttactcctcaagacggtcaatttgtagtagtaatagctggaaacaatacagctaagcaatttactcaaagtcagccaactagagtcgtaaattactttggatttcaaaattctactgctattagttacacaaatagtttgcacatccaggcagcattcccaaatggattgaatgtaactggggtaaagactcctggaatcaataatactatgcgtccaggaaccacatcatatgcatatactattgaaactaagagtggcaaaattttatcaggtgtagttaatgcaggagagacaattcttgcgccaacaggtgaatacattcttaaagtagatatagtacctaattatgtagaagtaggtgcctctacaaaatatggtaacgatgtaaataatattattaaagataatgttggaaacaaacaagcagatgatccagatatttttgaagcattagggacattatcagatgcaatgaataccatggcagtaattccgcctgatacagtattgacgactaagatagcggtgttttcaccagactttaataacaatacctaccatacgcttagtattgatcaaaaagttcagggattggatcagttgaaggcatcaattggtgcatggagatggcaaactaaaacaatgtataatacaaaaaatacagatcctaattattatggaaagtttgatactcactcatatggaacgggatatacaactgatagaatctatgagcctatcatttattatgttttgcctaagtatttttcctactctcgtggttgggatggtgtgcaatataaaacaacagatgatagtggaaaagtagtagttcctaaatattcaacctacgtagttgatggacgacaggttataaagtttgactacacaggtactggatatagtttgtatactcaaaatcaatctactaatcagatatttattatgatggatccagatgcagttgcaggcaaatatccttatgatgtatatatgtatactcgaacaggattaattaattacaatacaaaatatacaagttcgaatgttacagatttagtaaatcaatatactggaaatgtgatgacaagtagtattccgggaagtttatataaactaaatacggtttatgaaaattactttgtggttgataagcaaattatcacttatgtaccggtaacatcacaagggaatcaaaatcctaagtcagttctggtaggtacaagtgatgacaagggagataacactttaagttactaccttaatatcgccaactatgatagtaatgatcttagtgcagccagattgttaatagatttaccacaaaagagtgatggggcaagtagctatgatgttcatttgtcaggaccaattgtatacgacaagagttatggtaatttatcagatgatgcgtatactattttatactcaactaatacacaagatttgccaagttcttcagttaagggtacacaaacaagtttagaaggatatatacctgctgatcaagtaacagattggtcacaaattaaatcaattatggttgtatttaatgagccaattcctagccaagattatgtaggacgtttcattgttaaagggacagacccaactttcaaagaagatgctggaaagacaggatatattaaagcagctcttactggagataatctctcaccatttactgtcaataatagtggaattaagattcaaggaacatcgactgttacagcacgactacattatcaagatgagaatggggttgacaagtacattgatattccagcgatgacaaaaacttattcagataatgttgatacccttaaaagtagtgactttagtgcaagtagtgtcccagcagatatgattccaaaaggatacgaggtatcaggcttgccacaattaattatcacaaataaagatgatacaaataaggtagcaaaatttgatagtttagttaagtactattttgacggggatattgtgcaatttgaattatcagaaattgtaactacagaaactaagaaagtaacacaaaatgtttactatatctatgattctagttctgctaaatatcaagctggaggtactaaccttgataatgccattgttgttaatgggcagaaagtttctccaacaacagtaacatatactgttacacgtaaaactcatcaagcttctggaaagaaggaatatatcgtagtaaacgatgaaactggtgaaatattaacagttgacagtaatggtaactttgtacttccaggaattacaacaattcctagtttaccaggttatacagcaaatggacttgatataactaatgcgcaaagcaatactaattttaatattgataatcaattcctagctaatactggaagtgaaatagatctaaataagacgattgcgtacacaccaaatagtcaaaacttgtcatatagaatgtataatatgacgcaaaagaaatggattgctgataatccaattccatttatgactggaaagacagacgatacagttactggaggaattgatgcttttgataagaaagtccatgatttcttaattcctagtgcttatattcttaatagagttaattattatgatgcaacaactggtaactttgttgattttacagatgaacctggaactgaaggaaattatgttttgaaagtaccagcaaactttaatagtgataacagtaaaaatataattactttgtatgtaagcgacccaatatcatacagtgcagaaaataaagtagttacacgtacaatcacttatcatgataaagatgagaataacgcgttaattaatactgctaatgcgaatattaataaggatacttatccagatactactaccgatacaattacgtttacacgttataaagtaattgatcaagttacggaaaatgttctaggctattacaagcctagtcagatggaatcagtcaatggtaagttagtccctaaagctggggaatataccagcgatacagctaatgcaagttctgctttcgaaattttggttaatggtgcttatactacaagtgcgaaatttggagatgttacaccttatgatttaactaaatatggatatcagccagcagttgatatgaatggtaatactctaaccataattactggtagaacagtgcaagcaactacaagtgattttgaagaacatgtcttctataaacatcaatgggctaatattaaccctaatactaagccacaagaaggccagaaagtagatagtacagatcctaatagtccagtctatcctaagaattcgtatgattcagaagatagtattagtactgttaatcgaattattcattacgtatatgcaacagggactaaaattgatggagtagacgttagcagaaagccagtcaatggacttagtgatacaattcagatgataacttattatcaagatgcacaaattgatttagtaacaggtaacattaactatctgggaacttggaaagctgtgaaatcagaaattacgcagaatggagtcacaacaataattccaaattacaatcaatttacagaggtaacttctccaaaaattgataattataagccggtccaatctaccatagatgcgttgacaccaaatagacaggacaaaactttagatgtatatgtaatctatgtggcaaatacaacttcagtcgtggtaaattatctggatcaagacaatgcaaatggtgtaatttttgctaaaactttgaatggatctcatggtgataaaattgattacactactactgatgagattaagactttagaacaaaaaggctatgagttagttgatgatggttttaccgatcaaactggtgataaatactatgattcatctaaatcacaaatttggacagttttattgaaacataaaaaagtagtaattaaagctgatgatccacatagtagtgatgaaaagcttactactccagatggctatcaacataattatccaagtggtataagtgagcaagatttaaatactacggttagtcgtgaaattgactttaaatacaatcaaggtgtttaccgtaatggtacagatgtcagtggacagccagcagttgatgataatggaaacttgattgagaatgttgtgcagaaggttccttatgtaagaactgcaacaatagatttagtaaaattagctgataataatcaagctaatactgcagttacttatagtaattgggtagctaaagatggaggcagtggtgattttgcttcatttacggtgcctgagattaagggatatcacgcttcaatgccaatagtacctgaagtgactccaataaaggatattcaaggaaagccacaaaatgcaaagaacttgactgtattatatgatgctgaagatcgaactattgaaattgtctttgtagatggagatggaaatgttgttgaaccacaatatccaattactggtaaaacaggtgagactgttccagtaactgatggaaagggtaatccaatcaaacctccagagggttggaaatataagtatccagatgatcctgataaagtggttcctggaacaattactttaaccccagatggaacgccagagcttaaaattccaatagaacatacaacggttagagttgatccaaatgatccgcatgaagcaaatacaggacataatcctgataatccaattagaccatatccagctggtgttggtaaggatgatttgaaccatacagttactagaacaataattgttcatatgccagacggtacaactagagaaaagaaacaagaattgcttttccaacgttgggcaactgttgacgaattaaatgggaatgttacttatgatccatggttacctaagaatggaacaacttttgaagctgtacaagcagaagatattgttgcaacaccaagtggttatactcctggacaaggagctccaatggtagaaggaataactgaggaaagtgaagattcaacttttgatattgtatatactcctaatgatcaacatgcagtattaagaattgtggataatgatactattattaatggcaaaccaaaggaaatatttacaacatctgccactggtaaatatggtacgatcattaattttgctgatttagataatgaattaaatgacttgaagtctaagaattatcaagttgaaaataactttaataaagaaacgaaatatcaagcagacgatacaaataatgaatttattatttatttatcccacaagaaaattatagtcggaggtggcgtggccgtcagagaaaagatctcttacttctatattgatgacgaaggtaataaacatccaatcgcagatgattatataactgatgttggaagtagagtggcatttactcaaacaggtatgttggacttggtaacaggcaaatatacttggaatcatgactggaaaattgagaacaataagtttgatactgttgctagcccaaatatccaaggttatgtaattcgtcagggtatggaagaagttcctgcacaaacggttgcgatatctgaagatggaactattacaattaaagatgataagttgggtggaaaaattagtagagtttcaaacgatggttcgactgcaacttattttgtatcatacgagatgtattatgatgcagctgatcaaaagacaactgttacttatgtagatgatgatttagctggaaaaatagttggaactgtacaagaaattacaggtaagacttttgaaagtgtagaaactaatattactaatccagataaagataagtatgagatagtaaatgaggaccaaattccaaatgagattgtatttggaacgaagggttatccagctataactgttcatttgaagcataaacatgaaccagttactagagataatacggtaacaagaacaatagagtatcgagatgaaagtggtaagttattagatgcagtaaaacaaagtttggtatttactcgaacaggagataaggatttagtaacaaatcaagaaattttgaacacagatgttccaagtcaaagcttcgatgaagtgaagacaccagaaaaagtaggctacacaccagataaagctgttgttccaagtgagacagtaacatttgatactaaagattacacagaaactgtagtatataaggcaaatgaacaaaccggtcgagtagtatatgtggatgatgacaacggtggacaaaaagtcaagcaaggtagcatatctggcaagacaggagaaaccgtaaaggttaccccagaagtaccagaaaattatgaggaagtagcaggaaatccaacggattacactttcccagatgatggtacagacgaaagtaacgtagtaacaatacatttgaagcataaacatgaagcagttactagagacaacgtggtaactagaacaatagagtaccgagatgaaaaaggtaatttactaggtaccaagagtcaaagtttaacgttcactcaaccaggcgataaagatctagtaacagaccaagtaatttggaacacagacgttccaagtcaaagcttcgacgaagtgaagacaccagaaaaggcgggctacactccagataagataagcgtaccagctaaagaagtaacaattaatgatagcaatacgacagaagttgtaatatataaagctaatatcgtaaatgtggtaattaattatgaggataacatgggaaataaacttgtcgatactgaaaccatatctggtaaagaaggaaatgagtttactactcaagccttagaaattgctggttatcacttaatttctgagagtaaattggttcatggtatttttggtaaaactttagaagtcacctttgtatatgagaaaaatagtacagattctacaaagaatacaaaccaagttgataagaacgataacaatggtaaagaaagtaaagtagaaactgaaactaagaagtctaatgatttcaaaaatactattaactctaaagataaggtaagcactgaagtatcaagccaaaaactaccacaaactggtgatcaaaaagataatactgctagtttagtaggattaatcttaatgagtttagcaagtttattcggatttaaacgcaagaataagcgtgataactaa

SEQ ID NO: 924 - DNA, 1179 bp, Unknownn
  isolated from dental, unidentified
atgtcgaaagtaagaaataattttgcttgggaaatagtgttaattgcatgcaacttaagattagcaatcataattcttacacctttaatagataaaataggagaaacatttaagctatctacagttcaattagggatacttactacgataccattattatgttttggttttatatcgatattaatttctttattgattaaaaaaattggaactagaagaacaataataattggtttatttttattgatgttagctaacttttttagaatatatactgaaagtttgatttttgtaggtacgttatttgttggtgtatcaataactattttaaatgtgactttaccggctttggttgtagattatgctgaagaaaaatcggcatttttaaatggtttatacatagctactagcaatttaatttctgctttagcaggaggtgtgatagttccactgtcaaatctaataggctgggaaaacgcaattcaagtattttcattgcctgcattaattgctggagttggagcaattttgttacctaaaaaggaaattgaattggatagtaaggtagaaatttttgaaaaagaaaaggtatggcaaaggcatgctatctggttgttagcaatttttatgggattgcagtccttagttttttatacgttggttgcatggttgccaagtgttttggtaaatcatggaatctctcctgtaatagctggatggatgtttgcagcatttcaaatgataggcttcccattttcgtatgtagttcctaaattagcaagtagattaaagagtgcacgattgacgatgctattattattagtgggatatattttaggtgtgggaatgctgattgttgtcaaagataatttatggttgttattgctagcttgtttaataaatggaataacaacaggaacaagttttgcattatctttatatctaattactgttttttcaagtagtaaggaagaagttgggcaagttagtggttttgtccaatctgtaggttacttactggcaagttcaggtccagttatttttggagttcttaaagatacttttaataattggaatacgactttattgtgtttattattagtagcagcatttactgctataattggattagttatgataagaatgggaagacaacattttttacggttaaataagtaa

SEQ ID NO: 925 - DNA, 966 bp, Unknownn
  isolated from dental, unidentified
atgaaaaagacaataataagtggttttataatttccattattggcgctattttattagcaattggcttagggcttaaaggaaataaaagtattgtttttgaagatttaaaacctgttattgcagatagtactaaagttactcaagctcatacctataaagacattaataaacttgatatagatgttaaagatgttaatgtggaatttagagaagaaaagaactattctgtaaggtacgaaggtgcaaaatctagctccccaacggtaaaaaagtctggcaatcaactccaaattaaaggacgtttaagtagtcatagcataagatttaatggaatgagcatgtatgatgattattatcgaaattctgatcgaaataagatgataattactttaccaaaggatagtaaattagatgaactaaatctcaaattatctgattctttattatcacaggttaatatgacaggaattgaagctgatcaagttaaggcatctattcatgatactaaactagatttaagagatgctaattttggaaatgtagaattatctgcaggcgattcagatattagtatgactaatacagtattaagtaatggcaagttagacttaaatgacacagatgtacgtttagatggtggatcattgatgcaggttgcaatgaatattactgacggagatgtggattacaataatttgtctattcaaggtggtaacttacgtaataatgatggtgacattaagatgagtaatacacaaattcaaggtggatacaagatagatgatactgacggagacatactagtttctcgtgtaacagttgatggctatcgagttcaaagtaatgatggtgacgtaagattatttgaacaaacaacaagtaatggcaatgttttagagaagaattctaactcagataatgtattagatattataagtaatgatggcgatattactgtaaattaa

SEQ ID NO: 926 - DNA, 732 bp, Unknownn
  isolated from dental, unidentified
atggacaagtatagattcacaactgcggaaaaccaacggtttgcccgagcaaattttaccaagttagtgcatactaatgctcgctttgaaggcgttaataccacattgccacaaacacaaactattatggacggtatgagcgtagcaggagtacctgttgaagatgttttgacgattgttaatttaaagcgtgggtggcaatatatcactactcaaaattcccctttaacgttaaccatggaaaaacaaatcaataaaattgtggcagcagaagacgccttagtaccaggagaattacggcaaggaaaagggggagttaatttaggtagtgaagacttttttgagccgcctttaattaacgaaaaacaagaacaatcctttttacaaaaaatcttgactgatccacgaacgacgattactgataaagcattgactgtcatgtatcataatatgcgtcaacaaatcttttgggacgggaacaaaaggacggcaactttaagtgccaataaaattatgattgacggtggcgctggtttaattaatgtcccattagataagtgggatcaatggaacgaactaattgccaattattatcggactaatgacatgactgaagttaaacagtggacatatgataatggtatccaaggattacaaattcgagcaaacaaagaattaagtgctaatgaattgaaccagatgtacaagcaactaaaaaaacggatgaattag

SEQ ID NO: 927 - DNA, 909 bp, Unknownn
  isolated from dental, unidentified
atgaaaacgaagggcatattattagctgctggtggagcatcattatggggaggttcaggagcagcagcccagcaattattcatgacacatgcagtgacaacagagtggttagtagctgttagattattaggtgcaggactactattattaatttggggattaattaagtcttcaaaacaaatcaacgaaattattcatgatcgaaaaaatatggcaatggttttggcattcgcaattttcggagttatgaattcgcaattatcttatttttttgctattaaatatagcaatgcaccgacagcgacagtcttacaatatttacagccagtattgatcgttttatggatggcttttggtcagaaaattagaccaagaagagtagatggaatttcaattgctgtagcattaatgggaacatttttgctagtaactggtggtcgtttagatacactaactctaaccccaattgcgttagcttggggattatggagtgcagttgctgctacattatatacattacttccaagtggattgttgaaaaaatacgatgcgatggtagtatgtgggctagcgatgtttgttagtggaattattatgttgccatggttcttaacaatggaacaaccacatttatcattattcaatatagtgttagtgatctatattgtggtatttggaacgatgtttgcctataccttatttttacaaagtattcgttatatagcaccatccgttaccggaattttaagtgcttttgaaccactgattgcgacaattttagctgttactttattaggaactaaattatcaacagccgcaattattggatcattattgattattttaacaacagttattcaagccgtaccatttaatgtaatatggcgaagatttaaaagagccaaataa

SEQ ID NO: 928 - DNA, 795 bp, Unknownn
  isolated from dental, unidentified
ttggaagaatatggaattattatttgtgacgatgagaaggatcaagttagaaggatacatgatctagttaaatatgctatttggtctttagaagattctgctgacagtaaaggtaaaaaatttaaaataactttggaagctaatagttatattgaagtagccgattatttggaagataacaaagtagatagtggagtttattttttagatattgaacttagtaaagataaagcagatagagatgggatagatttagctgaatttattagacaaaaagatccaaatgcacagataatttttattacagcttatgaaaatctagcagcaatgacttatcgacgtcgtactggagcattggattttattactaaaaatgataatgatgaagtgattcaaaaacgactaaatgagactttatcattagctgcaaggagaattagggaatctcatgccataaagaaaatgacatttagctataaaatgggcagaagaattattaacgaaaatatcaatgatattctatatattattaccactcctaagtcacatagattgaaaatagttacagttaatggtatgggtgagtttacaggcgatattaagaagttagaggtagaaaatgattttctagaaaaaatatcacaatcttgtttagctaatccaagtaatattgttgaaattaacctgtcaacaaggagtatttcttttaaagatggatataaggagacttttcctaggagaagtaaggctaaaatgaaaagtttgattgaaaggtataatttgaaaacagtttaa

SEQ ID NO: 929 - DNA, 1197 bp, Unknownn
  isolated from dental, unidentified
atgaagcaaaaatttgaaccttttacagaaagagtttatttatcttcgccaacaatgcatggtgaagaattaaagtatatgacagaagcctatcaaacgaattggatgtctacgataggggcaaacatcgattcaattgaagctgatgtagctaaaaaactaggtgtgggatacaccgtagcattatcatcaggaacagcggctttgcatttggcgatgaaactagccaagatcaaaccaggagaaaaggtgttttgtacagatatgacctttagcgctacagctaatccaatagtttatgaaggtggaatacctatctttatcgatagtgagcctaatacatggaatatgagtccagaagcattagaaaaagcttttgaactatatccagatgtaagagtggttatgttggctcatttgtacggagtaccggcaaaattaacagaaattgaggaaatctgtaggcaacacaaagcgattttaatagaagatgcagccgagtctttaggggcaacttatcaagggcaacagactggatcatttggagaaattggagttatttcttttaatggtaataagattatcactggatcttcaggcggcatgttactgacagataagaaagaattagctgatgaagcaaggaatttatcgacgcaagctagagaagatgcaccttggtatcagcataaagagataggatataactatcgtatgagtaatgtaatcgcaggagtagttcgaggacaatttccgtatttagaagaacatattgcccaaaaaaagaaaatctatcaacgttatcaagccggattgagtggattgccggttaagatgaatccttttgatagtgataagagtgaacctaatttttggttgtcatgtttagtgattgataaagaggcgatgtgcaagcaaactaggacagatactgaagctagttatatttctgagcaaggtaaatcttgtccgacagagattttagaagcactggctgccattaacgcagaggggcgtccaatttggaaaccaatgcatcttcaacctatttataagaaaaacgtatttgttaaagttgatgaaaatggtgtagatgaagacatttttaatcgcgggttgtgtttacctagtgataataagatgactccagaacaacaagatagaattattaatgtaattaaatcatgttttgagtga

SEQ ID NO: 930 - DNA, 1914 bp, Unknownn
  isolated from dental, unidentified
atggaattcggaaaaagatataaagctaaagactatgatgtaattgttgttggggcaggacatgctggatgtgaagcagccttagcttcagctagaatgggtaatgaaactttattaattacgattaaccttgaaatggttgcatttatgccatgtaatccatctattggtggaccagctaaaggtattgtagttagagaaattgatgccatgggtggcgaaatgggacgtaatattgataagacttacgttcaaatgagaatgttgaatacaggtaagggacctgctgtacgtgctttaagagcccaagctgacaagcgtcaatattctattgaaatgaaacatacaattgaacaaacaccacatttaactttacgtcaaggaattgttgatgacttgattattgaagatggtgaagttaaaggtgtagtaactaatactggtgcttgctatggtgcgaaatcagtagttttaacaactggtacagctgctcgtggaaagattatcattggtgaattaatgtattcttctggtccaaacaatactcaaccagctttagaactatctaagaacttagctaaattaggatttgaattgaagagatttaagacaggtactccacctcgtgtcgatggaaatactattgattacgacaagactgaagaacaaccaggtgatgtggaacctaaccactttagttatgaatctaaggatgaagattacttaaaagttaaggaccaattatcatgttggttaacatatactaacgaatatacccataaaattattcaagataatttagacagagcaccaatgtttactggtgttattgaaggggttggacctcgttactgcccatcaatcgaagacaagattgtacgtttttctgacaaacctcgtcatcaattgttcttggaacctgaaggacgtaataccgatgaatactatgttcaaggtttgtcgacatctttaccagaagaagttcaacaagaaatggtacgctctattgatggcttagaacatgctgaaatgatgcgtccaggttatgcaattgaatatgacgttgtttcaccatatcaattaagaccaacattggaaactaagttgatcaagggactatacacagctggacaaactaatggtacttctggttatgaggaagctgcaggtcaaggatttattgctggtgtaaatgctggtcgtcgtgctaaaggtttagaagaaatcactttgaaacgtagcgatgcttacatcggtgttatgattgatgatttggtaacaaagggaacaaacgaaccttatcgtctcctaacttcacgcgcagaatatcgtttaattttacgtcatgataatgcagatttacgtttaacagaattaggtcatgaaattggtttgatttcggatgaacgttatgctgcttttgaagaaaagaaagcacaaattgaagctgaaaagcaaagactatcaaagattagaattaagccaaatgctgaagttaatgcctttgtggaagctcatggtgatcgtgaattaaaagatggtgtgctagcaactgaattcttaagaagaccttatgtaacttaccaagatctattgaaattcattccagcacctgctgaaccattagatagacgtgtaattgaacaaattgaaatacaattcaagtacgaaggatatatcaagaaagaatatgctaaagttgaaaaactaaagcgtatggaagctaagaagattccagcaagaattgattactctcgtattgaaggaattgctactgaagctcaacaaaaattagctaagattcaacctgaaacattagcacaagctggacgtatctcaggtgtaaatccagcggacttgtccattttagctgtttatattgaacaaggaaaaattgctagagttgacgattag

SEQ ID NO: 931 - DNA, 2424 bp, Unknownn
  isolated from dental, unidentified
atggattttaataaagaggtttttaaagaaaaattcaaaaatcgtttggatgaaaaatatgctttagatgtaaaggatgcaacacctcaagaactttatttaacattaagttcaattgtacgatcaagttatagtcgttattggcgtaaaacttggaagaagtacatggaagatggtaaaaagcaaatttattatttctctattgaatttttaccaggtcgtttattaatgagtaacttactcaatatgggttggttagaaacagtcagagatgcattgaaagatttagacatcgatttagatgaaattgcggaagtagaaaaagatatggctcttggtaatgggggattaggtcgtttagcttctgcttttatggattctttagcttctgacggtcttccaggaaatggtaatggtatccgttatcgttatggattattcaagcaaaaatttattgatggttatcaaattgaattacctaatgaatggcttgatagtggtaatccttgggaaattcgtcgtgaaagtaaatctgtgacagttagattgggtggaaaggtatatcttgttgacagaggaagttaccttgaaccagtttatgaaggtgcacaattaattaaagctgtaccgtatgatactgccattgtgggctataaaaatggcactgttaatacaatgagattatgggatgctgaaattccatcttcagaagaaactaaatacagaactattgaacaaagacgtgaagttgaagatttagtatctgttctatatccagatgactctaaggaatctggacgaattcttcgattgaaacaagaatatttttttgtatcagctggtatccaaagtattgttcgtcactttaagaagtacaataaatcaatgaataagattggtgaatatattggaattcatattaatgatactcatccagttatgagtgtagctgaattaatgcgtattttagtggacgaagaacatatgagttgggatgatgcttggaaacaaactgttgctgtaatgagttatacaaaccatacaatcatggcagaagcccttgaaaaatggcctgttcatatcatgcaacaagttcaacctcgtattctacaaatcattcaagaaattgatcgtcgttttgttgaagaaaaacaaggtaaatatgcacgtgatatgatcgaacgtacacgtattattaaagataatcaagtgagaatggctaacttatctatcattggttctcatagtactaatggtgtagctaagttgcatacagaattacttaaagatgatgtgttgcatgatttctatgtaatgtatcctgaaagatttaacaataagacaaacggaattacagaccgtcgttggttacaaattgctaacctagaattatctaaagttttagacaaagcaattggtacagaatggcgtcaagatccaactaagctacaaaaattattgaagcatcaaaatgataataaagttttgaaccaaattgctaatgctaagttgaagaacaaagaaagattagctaagtttatcgaaaaagaaacaggaattaaagtttctacagatgctatctttgatgttcaaattaaacgactacatgcatacaaacgtcaattattgaaattaatgcacattgttaagttgtatctagacattaagcaaggtaaggtagcctctgatttccaaccaagagtatttatttttggtgctaaggcagcacctagttattactatgcaaaagccatcattaagtgcattaatgaagttgcaaacatggtaaataatgaccctgaaattggcgataagttaaaagtggtattcttggaagattatcgtgtatctttagcagaaaagattattccagctgctaatattagtgaacaaatttctcttgcatctaaagaagcttctggaacaagtaacatgaagttaatgcttaatggtgctttgactgtagctacacttgatggtgctaatattgaaattaaagattatgttggagaagataatatctttatctttggtttaactaaggatgaagtatacgactactacaataatggtaattaccattcatatgattactacaacaatcatgaagaaatccgtcgtgtattgaatgcttttgtagatggaacaattccaaattgccaagctgaaggtcaagaaatttttgattcacttacaaaatacaatgatgaatattttgtattaagagatttcgaaagttatgtaaatatccaagaaatggttgatagaacttacggtaataagcgtcattggaaccaaatgagtttggttaatattgcttacggtggtatgttttcttctgatgatactattaagcgttatgctgaagatatttggaacattagtccattaaaggatgaaaaacatggcacatattctttataa

SEQ ID NO: 932 - DNA, 1146 bp, Unknownn
  isolated from dental, unidentified
gtggctaatgacaaaaataaagttcaaggcgatcaacctgaagaaagattaaaggctttagatgcagctttaaaaaagattgagaaaaagttcggtaaaggttccattatgaaaatgggagggaaagtagatacaaagatttctaccatttctagtggttcaattgctattgatgcaggattaggtgtaggtggttatccacgaggacgtattattgaaatttatggtccagaaagttctggtaagacgacagttgcattacatgcagttgctgaagttcaaaaacgtggtggtacagcagcatatatcgatgctgaaaatgctttggatcctgcatatgctactgcactgggagtgaacattgatgaattactactttcacaaccagacactggtgaacaaggtttagaaattgctgatgctttggtttcatctggtgcaattgatataattgttgttgactcagtagccgctttagtacctaaagctgaaattgagggtgaaatgggtgattctcatgttgggttgcaagctcgtttgatgtcacaggctttaagaaaactttcaggtacaatcaataagacgaagactgtagctatatttattaaccaaattcgtgaaaaagtaggggttatgtttggaaatcctgaaacaactcctggtggtcgtgctttgaagttctattcaactgttagaatggaagtgcgtcgttccgaagcaattaaggcaaaatctgaaattattggtaacagaactaagattaaatttgtgaaaaataaagttgctccaccattcaaagtagctgaagttgatatcatgtatggtgaaggtatttctaaaacaggtgaattactggatatggctgttgagaaggatatcattcacaagagtggttcttggttctcttatggagatacaagaataggtcaaggacgtgaaaatgctaaggaatatcttagtgaacatgaagacgagatgaatgaaattaatatcaaagtcagagaagcatacggtataccggatgaaaatggaaatgtacctgaatctcaagataagaatactactcaatctgctatggatgacaaggctgcagatatagatgattctgaagaagtatctttagatgtaaatgatagtgacgaataa

SEQ ID NO: 933 - DNA, 1011 bp, Unknownn
  isolated from dental, unidentified
ttgttaatcacaaaaatttataaaccaagtgagtttaatgaagctgcaaaagaattacgtctaggagaacttgtagcttttccaacagaaacagtatatggattaggagcagatgctactaatgaacaagcagtaaagagggtttatttggctaaaggaagaccatcagataatcctttgattgtgactgtatcatcactagagatggtaaaaagatttgttccatcgttaagtaaagaggtagaaaagataatagaaaaattctggccgggttcattgacaattgtactaaaaataaaagatggtagtttatctaagacagtaacaggtggtttgaaaactgctgcgtttagaatgcctaaaaatgaaactacattaaacttgataacagcattaggtaatcctattgtaggcccttcagcaaattcttcgggaaagccaagtcccacgactgctcagcacgtttatcatgatttagagggaagaattgcaggtattttagatgatggacctactgatgtcggtgtagagtcaacaattattgatatgagtacagaaataccaacaattttaagaccaggagcagtaacagcagaagaaattgaaaaagtcataggtaaagaagtatatagtgataaacataaagttaaagaaaatgaaatacctaaagctccgggaatgaaatataagcactatgctccatcagcacaagtgttaatagttaataaagataattggaatagtgcactacagtgggcaaatgaaaataaaaatcaagtaggaatattagctgatgatgaagtattgagtaaagccttagaaaataaaacttattcattgggagaaaatgtagaaagtgcagctaagaatctttttgcagggcttagatattttgatgatgacaatcagattaagtatattttagccgaagcgtttcctgaagaaggtgtcggtttagcatatatgaatcgtttaaaaaaatcagccggtaatcaattttataataaatag

SEQ ID NO: 934 - DNA, 2025 bp, Unknownn; identical to SEQ ID NO: 4
  isolated from dental, unidentified

SEQ ID NO: 935 - DNA, 1221 bp, Unknownn
  isolated from dental, unidentified
gtgcaggtgaaagttaatgaataccctaaaacttggaaaagaacatttatatcactatggttaggctgttttattactggactaggattttccatgaccatgccatttatgccactgttcatggaaactttaggtaatttttcgacttggcaactaaatttatattctggtttagctttttcgatgacatatttatcgcaagcaattgtatcaccatattggggaagtttggcagatcgtaagggtcgtaaattaatgtgtatgcgtgcttcaggtgttatggcttttacgattttcttaacaggattagcccaaggtgtttgggtgattattttccttcgtttcttacaaggagcattttctggttatataaataatgcgactgcatttattgctggggaaactccacgtgctaaaacgggatccgcaatggcaaatatgatgactgccagtgtttctggaaatctactaggacctatttttggtggcgcaattgctggatcatttggctatcgagtaccattttttattacaggttttatgatgttagttgcgtttttcttaacctgggtaaacaccaaagaacactttaagccagtagctaagcgtgaaatgaaacctatgaaagaaatcttttctcaaatttcaaatactaaattgataatttcaatgtttataacgactttgattattaatgcttctttgatgtcaatttcaccaattattagtttgttagttaaaagattgatgcatggacagggtaatatttctctagttagtgggattgttgcggcagctccaggctttggaacattattagtcgcaaataaattaggacataagatggatgaaatagggccagaaaaagtattgataacgggattagttgtagaagtactactatttatcccaatgtctttggtaacatcgccatggctactagctgtattacgtttctttataggaatcgcagatgcagctttattaccagctgtacagacgatcttatcagtagacgtaccaccagcagcatttggtagaatcttcagttataatcaatctttccaagctagtggtggggtaattggaccattattaggatcatttgtatctagtttgtttggttaccaagcagtctttttattcacagctttgatgttaggatttaatttcattctagtaatttggtcacaaaataaacgaattttagtaaagaaatag

SEQ ID NO: 936 - DNA, 540 bp, Unknownn
  isolated from dental, unidentified
atgagaggcaggaagaaatatatggctgtgatctatactagaaaagctacgattgatgatttagataaaattatgtcaattgttgaagatgcaagagcattgtttaaaaatgataaaattcctcaatggcaaggaggttatcctgatgaagaacgatttaaagaagatataaataatgaagaagcctacgtactggtagtaggtgatgaagtagcaggtataggagtattaactactgagcgacaagaaaattatgatgccatagaagaaggtagttggaaacgtgatgatgattatgcggctattcatcgtgccgcaatttcaagtaaattcagaggaatgcatctaagcaattacttatttagtggattaattacaatcggcgttcaaaaaggatataaagattttagaatagatactcatccgggaaatgaacgaatgaaaggattatcagaaaagtttggttttgaaaaacgtggcataatttatgttgatgaaaaaattgaaccaatcagatatgcttatgaactaaatttataa

SEQ ID NO: 937 - DNA, 963 bp, Unknownn
  isolated from dental, unidentified
atgcaagaaaagcaggagataatgttatttgccttaaattctaatccagaattggcacaaaaaattgctgataacttaggtgttaaattatgtgatgcttccgtaaaacactttagtgacggtgaaattcaaatcaacatcaacgaaagtgttcgtggtagagatgtatttgtaattcaatctatatctgatccagttaacgaaaactttatggaagttatgattatgattgatgctttacgtcgtgcaagtgcaggtacaatcaatgtggttataccttactatggttatgcacgttctgatcgtaaggcacgttctcgtgaaccaattacagctaagttactagctaacttcattcaaatggcaggtgctgacagagttgtagcaatggacttgcatgctggtcagttacaaggattcttcaatattccagttgaccacttacttgcaatttttgtacaagctcaatacttcggcgatttgggattgaagaaagatgtagtagttgttgctccagaccataatggtgttaagggtgcacgtaaccttgctcaattattaaaggctccaattgccatcgtagataagcgtggaactgaaagaattgcagaaccaacagaagcacatgtaattggtgatgttaagggtcataactgcattgtttatgatgatatgattgatacaggtggtaagatggtagacgctgctaaagctttaaaagcagctggtgcagcagatatctatgcttgtgctactcatcctatcttctctggaaatgctgtagaagaattgaaggtttctccatataaggaagttgtagtaacagatacaattgaggtgccagaagaaaagcaattttcacaattgaaagttttatcagtagcacctacaattgctaaggctatttcattgattaatagtaataaatcagtggattcattatttcaaaagcatgaaatttaa

SEQ ID NO: 938 - DNA, 1041 bp, Unknownn
  isolated from dental, unidentified
atggcattcttagactcagtaaaaaacttgatgaagtttaataaaaataatgaaacaaaacaaaaaaatgatgtatccacagttaaaaaaagtgatctctcagataaaaataaggaatctatcactaaagttggacataacgctactttaatcatcatatatcaagacgatcgtggtcaaagtctgactactccacaaattatttccggatatattggcgaagaacttcatttaagattcaaagaatttcccaactatgacttaattaatatttcaggatttactagtgcctttgttgatccatatggttctataactcttacctatcgtaaacatcaaggggctgatgtttggctattttcacaagatattgataagcaaaagttactgatgcgtcctgtctttatccgaggagattttggggaacgctttgaattaaatgcccctaccatccctgactattcactacaaaaagctgttgggcctactcgtggtgtcttctcagataaacaacaattagtcacatactattatcgtaaatcacgttggaaaattgttgatcataatgtacattatcttcgtatcaattcttattgtttaagttatacagaacctgaaggacacgatatttctgtcacacttgctccagatactatttggcaaacattcgagtctattcaacttatcaataatgattggtggtataacatcggcggaaatgcctgggttaaatttgatgaacaacgtatggaattactagaaaacaatccatatactttatcagatacattaaagatcgctcctatccaggatgatcctgaactaagtattcctgaaccagttaaattatctgttactgctgaaattaactttgtacctaaccaaaagcttgctctttatgatcgaccatttggtaaaaaaattaatgagatagaaaatggaaaaactgtgctcataactgctcgtaaccgtgtcggtcgtatgctttggtttgaagtcgatggtctaggttggacaatttgggaatatctacaattttaa

SEQ ID NO: 939 - DNA, 759 bp, Unknownn
  isolated from dental, unidentified
atgaggatagtcaaagtaagaaatgttgaattcggtacggaccgtcctaaaatagctgttccaattaccggaaaatcaagtgatgatattataaagcaagccgaaacaattatgtctagtgataacgctgatttaattgaatggagaatagatttctttgatcaagttgaagatgctgaaaagttggttgaaacagccaaaaagctacgccaagttatgggtgaaatgcctttattaactacatttagaactcatttcgaaggtggagttaaagaattatcagaagaagaatatttcgatatttgtcgcgtattgattaaagaaaaggcaacagatttgttagacttagaattgttcagaaaaacaagtaagctaaaggaaattatcgccgaagctcatgaaaataatatctatattatcatgagtaatcatgatttcgataagactcctgcaacttctgaattagaaagacgactaactttgatgaagacttacggtgctgatattgctaagatcgcagtaatgcctaatagtgcacgtgatgtcctaaatctattactagctacagataatatgaagtacaaattaaattgtccattaattacaatggcgatgggagacttaggtaaagtaaccagaataagtggtgaagtctttggttcttgcttaacatttggtacagtaggcgatgcttctgcaccaggacaaattgaaagtactaacttaaaaggaatcttaaatacattaaagtttgactaa

SEQ ID NO: 940 - DNA, 891 bp, Oribacterium sinus
  isolated from dental, Oribacterium sinus
atggagaataaaatgttagataataaaattgaaacgtttatgatggtagcccatctaaagtcatataccaaagcggcagaaagtttgtttataagtcaaccagcagtgtctcaacaaattagacaattggaagaagaatttggagtaaagctatttaactatgaaaagaggaaattatttttaacaactgagggaaaagaattattgaaatttgcagaatcagtgaaagtacaaacaaaaaatataaaaataaaaatgaaattatctgataagcaaagtagcccattgaattttgcaacaacattttcacttagtaataatgatgcatggaaaattgttgattactatagaagtcagagaagtaagaaaattgtgtgtcaaacttttaatacccaacaatgtttagaagctcttaataatggaaaaatagattttgcattgattgagggtaattttaagcaagatgactatgataaagtaatcattagaaatgaaccatttattgcagtaggaaaaagggaattaggtatagaagcaaaaaaagaatatgatttacgcgaactaataaattatccattaatttatcgagaacaagggtcaggttcgttagaaataacaagacaaatattgggtatgaggaatttaagtccaatagattttaaacaagaataccaaatagggagtttaagtttatttagaagaatgctattagatggagtagggataggattctgttatcaatgtttattaacagatgagttggatgatggaattattcagaagataaaaataaaaaatatggaagtggctcatcctatctcattagtgtggttaaaaggaaatgaccagttaaaagaagaaatacaagtagtgaaggaaatcttaaagtaa

SEQ ID NO: 941 - DNA, 909 bp, Unknownn
  isolated from dental, unidentified
atgagaaaaatggcagtaattggtttaggacatgtaggagcaacagttgcttatactttagtttctcaaggaattgctgatgagcttgtattaattgatacaaatgagaaaaaagtagttgctgaaaaactagattttgaggatgcaatgcctcgtctaccttaccatgtagaaataaagacacgagattatgctgaattaaaggatgttgatgtaattatcacagcctttggtgacattgatgcaagtgttagaactggaaatcgttttgcagagttcgaaattaacactaagaatgcagtagaagtaggtaagaagattaaggaatctggttttagtggtgttattattgatatttctaatccttgtgacgcagttacttctatccttcaagaaacaacaggattaccacgtaaccaagtgttaggtacaggtacattcttagatacagcaagaatgcaacatgtagttggcgatgctttaggacaagatggacgcaatgtagaaggttttgtcttaggtgaacacggtaattctcaatttgtagcatggtcaacagttagagttaataacaagccaatcactgaattctttacagaagaagaattagaagaattaggtaagaaaccagcagaaggtggctttaaggtagctaacggaaaaggatacacatcttacgcaattgcaacatgtggcgttaagttagcacaagcagtattatcaaatgctcatttctttggacctgtatcaacatatgttgaagaagttggaacatacgttggatatccagcaatagttggtgctaagggtgtagaaaaggtagtatctttagtgcttactgatgaagaaaaagcaaaattagaacaatctgctaactatattaaagaacatttagatagcttaaaataa

SEQ ID NO: 942 - DNA, 753 bp, Unknownn
  isolated from dental, unidentified
atgatgaccaattttttatatcaacttgaaattgattttaaacgcataatcttaagaaatccggcattcttcatgtttgatttagcaatgcctttgactttttatttactttttacaaaagccttaccacattatagtaatacaatgcaatggaaggtagattatttagtaagtatggcgatttacggaattctacttggatctattatgactgttgcacatacactaagttccgatatagaccgcaaatttacactatttatagatttaagccctttccctaaatttatgtattatattgaaatgatcattatttttgaagtattaaacttactttgtcttgtaggaattggtttagccggtattttagttaataatctcacattaccgacaaaggtctggatacttttattaattctaattcctattatgagtttgcctctcgttttattaggaattttgatttcatcatttaaagatagtaatgttatcaatgccttagccaacatcttagtttttcctatggcaatttgtagtggcttatggtggccgcttagtgtacttccacaatggctacaaaaaattggtaaagtaacaccaacatactacatttcaaatttgtctaataacattttacatggaaatagcatcaactataattcgcttgtaggtttaataatttggtttgttgtgttagtcttagctctaggaattagttatatatttacttcaaaaaaggattggaaaaactaa

SEQ ID NO: 943 - DNA, 1863 bp, Unknownn
  isolated from dental, unidentified
atgtttataaataaaacttatttctttttagatatggggggatttattatgtctcgtctaagtcataaacaaaaattatatattattgttggtatcgctgcagtcgcagttgttttacagtacttattacatttaaaattatatgcacaaattctcgttactttagtcggagctatcattgctttatctatgtttaaggaaatggttcacacactccgttctggaaaatatggcgtcgacctattagccatcttagctgttgtcgccactttatccgtaggtgaatattgggcaagtatggttattcttatcatgctcactggtggtgatacattagaagattatgcctctcataaagcaaatacagaattaaaagcattactagataattcacctcaaattgcacataaaattatggatgatggtgacatagatgatgttagtgtcaatgatgttaaagttggagataaaattgtagttaaacctgggaaaatcgttcctgtagacagttttatcattaaaggtagcggcttatttgatgaatcttctttaactggtgaatcaaaacctgttgaaaaaaatctccgtgacaacgtaatgtctggttctttgaatggggacaattccgttactttacaagtaagtaaacttgctaaagatagtcaatatcaacagttagttaagctagttaaggaagctgaaagtactcctgctcattttgttagaatggcagatagatacgctgttccatttactttggcagccattttaatttcacttgcagcttggttcttctcaggcgaccctcatcgccttgctgaagtattagttgtagcctcaccttgtcctttaatccttgcagcacctgttgctatggtttcaggtatgagccgtgcctcacgcaacggtattgtggtaaaaactggtgatgttttagaaaaacttgccactgctaaaactggtgcttttgataaaaccggtacaatcactagtgggcaattaactgtacaagatgttgttacaacctcttctatgaaagtagaagaattattacaactagctgctagtgctgaacaagaatcatcacatattttagctcgttcacttgttgcatatactgataatcaaaatattgatttagcacctgttagttctttagaggaaaaaacaggtaaaggaattgaagctactattaatcataaaaatgttaaagttggtaaacttaaatttgttgctccaaattcagaaatgaaacctttagcaactactactatttatgtcagtgttgatgatgaactttgtggttatgttacttttaccgatcatgttcgtcctgaagcaaaagaaactatgaatactttgaaagctttaggagtcaaaaagttaatgatgctaactggggatcaagaaaagattgctcaacgagtagctaaagaagtaggaattgatgaagtaaaagctgacttactacctcaagataagatcaccgctttacaaaatatccctaaatctggccaccctacttttatggttggtgacggtgtaaatgatgctccttcacttgcaactgttgatgttggtattgctatgggtgcacatggttctactgctgctagtgaatcagctgatgttgttattttaaaggatgatctatctcgtgtttctaaagctgttactatttcacgtgacaacattaaagttgctcgtcaatcagttttattagggattgcaatttgtactgcattaatgttaatcgcaagtactggtatcatccctgctttcatcggtgcgatgttccaagaagttgttgatactgtttcaattttatgggctttgaaggcacgttattctcacgaacaatag

SEQ ID NO: 944 - DNA, 1083 bp, Selenomonas sputigena
  isolated from dental, Selenomonas sputigena
atgccacaagataacagaagacgtcgacgttccattgaaaattatcaaaacgacatgtcttcacacgtaccacaacgacaacatgaacatcatcattctccacatagacttagtaaaactatctttttttggttactactatctttagtggtttttgctatcgttggtggaaaatatctggagaagaaactgaataatgcacaaaaagctgccaataccatctatagttctagtaattttagcaaatcgcgtaatgttagctctaccttaaaaaagggtaaacctgtttctattttactaatgggaactgatactggagctttaggtagggatttccgtggacgtactgatacattgattgtcttagttatgaatcctaaagataaaaagatgactcttgtttcacttccgcgagatgaaaaagttgcaatctcaggatatgaagaatactatcctagcaagttaaactccgcttatttttacgggggatctaaagccgctgttagaactgttcaacaagatttaaatattccaatcgatttttacgttacagttaacatgggcggcttagaaagtatcattaatgctattggaggagttgatgtagctcctacaatctcattctcatatggtggttactctttcaagaaaggtaaagtaacacatatgaatggacctaaagctttagcttacgttcgcatgagacatgaggatcctttaggggattatggtcgtcaaactagacaacgacaagtccttatgaaagttgccctgaagagtagtcacgtttctaatttactcaatcaaaaattcttgaacactatttctaaacaaatgcaaactgatttatcttttgatgatttattagctcttggaactaaatatcgtgttgcaactcatggtatggattcagatcatttacaaggtacttcaacgatgataatgggtgaatcttttgaagtccctactttatctgaaaaacaaagaattacaaacaaagttcgctctgctttagatttagaaaaggctaaaactggttctacatatggaactgattatgaaataaacacttcacaatattaa

SEQ ID NO: 945 - DNA, 1551 bp, Unknownn
  isolated from dental, unidentified
ttgtctaacaattgtaaggcacttcaagattcaaaacgcttaaaaggttttcttgtaaaagataattcaaaacaaacacagcttaatgtgtacactgattctatcaatatgttaagtaattctgccgatacagatgaaaaggtaaactttccttctgatgaagtaaaagtgtatttaaatgatacaactaaggaaattcaaaatggcaatttaggtaaaaaggaagctgtaactgttaatcaaacaattaagttatttacagaactaggtaatctgagaaaagaaaagaccttaaagaaagctactagtgaaatcttaaacttaaatcaaattattgagtatcaagaaaattcaaaaaaatcatctaagaaaaaaaatgatgtggattatttccctaaaccagctttaatttggaataatgaatttgaaaaattatttactgcatccaaagtaggcgaaggtggtcaagttttaaaacaagtttcattgagtgatgaagaattaaaagaaaaattacaattattctgcgatattgtcaacgagtatgatacgtataagttatcaggagaaggatggcagacgttaggatttttattatatttatatgaagcaccttttatttggagggtaagagatttatatgatttagcggataaaagcaaacatagagaagatgttccaatagcagttgctttgattggacaaggtaagacgggaaaatcgacattaggtagaagattagccgctaagttgacaggtgcactaaattttacgggtagtggtgagtttgaagaaagaaataaatatgttaacaaagcaataagtgatgttattaatgaatatttacaaacatcaggtccagttagtccattaatgattgatgatgttcgtcctgatttaacaactagacaatattttgaagatatgattaaacgcaattcaaactctataactggcccaatgcctactgcaatatttacaatgaataaagaggatgattctaagggcgttgtatctaatcgtcatgaaattacaagacgtatttggttcttatcttttgaatcatcatttaaaggtaacagtaaagaaggagatttgaaagtagatgaactactaaatcgtgctgactctgatctatattacttatgccaacaattattggaagaatattttaaagatatttcagaagaggatgctataaaaattcaggcagactttttgtatccaattaagaaaatcttaaaggacttacttgttaaatatgatctttttcaagaaattgagaaattttttgaaaaagataactatgactatgctttatatagaggtaagtcagattggcatatgttaatagaacaggtaaaagaaccagacgatttttcttttatagaaagcagctacaagcacaatttaataaacaagcgtttaataaattgtcagatgggaccaataaaaataatggtagttcacagatggggttgtactataataatcttccgcgtaagtatgaaatttctgatagtagtaagtatggtacttctggattcatga

SEQ ID NO: 946 - DNA, 1041 bp, Oribacterium sinus
  isolated from dental, Oribacterium sinus
atgaaaagtgcagtttttgaaaataagggaaaagtcagtttagaagaaattagtaaacctacaattcaagatagtggtgatgctattatccgcgttattcgtgcatgtgtttgtggctctgatttatgggcttattctggattagacagtaaagaaaaacattccgttaatagtggtcatgaagcattaggtattattgaagaagtaggctctgatgtaacaactgtaaaatctggcgattttgtgattgttccatttacacatggatgcggtcattgtgcagcttgtttggcaggttttgatggtgtatgtcaagatcacgaagataattttagcgttggtttccaatctcaatatattcgctttgcatatgctcaatgggctttagttaaagttcctggtaaacctgaagattatagtgaaggaatgttgaaatcactacttaccctatctgacgttatggctactggctatcatgctgctcgcacagctcatgttaagcctggagataaagtagttgttgtcggtgatggagctgttggtcaatgtgctgttattgcagctaaaatgttaggtgcatctcaaattattatgatgagtcgtcataaggatcgccaagatttagctttggaattcggtgctactgatattgttgctgaacgtggagtagaaggtatttctaaagttattgctctaactggtggaacaggtgctgatgctgttctcgaatgtgtaggcgctcaagcatctactgaacaagccatgggcgttgtccgtcctggtggttttattggtagagttggtctacctcacgggaaagatatgaaccctgctgctacattctatcgtaacgttactctagctggtggtcctgcttctgttacaacttatgataaaaaagttttacttaaagctgtacttgatggacaaatcaatcctggaaaagtttttactcatagttatagtcttgatgaaattaatcaagcttataaagatatggcagatcgtaagactattaaatcactgttagtcatcgattaa

SEQ ID NO: 947 - DNA, 666 bp, Unknownn
  isolated from dental, unidentified
atgaatttggatttagtaatatttgacatggacggcgttatttttgattcagaaaaggtttattatgaagctaatcaaatagctgctgataagcttggcatggattactcattggcttattacaagcaatttattggtgctggaacagatgcgatgagagcacagatgattgaagattatggtggcgatgctcaactcattgatgactttttgcgtattagtgaagaaaatgttcatcctttagttgaagcaggagaattgaaattaaaaccaggtttcgtagagctatcacaatatcttcaagcaaatgacattgcttatactttagcttcaagtaactacaagagtgaaatcgaatttttcttagaacatacagatgttgatccagcttcttttgagacgattatttctgcagatgatgtagctgaggctaaaccagcaccagatatatttaataaggcttggaagaagagtggggcacctgccaaagaaaagacgatagtaatcgaagactcatttaatggaattaaagctgctaataacgctgaaatcccagtaatcatggttcctgatatcatccaaccaacggaagaacaaagaaaaacgacagtggctattttggatgacttgatttctgtgcgtgaatatctaaaaaataattattag

SEQ ID NO: 948 - DNA, 1263 bp, Prevotella veroralis
  isolated from dental, Prevotella veroralis
atgagtaaatggtcagaagatttacctaaagatttacaaaataaaatagagatagtagatgagaaaatatcttcaaaattagaggatataacagaaatagtattaaataatcagcgaagagtattagaattatttaggaagcatcatgtcgctgaggaagacttagttggttcaacaggatatggttatgatgacataggtagagataaacttgatgctatgtttgctgattattttaaaactgaagatgctatggttagaccgcaattgacatctggtacccatgccatttcaactgcattttttggagtgttgcgtccacatgatacattgcattatttaacaggaatgccatatgatactattcaagaagttataggtgtagctggaaataatccaggaactttggaagaacatctaattaatttttcttacacaccacttttagataatgggaaagtagattataaaagagcgaaggaagatttacaaaaagattcttcgataaaaatggtagctatacaacgttcgcgaggttattcttcaagagatagtttcgttgtttctgaaatagctgagatgataaaatttgtaaaaaaatatgcccctcaagcgataatttttattgataattgttatggagaatttacagagactgaagaaccaacattttatggagctgatttgatggctggctccctatacaaaaatgctggtggtggaattgcaaaaacaggtgcatttttagttgggaataaagatcttattgatagatgcggtgcaaggctcattgttccaggagcaggaaagaatgaaggtgccacatatccatttatgagagatttttacgaaggtttcttcttggctcctaatgtgacaggagaggcaattaaaggatcgatttatacagcagcattactagaagaaatgggaatggatgtatcacctagctgggatgcgcctaggacagatttggttcaaacggttaattttggtaatcctgatgcaatggtcaaattttgtgcagcaatacaacataattctcctatgaatgcatatgttgaaccagttccaagttatatggatggatatgaagataaaattattatggcatctggaagttttacagaagggtccacaatagaattatcaagtgatggtcctttaagagaaccatatacattatatattcaaggtggattaacttatgcacatgtaaaaattgctataactaaagcggtgctagaaacattttataaataa

SEQ ID NO: 949 - DNA, 1617 bp, Oribacterium sp.
  isolated from dental, Oribacterium sp.
atgaaattcaagaaagtattacgattagttccagttgttttagcaggcacattcttactagcatcatgttcaggaaagaatagttcaaaggacacattaaagttaatgcaaacagctgaaattcaatcgttggataattctaatgtagcaactttgcctcaatggaatgtgctagttcaatcaatggaaggtctatatagaatggacaaaaatggtaaaccagtagcagcgatggctacaaaggttgtaaaaccaactaacaatggtaagacttataccttccatatcagaaaagatgctaagtggtctgatggttctaaagttacagctcaagactttgtaacttcatggagaagatcagcaagtccatcagctaaatcaggatataactacatatttactggaattaaaaatgctactaaagtttcgagtggtgaattgccagcttctgacttaggtgtaaaagcattaaatgacactacacttcaagttcagttagagtatccaatgccttacttcagccaaatgatggtaatgccagctttcttcccacaaagtacaaaatacgttaacaaagaaggaaaaagatatggtacttcaagtacaagattagtatataacggaccatttaaggtaacaggttggaccggtactaatgaaagttgggatttaacacgtaataagtactactatgataagaaagatgttcatttgaagaagatctctatgcaagtagttaaagattcaaatactgctcaccaattgttccaagataataagttagatgatgcattagttacaggaactacagctcaaggtttgcaaaaagataaagatttgaagcacgtatacagagcaggaacatattatttaagactaaatctacaaaataataaagcattccaaaatcaaaaattaagacaagctttgtatctagttttaaatagaaaacaattagccaataaagtactaagtgatggatcaacagcaggagatacttatgttgctcctagattagctaaagatcctactacaaacaaagactttgcaacagaaatgaagccttctacaacttatgatttgaaaaaaggtcaagaattatggaatgaaggtttgaaggaacttaataagaagaaagtaacattgacacttgttacagatgatcaaacaatttctaagaatgtaggtcaatttgttcaatcacaagttgaaacaaaattaaaaggtgcagaagtagatgtagtatctgttcctgaaaagagtgctaatgataaagtaagtaacggtaattttgatatgaattatactttgtggttagccgattttgcagatccaatcagtgatttcgatgtattatctaagactaatccacaaaattatggtaaatatgctagtgagtactacaacaagcaattggaattagctaagcaaaacggtactgatactaataagtattgggaaaatatgagaaatatgcaaaaacaattaaatgatgacatgccagtagtaccattgtacacaatgacagaaagtcacttagtaaatagcaacttaaagggtgttatgtggcattcagtaggtgaaacagactacacaagagcatacttcggtaagtaa

SEQ ID NO: 950 - DNA, 753 bp, Unknownn
  isolated from dental, unidentified
gtggaaaggaatgaaactatggaaaagaagacatttataattccggtagggttagtggggctatatgcagtattactagttattagtggaagaatagttcagttattaagtttaaattccagcaatagtaagatatttgcctctgtaataattaattttgtgatatgtacgttacttttgtggctcaataaaaaatatataagagtaaaaatcgactttaaatttacttttagcttttttaagaaacataaaatattggctacagttttagcaattatcataatcttaattgttataggtaatgtaaaaaatcttccactagcattaatggtatccttacaagcaggaatagttgaagaggtaatatgtcgaggtattattagtaaatatatttataatggcttaaacaaagtagaggagaaaagaagaatatggataagtgcgattttttcaggtctagcatttggaatgttacattttatcaatctttttaggcaaggactactacctactattaatcaagttatagcggctgcagcaataggaatgctttttggggtaatatatttagtatataaaaatttatttggaacgatttttattcattttttgaatgatttttggattattgcagtaacaggtacaattactgagcaagattcaggtactgtagcaatgattatttcttcaatgctatattggataatattaggatttattgcatggcgaattatcaagaaaaaagtagcatag

SEQ ID NO: 951 - DNA, 2400 bp, Unknownn
  isolated from dental, unidentified
atggataaagaaaaattacaagaaaagctattacaaatttttgaagctgaaccacaaaaaaaattccaagttcaagatttagttaaagttcttgacatggaaggagcaggtcaattcaaatttgtagtacaagctttagcagatttagaacataataagcaaataaaattatctgaagatgatacatttagtttaatagtaaaagaaagtcctaaaacttttgagggagtctttcacgctaatgatagaggatttggttttgtatcagtagatgatgaagaattggatgatttctttattagtcctacacaaactctagctgcattgaacggcgatcgcgttgtagtcgaaatgatcagtgaaggtgatcctgaaattagcaagcgtcctgaaggtaaggttatcgaaattattgaccatgctctaacacaagttgttggggaatttcgtgttgatccagatgaaatcatgccagatggatatattggaacagtacatttaaaagataaaaaattatctaatatcaagtgttttattgaagaaaaaggattacatccagtacctggggaagttattttagctgatatcacttcttatcctacacagacactaccaaatataatcaaggcagtagctgttaaagttattggtaatgttaacgatccaggaatggatattttagaaattgtataccaacacaatattccaactgaatttccagaagaagtgttagaacaaatttctaagattccagactatgttacagaagaagaaaagataggtcgtgtagacttaactgatcaagatcttgttactattgatagtatagaatctaaggacttagatgatgctgtaaatgtttggaaacttcctaatggaaattatcatttaggagtacatattgctgatgtttcacattatgtaaaacctaaaacacctctagataaagaggcttttgaacgaggtacttctgtttatttaacagacagagttattccaatgttacctcctaaattatctaatggtatatgttctttaaatccacatgtagaacgtctagcaatgacatgtgaaatggaaattaatgctgatggagaagttgtaaatcataaaattttcccaagtgtcattaaatcaactgaaagaatgacatataaggcaatcaataaaattttagaatctgatgatgaaaaaactaaagaacgttatgcagatttagtacctatgtttaaagacatggctgaattacataagattttagttaaaatgagaaaacgtcgtggtgcaattgattttgatgcccctgaagcaaaaatcattgtagatgaattaggacatccaattgatattgaattacgtgaacgtggaactagtgaaagaatggtcgagtcattcatgttagcagctaatgaaactgttgcggctcactataataaattacatgtaccatttgtataccgtattcatgaaacaccaactccagaaaaaataacaacattctttgaagctcttaatagtttaggaatagaagttactggtagaagtaatgatgttaaacctaagatgttacaaaatatcttgaagaaagtagcaggtaaaccagaagaagcaatggtatcaacaatgttgcttcgttctatgcaacaagctaaatactcacctgacccattgggacattttggtttagcagctaaagattatactcactttacttccccaattagacgttatcctgacttgatggtacatcgtttgattagatactataaagaaaatggtacatctgaacaagttcaagaaaagtatcgtaacaaattagacgaaattacacttcacagttcacaaatggaaagacaagcaattgacgctgaacgtgatactgatgcaatgaagaaggctgaatttatggctgatagagttggagaaatattcccagctgtagttagctcagttacaaaatttggaatgtttattgcgcttgagaatactgtagaaggtttaattcatattagtgagatgaaaggtgactattacgtattccttgaaaagcaaatggcgttagttggtcgtcattctaaacgaacatttaagattggacaaccaattgaagttaaactaattaatgttaatgtcgaacaaaaagagatagactttaaattagagggtgtcaaagatattcctaagtctgatttattagagggtgttgaattacctgaatttaaaccacgtgataataataaacgtcgttttaaagataaggataaaaaacgttcacatggcaataagaagtaccatggtaaagataagaaaaactttaaaggtggacaaaagcctttctacaaaaatggtaataaaaatagatttaatcactctaataagaaaggtcgacgttcaagataa

SEQ ID NO: 952 - DNA, 1431 bp, Unknownn
  isolated from dental, unidentified
atggatggaataatgatggaacaagcttgtacatcaattttagtaggaaagaaagcaactgttgatggttcaacaatgattgcgagaaatgatgacacatttctaccaatcactcctcaacgatttgttatgcaaccagctgtatctggacgtaaagaaacttggacttccaataaaaatggttttactgcaccattaccaagtgaagggtatagaacaacttttactcccaatgctgatgtagaaaaaaatggtgtctttggtgaaacttcaattaacgaaaaaaatgtagcgatgtctgctacagagtctgtatatgggaatccacgtgctttggcatatgatccatggatagaaaatggattggcagaagattcattacaagacatggtggctccatatatagattctgcacgcgatggtgttaagtacttaggaaatcttataaagaaatacggttctccagaaggaaatggtgtcttgtttgcggataaggatgaagtttggtacatggaaattgtaacaggtcatcattgggctgctacaagaattccagatgatgcctatgcaattgctgctaatcaagtagcacaacaaaaaatagattttaatgatcctgaaaattatatgtggtcagatggattattggaattcgtagaagaacatcatttgaatcctaataaagatggcttcaatttccgtaaaatttttggcacggatactgaaaaagatagacattacaatactccacgtgtttggtttggacaacgttacttcaccccagaagtagaacaagaaccaacttcttctgaattgccatttatctgtcgagctaatcgcttattatcagtagaagatctagagtatgtattaagttcacattacaatgaaactaaatatgatccattaggtcatggaagtgaagaagataagaaacgtttccgtccaatctcattgaatcgtacacaaaattcccatgttcttcaaattagaaataatgttcctgaagaacaagcaggattaatgtggatgtgctttggtgttccttcattcacgccatatgttccattttatgcaaatgctaatgacactgatcctagttggagtaatacaccacttgaatttgatatgaatagtgcatattggatgtatagagctttgtcaatgttagtagaatcacatcatgctcaatttattcaagatgatttagattatttaacagctgcacgtgaacaacaacatagattgattgatgaaactgataaagctgctcaagagttaagtggagaagatttaacaagatttttaacagaaaagaactatgaaatggtagcagacatgaaagaacgaacaatgggaatgataaatcatttctttgtagaaggtttgaagctatctaagttaacatttaatatggacgctaatttataa

SEQ ID NO: 953 - DNA, 789 bp, Unknownn
  isolated from dental, unidentified
atgaatcttaatttagaaaatggatggcaaatcctcccaatcggtggtgacacagatacagcatatatgggaataaaaagtgatcaaaaagtatttttaaaacgaaatacctctccttttttagcagcattgtctttggaagaaatagcacctagactaatatggacgaagaggatttcaacaggtgatactttgactgcccaagagtggttaaatggtagatctttatataggagtgaaatgggacaaaaatcggtatctgatttattatataaagttcaccatactcctgtacttaaaaaaatgttaattcaagttggtggaaaagtagttacgccaattgatttagtgagaaagtactttgaaggacttcctgatgatttaaatcagcatccgttattgaataaagtagcaaattatttaaaggccaatcagcccgatttaaaatctgatttttatgaagtatgtcatggggatttgaatcataagaactggttgttgtcagataaagaaaaactttatttagtggattgggaatcagctagaattgctgatccagctagtgatcttagtatgttaatgtgtcaatatgtcccacgtaaaaattgggagcaatggttacgtcagtatggtttagaagtgaatagagatttatggtatcgaatttactggtattcattgataaatttattgctcgatgttaaatactatcatcaacgtggtcgtttcacagaaatgaaccaagacatattaaaaatatcggaattaattaatgaacttaatttttaa

SEQ ID NO: 954 - DNA, 879 bp, Unknownn
  isolated from dental, unidentified
gtgagtgtaaaaattattgtaccagctactagtgccaatataggcccaggatttgattctttaggtttagctgtgactagttatttaacagtgactgttgtggaagagaatgtagatgcttggtatgttgatcataatttaggtgaaaaaattccacatgatgaagaaaatttaattgtaaagacagctttagaattagtaccagacctacaaccgttaacagtaaaagtagaatctgatattccattaacccgaggcttaggaagtagttcttctgctatcgttgcaggtttgatgttagcaaatcatttcggaaacttaaatctgtcaaaacaagaattagttcaaagagcgactgaaattgaaggacatccagataacgttgcaccagctatactaggtgattttgtcgttgctacatatttagatggagaaataatgtatgaaaaaataagttttccagacgtaagcttattagcatatattcctgattattggttagctactaaaaagagtagaggagtgctaccagcaaatttagatttcaaagatgctgttagagctaatgcaattggtaatgctttggtagcgaagattgtatcaggaaataaaaaagatatgggaaaactgatggaagcagatctcttacacgaaccatatcgtgataaattagttccacatttcttaaagttaagatatttgggacatgagataggggcatttgctacatatttaagtggagctggtcctacaacaatgacgctaattgaaaaagacaaggttgatgaatttataaaaattgctcaaaaatcgagcttaaatgatgaatatcgtctacttgaagttgatagaaatggtgcaaggattgaagtggaataa

SEQ ID NO: 955 - DNA, 1302 bp, Unknownn
  isolated from dental, unidentified
atgttcgtaaataattataatgatgccttggcatttattcatggaagaactaagtttaaaaagatcccaactttagatagaatgagggatttcatgaagagattgggaaatccacatgaaaaagtaaaagctattcatgtaacaggtacaaacggtaaaggatcgacaacagcgtatttgagagacttaatagcagaacaaggatataatgtaggaacatttacatcaccatttatcgagaagtttaatgagagaatatctgtaaatgggaaaatgattagtgatgaagaaattgttcgtttggttaatataattggaccagtagtgaaagaaatggattcagattggcgtgatcgtgaaggtggaccaacagaattcgaaattgtaacagcgatgatgtttgtttattttgctgaaggacatgttgactatgctgtaattgaagtaggaattggtggattatttgattctactaatgttattactccgcttatgtcagttattacgactgttgcaatggatcatgctcatattttaggcgatacaattgctaaaattgcaacacataaagcgggtataatcaagtataaaaagccaatcttgattggtaaacttccagatgaagcaataaaagtagttaaacaagtagctaaagaaaaagaagcaccattattaataatggataaagatttttccagcaaagtaaagttagaacaaggttggggagaaaagtttgatttttcagacagtagaggagaaataagtaatatacatatctctatggaaggatttcatcaaatagaaaatgcaactttagctattgaaacgtttattcaatttgctgaacttgaaggaattaattattctaataaagatataaaaaatgcaattcaaaaaacacaatggcttggaagatttgaacttttaaataaagaaccattagtggtgattgacggtgctcataatacggcagcgatgaaaagaatttcccaacttttgagaaaagaatttgcggatagagaagtttatgttattctagctattttagctgataaacaacctaatgaaatgttagatgagttgttaaaattgccaaatgtacatgtaactgtaactcgttttgaaggaccacgaaaagtaacaaagttggcagattttaaattacatgataatgtaaagtatgtggaacattggcaagaagcaataggtgaagtcatatctaatatgtcactagatgatatgttattgataactggctctctatattttatttctgaagttagaaataactttgaagaataa

SEQ ID NO: 956 - DNA, 2403 bp, Unknownn
  isolated from dental, unidentified
atgaaaaaatcaagtaacgaaaaaattgacataaataggataactcctgatgcagactatgggcttacggataaacaagtggaaaaatataagaaaaatggttggagtaatgaggcagtgaaaccacctgtacgtactgctaaagaaatagttgcagaaaatatatttacatactttaatttgatatttttaatattaactttacttttatgtttagtaaattcatttagaaacttaacctttttaccaattattattgcaaatatttttattgggataattcaagaattaagggcaaaaaaagttgttgataagttaacgatgctaaatgttcctcaggctatggtggtaagaaacggagaggttaaacaagtaaatacagaagatttagtattagatgatattgtaatctttaaaatgggaaatcaaattttagctgatagtgaaattgtaagtggagaagttttagtaaatgaatctttattgacaggtgagtctgatgaaattcctaaaaagccaggagataaattaatgtcaggtagctttattattgctggaaagtgtagagcaagactaacagcggttggcagagactcatatatttctaagttaacattagaagctaagaaaatgaaaaatgttgaacgttctgaaatgatccaagatcttgatatattagtaaaatttgtaggtgtagcgttagttccgattggaattgttttatttatacaaggaattttcataaatcatgaaagtttacatgacaatataacatctatggtagcagctgttttaggtatgataccagagggactgtatttgttaacaagtgtagcattagctgttagttccatgaggttggcgaagaaaaaagtattgcttcatgatatgaaaagcattgaaactctagcaagggtagatgttttatgtgtagataaaacaggaacaattactgaaaatgaaatgaaagtagaaaaaataaaagcaatcgatatagaaaacagagatgcctttgaagagttattagcaaagtttgtttatgcaatggatgaaagcaataatactatgaaagctataagaaattattgcaaacagacgagcaaagtgatagcaagtgaaatcattccatttacatcaaaaaataagtatagtggggctgtttttgaaaatgatgcatacatattaggtgctcctgaatttgtattgcatgaagatttttcattatatcaagatgatattaatgaagatactaaaaaaggatatagagtactagtatttggaaaagctttagatggctttatggataagaaagttacaggtaaagtaattcctataggatatgtattaataacaaatcccataagaaaagaggcacctgcaacatttaactattttaaggagcaaggagtagaagtaaaggttatttctggagataatccgcaaactgtttcagaaatatctaaaaaagctaaaattgaaaatgcagatctgtacattgatgctacaaagttagagacaaaagaggaactagctgaagcagttaaaaactataatatttttggtagggtgacaccaacgcaaaaaagagaaattatacgaattttgaaagaacaaggaagaactgttgctatgacaggcgatggagtaaatgacgtgctagcactgaaagatgcagattgcagtatagctatggcgtctggtagtgatgctgcagtttattcatcgcaagtagtgctattagaatcgaatttttcatgtatgcctgacgtagttttagaaggaagacgtgtagtaaataacatccaacgttctgctagtttgtttttggtaaagaatatattttcctttttcttatcaatgttagcagttattttatcatttacttatccgttaaagcctgcacaagtttcattgataggaatgtttacaattggaatacctgcctttttcctggcattacaacctaataaagaaaagatagaagggcgatttttatctaatatattactaagggcctttccagcagggataactgatgtgatagttgtggaaatgatggtacttctagcttcgatgtttgaaataaaatatgcagactattcaacagcttccactattttattatctatagtaggattgatagttttgtataagacctgtaagccattcaatgtccttagagtaaccgtttatgtgggatgtatcttaggattgataggaagttgcgtatttttaccatggttatttggcattacattgccatcgaaagaatgtattgttttattaatattaattgcaataacgattaatacgttattaagttttacaaccaaaattgttaacttagttcgaaatggttttattaaaattagaaataaaataaaaaatattttgaataattaa

SEQ ID NO: 957 - DNA, 1251 bp, Unknownn
  isolated from dental, unidentified
atgcgacctaaaaatattgatgacgttgtagggcaacagcatcttgtcggccctggaaaaattattagaagaatggttgaggctaaattactttcatctatgattttatatggcccacccggtaccggtaaaaccagtattgccagtgccattgctggttcaactaaatatgcctttagaaaaatgaatgcagcaactgattctaaaaagaaattagaacaagtggttgaagaagccaagtttagtggtacagttattctattacttgacgaaatccatcgcttaactaaacctaaacaagactttttactacctcatttagaagatggacatattattctaattggtgctactactgaaaatccttatatttcaatcaatcctgctattagaagtagaactcaaatatttgaagtacatcctctaaatgaagacgatattattcaagcaattaaccgagctattactgataaagatgatggcttaggtgaattgcctctacaaattaatgatgacgctatgcaccaactagcaatcgcaacacatggagatttacgtagtgcattaaatgctttagaattagctgctaaatctactccaaagaattctgaaggaaatattgtacttactttagaaatcattgaagaatgtatgcaaagaaaagctttggttcaagataaagatggtgacgcacactatgatgttatctctgctcttcaaaaatctattcgtggatccgatgttgatgctgctcttcactacttagcacgcttaatcgaagctgaagatctcccatcaattagtcgacgcttaataacaattgcttatgaagatattggattggctaatctccctgctgctactagaactgttctagcaattcaagctgcagaaaaaattgggtttcctgaagctagaattcctttagctgatactgttattgaattatgtctatctccaaaatctaattccggtatttcagcaatagatgctgccctctctgatattcgagctggaaattatggtgatatacctgattatttaaaggatgcacattattcaggagctaaagaattaggatatggtattgattataaatatcctcatgattatcctcatgattgggttaaacaacaatacttaccaaataaacttaaatccaagcaatactatcatcctaaacaaaatggacgctacgaagaaagtttaggaaaacagtaccatcgccttaagaatgcccaaaatagttaa

SEQ ID NO: 958 - DNA, 816 bp, Rothia aeria
  isolated from dental, Rothia aeria
atgaagaaaaaaacagtttttggtttaattacatcagttgcagcagctgctttcttatttacaggcgtttctaaggcaaatgccgatacaactttaacagttggggcatctccaactccccatgctaaaatcttggaacatgtaaagcctgaattaaagaaggaaggcattgacttaaagattaagaagtatgacgactacattattcctaacaaggctttggctaacaaggaaattgatgctaactacttccaacacacaccatttttaaataactggaacaagaaaaacaacggtacattagtttcagctggtaatattcacttggaaccaatcggtgtatactccaagaagtacaagagtttgaaagatttacctaagggagcaacagttaatgtttcctctaatgtatctgactatggtcgtattttgacaatctttaaggatgcaggattaatcacattaaagaagggcacaaatattgaaacagctaactttaatgatattgctacaaacaagaaacatttgaaattcaagcactcctttgaagctaagttaatgcctcgtttatacaaagaaggtaaagatgctgcttatgtaatcaatgctaactacgctgtacaagcaggtttaaatccttctaaagatgcaattgctctagaaaagaagagctctccatatgctaacatcattgctgtacgtaaggctgacaagaacaaaccagctatcaagaagttagtgaaagcattagaatccaaagatacacaaaactggattaagaaagaatttaagggtggagtacttccagctaaataa

SEQ ID NO: 959 - DNA, 1272 bp, Unknownn
  isolated from dental, unidentified
atgaaaaaaatgattgttaaaggtaagcagaccttatctggagaagtaactgttggaggtgctaaaaatagtacagtggcactaattccagcagctattttggcggacacagttgtaagatttgatagtgtaccggatattttagatgtacataatttgatgattattttaaagtctatgaatgtttcttcccattttggacatggggaattgatgatagatcctactgaaatcaagaaagctccacttcctggtaaagctattagaagtttgcgagcttcttattatttcatgggagctttgttaggtagatttggtgaagcaattgttgattttcctggtggcgataatattggtccacgtcctattgatcaacatattaaaggcttcgaagctttaggtgcaaaagttgtagaagaaaaagataaagtatatatcaagactggtcctgaaggtttgaagggtgcaagaatcttctttgacttagtttcagtaggggctacagttaacgtcttattagcagcagttaaagctaaaggaactacaattattgaaaatgcagctaaagaacctgaaattgtcgacttagctacatttttaaataatatgggagctcgaattcgtggagctggtacagatgttattagaattgagggtgtagatgaattaagagctacaaatactcatacaattattcctgatagaattgaagcaggtacatacttagcatttgcagcagcaaacggtaacggtgtattagtaaaaaatgttattacagaacatttagatccattcatcgccaagttacaagaaatgggtgtacgtttagaaattcatgaagatagcatctatgttcctggtggcgatttattagtccctgtcacagttaaaacagctcctttcccaggttttgcgacagatttgcaacaaccactaactccactattattaaaagcacaaggtagttctagaattattgatacattatatcctgaacgagttaaacatattcctgaaatgcgtaaaatgggtgcaaagatttctagtaaagatggaattattactgttaagagatctaaagacttactaggaacaacagttgaagctagcgaaattagagctggagtatcattactaggtttagcattaatggcagaaggaacaactgtgatcacaaaggctgataatattttacgtggttatgacagaatagtagataaattaaaaggtctgtctgtaaaagtagaaattattacagataaccgagaatag

SEQ ID NO: 960 - DNA, 762 bp, Unknownn
  isolated from dental, unidentified
caatttgaatataaaaataacagaatggaattatacaggaggaaaattatgaaatacgatagaccaataatagctttggattttccggataaagagaaaacttttgaatttttgaaaaagtttcctgaagacgaaaagttatttgtaaaagtggggatggaacttttctatagtgaaggttctgatatggttaaagaattaatcagtgaaggacatgatgtatttctagatttgaaattacatgatattccaaatactgttaagcaagcaatgaaagttataggaaaacttggtgtcaaacttacaacagttcatatttctggtggtagtgaaatgctaattgctgctaaagaaggattgttagatggagctaatggagatactaacactaagattttgggtattacacaattaacttctactgatgaagaaatggtaaaaaatgaacaaaaattatcaatctcacttaaagaaagtgtagaaaactatgctaagattgctcaaaaatctggcctagacggagttgtttgttcagcagaagaatctgatatgatctataagttaacaggcgatgatttcttgagaataactccaggaattagattagcaggtggcgatgttggtgatcaaaagcgtgtaatgacaccagatgctgctgcacgtaatcattcaagtggtattgttgtaggacgtgcaattactaaagctgcaaatcctttagatagttatagattagttacaaaattatggaggggaaaataa

SEQ ID NO: 961 - DNA, 1335 bp, Unknownn
  isolated from dental, unidentified
atgcaagaaaaaaatgtaaatcatggtagagctgcgattttaggtttacaacatttattggcgatgtattcaggagcagttgccgtaccattattaattggtacagcattaagatttaatagcgagcaaatgacatatttggtatcaattgatatttttatgtgtggtttagctacttttattcaattagctcgtaataagtattttggaattggactaccagttgttttaggatgtgcgattcaagcggtagaacctttgaagatgataggtaaacaatttacaattggaacgatgtatggtgcaattattgtcgccggaatttttgtgtttttgatttcaggttatttttctaagattaagaaattattcccaccagttgtaactggaacattgattacagttatcggtttaacattaattccaattgctctacaaaatatcggtggtggcgatgcaactactgctgattttggtaattggaagaatttagttactggttttgtaacgattttgattatcttgattattcagatttggggtaaaggttttttgagttccatagctgtattaattggtttaattttaggaacattactagcagctacaatgggaatggtatccttgcaaccaattgtcgaagctgcatggttccacgtgccacaaccattttattttggagctccacactttgaatggtcatcttctgtaacaatgataatcatttccttagtatcaatggttgaatccacaggtgtattctttgctttaggtaatttattaaacaaagatattactgaagatgatttaaagcatggttatcgtgcagaaggtttagctgtagttttaggtggtatttttaatactttcccatacacaactttctcacaaaatgtaggtttattacaattaacaggaattaagactaagcgtccaatttattggtcagcagttttattgatgattttagggttacttccaaaaattggagcattagcaactattatcccaactccagttttaggtggggctatgttggtaatgtttgcaatgattagtgtccaagggattagaatgttgattgacgttgatttcaaagatgaacgtaatattttgattgtagcagtgtcaattgggttgggattaggagtatctatttatcctacaattttccaaaacttgcctcgcacaattcaattgttcttaggtaatggtatcgttgttgcaagtatttgttcagttggcttaaatgtttgtttcaaaggtaaagaaggattagatcaggaacaaattactcaaaaagatgaacgtccaatgacggttgaaactaaataa

SEQ ID NO: 962 - DNA, 1134 bp, Unknownn
  isolated from dental, unidentified
atgacaaagactattaaagatttagcacattatgatattgtaggaagttttttaagacctgaagaattaaaaaaagcacgcaaagatttttcagaaggaaagatttctcaagatgaattaaaggaaattgaagatagactaattgatgagttggtggaaaaagaaaaagaagtgggactaaaggctgtgacagatggagaatttaatcgaggctggtggcatattgactttttagaaaatttagatggagtagaagggtacgttccacaaacaggatataatcaacaatttaaaggaactgatgcacctgcatataatgttcgagtggtaggaaaagttaaatttaatcctaatcatccattcttaaagaatttctcttatcttaaagaagttgcagataaaagaaatctcatagctaaagctacaattccgagtccaacaatgttatatcgtcaagaaattttagctaacgatggttcttcaaaattgaaagaaatttatcctaacatagaagaattttatgcagacttatcgcaaacttacgcagatgcaattaaagctttttatgatttaggttgtcgatatctacaatttgatgatacaaattgggcgtttttagttgataaaaataaacgtgaagctctattagaaaagggtattgatcccaacgaagcaacaaaaattagtaagaagattatcaataatgcattagcgaataaacctgatgatttaataattacaactcatgtatgtcgtgggaatcatgcatcttcttggttattctcaggcggatatgaagctgttgcagaagatttatttgcaacagattatgatggatatttcttagaatttgacgatgcacgttcaggtagttttgagccattgagatttgttcctgctggtaaaagagtggtattaggactagtaactagcaaaaagcctgaattagaggacaaagatgaattaaaacaaaaaattcaggaagcaactaaatatgttgatttagatgatttagctttaagtacacagtgtggatttgcttcaacggaggaaggaaataaacttacagaaaaagatcaagaaaacaaactgaaattagtaattgagacagctaaggaagtttggggagattaa

SEQ ID NO: 963 - DNA, 1491 bp, Streptococcus parasanguinis
  isolated from dental, Streptococcus parasanguinis
atggaatggacacgtgaatcacgttataaaaaatattctgaatgggatgcggaaactttactgaagttacaggcacaagcaacagcttcaaaataccaaatggcttatcatattcgccctcaatcaggcttattaaatgatcctaacggtttttcttactttaatgatgaataccatgttttctatcaatcttatccatttggtgcagttcatggtttgaaatcttgggttcatttaacttctccagatttagttcactggaagaaccttggattagcgattaatgctgatactaaatatgatagtcatggtgcttactctggttcagcacgtgttatcgatgataaattattcttaatgtatactggtaatcatcgtagtgaagaatgggttcgttacccttatcaaattggtgcaatcatggacaaggacaacaatattactaaacttgataaacctatgattgagcctgtagatcatgtaactgaacattttcgtgatccacaattactaaaacatcgtgatgaatactttgttatcttaggtgctcaagatgctgaaacaaagactggtaaaatctcactcttccgttcaaaagatttaaagaactggcaagacctaggctatcttgattttactgaagaagaaatgggatacatggtagaatgccctaatttagtctttgttgatgatcaacctgtacttattttctgtccacaaggtttagataagaaagttgctgattatgaaaatatctaccctaatatgtatattgttggttcagatgttcgtttagacaaagctaaattcaatactgatcaaaaagcacctctaaatcttgacgatggttttgacgtttatgctacacaggcattcaatgctcctaatggtaaagcttatgctatttcttggattggacttcctgatatctcttatccaactgatagtgaaaactgggctaactgcttaagtcaggttaaagaattatctgtagttgatggcgaattataccaacgccctgttccagctatggcatcacttagagaagaaggaactcttgttagaagtgaagaagtatttgatgaccaacaaattgtccactctgcagcttcaaaacattatgaattgaaacttgatcttgcagctggtcaaaatggtaaattattcctagcagctaataaagatttatcccaaggaattgaaattaatttctctactgctgatgatgctttccttacagtagaccgtagtaaggctggtattcctttcgcagaagattacggtacaactagaactattgctttgccagctaataaacaacttagcttagatatattcgttgatggttctgtttgcgaaattttcgttaataatggtagacataccttaactttaagattttttgctcctgatggtaacaataagattgcatttactagtgataaaaagctacaatatactggtacctattggaatatgaaaaatatttag

SEQ ID NO: 964 - DNA, 597 bp, Prevotella pallens
  isolated from dental, Prevotella pallens
atgcttaatggactaataattattggcataattttatggctgtaccttctatctgtacttaatcgtgctaatttaattggctttcacttttgggtaggaagtgtaggactatttgcaattatggcttttattagtcgagcttatttcgtctggttcttatcagcatgtattacacaagtaactggttggtggggaactttaacaggtttatatagtagttcctacattaataatttaatcagcattcataattcgcatggcttaattatgttatttgtagattatgaatgttctggtattattgaaactttagcttatctaagtttattgtggttctatcctatgtatcagaagatggaaaaaataaggttaactttcattggaatagcttggattttcatggctaatgttttccgtttatcattgatttcaacgattatctattatgccggaagtggtgcgtttttctgggtccactcaattttaggaagaattattttctatgttcttgtgattattctttactataatgtatttactcgctctcaacttgaagaaaaaggaacggctagatttaattatgggaggcgaaattaa

SEQ ID NO: 965 - DNA, 1194 bp, Unknownn
  isolated from dental, unidentified
atggaaaaaattctttcaataaattctggaagctcaagtttaaaatttaaattatttgcaatgcctgatgaaaaagtcctagctaaagggctttttgaccgtattggaattgataattctcgtgttactattaaatatgatggtaaaaaatatgatgagcaaagagaattgaaagatcataatcaagctgtacatgttttgttgagcttattcaaagaattaaaattaattaatgattttaatgaaattacaggggttggacatcgtgtagttgctggtggtgaatactttgataaatctgtaattgttgatgaagatgttatgaataaaattgatgaattggctgaatatgcacctttgcataatcctgcagaattagttggtattagagtatttaaggaattattgccaaatgcagtgtctgtagcagtatttgatactgcatatcatcaaacaatgcctaaagcaaattacatgtattctatcccatatgaatggtatgaaaaatatcatgtaagaaagtatggggcacatggtacaagtcatcgttatgtagctcatgaagctgctaaattgttaaacaaaccatttgaagatttaaaaattataacttgccatttgggagcaggtgcatcaatttgtgcaacaatgaatggaaagtcttttgatacttcaatgggattcaccccattagcaggaattacaatggctacacgtgcaggtgatattgatgcatcattagtttctttcatgatggaaaaactacaaattaatagttctgaaatgatagatattttaaatcataaagctggtttaattggtatttcaggagtctcatcagatatgcgtgatgttttagcagcagcagatgataatgagagagctcagctagcagttgatatttttgtaaaaaatgttgttaaatatatcggttcatatatagctgaaatgggtggcgttgatacgattgtatttactgctggtatcggggaaaactcaacaccaattagaaggttagtcatggaacgtttagcatatttaggaatcacaattgatgaagaagaaaatagtaagcatggttcagcaggagtgatttcaggcgatgattccactattaaagtactaagaattccaaccaatgaagaattaatgattgcaagagatgttcaaaaattagaaaaagaagtaaaataa

SEQ ID NO: 966 - DNA, 1758 bp, Unknownn
  isolated from dental, unidentified
ttggaaggaggagtctctttgagttatcaggctctttatcgagtttggcgtccacaaagatttatggatctagttggtcaagaaatggtgaccagaactctgaaaaatgcaattataactcaccaaacctcgcatgcttacttatttactggccctagaggaactggtaagacatctgcagcaaagatttttgccaaggctataaattgtcgcttttcaaaagaaggcgagccttgtaacgaatgtgaaacatgtaaagccattacggaaggacgtttaaatgacgttattgaaatagacgcggcttctaataatggtgtagaggaaattagagatattagggataaagtaaagtatgcgcccacagaagctgattataaagtatatattattgatgaagttcatatgttatcaactggtgcatttaatgctttgttaaaaacccttgaagaacctcctgcaaatgtagtctttatcttggctacaacggaaccgcataaaatcccagcaactatcatctcaagaacgcagagatttgattttaagagaataactgctgagtctattttacaaagaatgatttatattttagatcaaaaaaatgtagattatgatgataaagctttaaaagtaattgccaaagctgctgaaggtggaatgcgtgatgctttaagtttactagatcaggtaatctcttttggtgataataacgttactttagataacgcattgttagtaacgggtagtgttacacaagaaagtttatttaattatctgaaatttgtactgtctaaagatacgactaatgctttaaaagaaattcagcagattgtagaacaaggtaaagatgccaatcgtttaattgaggacttaattaattattgtagagatttactattataccaacaagcaccagagatggtttctgatggtgaattaggtttattagataataaatttaaggaattatctcaacaaataaatgttactcaaatttatcaaattatagatgaattaaataagcaacaagagaatatgagatttagttctcaccaatctatttatttagaagtattaactgttaaattaacgcaattaagtacgaatagtgaatctgataggatatcaaatgttgatttgagtcaaattgaattattaaagcaaaaaatagaaaacttacaacgtaaagtggataatttatctagtaatacagttcaaactgaaaagaataatgagcctagaaagcaagttagaaaaaatacaacaaagggacaaaaaaatgttaaaattaatttgtcacaagtttatagtgtattaaacaatgctacaaggcaatcgttaaatgaattgaagcaagtttggccagatttaatgaatatgttatctgttactcaaagagcaattatgcatgttagcgagccagttgcagctagtgaaaatggtgttgttgttggctttgaatatgcatttttatgccaaaaagctcttgaagaccaagagttgatagatactctggaaaatggattagacagactaattggaaaggttccaggcttagtattgattccagtagaaaattggcctgaaataagaagtaactatcttaaacaaagaaaaaatggggcagtagttattgctgatgatacaagtgaacaatctcaggataatgatgatcaatctgcctcaactcagccaactattatacaaaaagctgaggaactatttggtacagacattgttgaaataaaaaatgattaa

SEQ ID NO: 967 - DNA, 708 bp, Unknownn
  isolated from dental, unidentified
gtgaacgggtttttaggagaatttttagggacaatggtcctaatcgtactaggtgtgggcactggtgctggtgttaaccttaaaacatcatatgcacgtaattcaggttggctattcatcacaattgcttggggtatggctgtgacatttggtgtttatgtagctggtagctttggttctcaaggacatttaaatcctgcagttacaatcccattcgcaatctttggattcttcccatgggatcaagtattgccatacttattaggtcaattcttaggagcttttgttggtgcagttttagtcatcatccaatatggagcgcaatttaagaacgcaaaagactctaatgacggtaatgtagtaggaatttttgcaacaggtcctgctatcaacaatggtttatacaatttcttaagtgaaacaatcgcaacttttgtattcatcctaacattattaaacttaggagactttacaaaaggattgaagccattgattgttggtttactaatcatggtagttggtcaagctttaggtggaacaacaggatttgccttgaatccagctcgtgactgggctccaagatttgcttactcagtattaccagtacctaataaaggtgactcaaactggggttatgcttgggttccaatgtttggaccattagcaggtggtttaatcgcagcttgtgttcaatatttcttaatgtaa

SEQ ID NO: 968 - DNA, 1047 bp, Oribacterium sp.
  isolated from dental, Oribacterium sp.
atgaatcttaaagaaaagcttgctgagctaaaagaacaaggattagcggaaataaaagaagcaaaagacttaaagaaaattaatgacattcgtgtaagtttgttaggtaagaaaggtccaatcactgaagttttacgtggaatgcgtgatttgagtgcggaggaacgtccaaaagtgggacaatttgctaatgcaattagagatgaattgactcaagcattggctgataagaaagatgaaattgaagttataaaaatggctaaaaagctggaaaaagaaacaattgatgtaactttaccaggtgtgccagtaactacaggtaatacacatattattacacaaataattgatcaaatagaaaaattattcttgggaatgggattccaagttgttgatggtcctgaagtagaagaagatcattataactttgaaatgcttaacttacctcaagatcatccagcacgtgatatgcaagatactttctacattactgaaaagattttaatgagaactcaaacatctcctgtccaagctcgtacaatggaaaaacatgactttagcaagggaccacttaaaatgatttctccaggtaaggtttaccgtagagatactgacgatgcaactcattctcatcaattccatcaagtagaaggactagttatagataagcatattactatggctgatttaaagggtactttgcaattaagtgcacgtactattttcggtgaagatagagaaatcagaatgcgtccaagttatttcccatttacagaaccatctgctgaaattgatgtttcatgttttaagtgtaatggtaaaggttgttctgtatgtaaatacactggatggatcgaagttctaggtgctggaatggtacatcctaacgtattggaaatggcaggagtagattccaatgtttatggtggatttgcattcggtttaggaccagatagatttgcaatgttgaaatatggtgtagacgatatcagagagttctatctaaatgatgttcgtttcttaagtcaattttcacagaagggatag

SEQ ID NO: 969 - DNA, 471 bp, Unknownn
  isolated from dental, unidentified
atgccaagaaaaggtgccgttgcaaaacgcgaagtgctcccagatccaatttataactcaaaattggttactcgcttaatcaaccgtttgatgttagatggtaagcgtgggactgcatcaaagattttataccaagcatttgatattattaaggaacaaacaggaaatgaaccattggatgtttttgaagaagcaatgaagaacatcatgcctgtacttgaagttaaggcacgtcgtgttggtggttctaactaccaagttcctattgaagttcgtccagatcgtcgtacaactttaggtttacgttggttagttcaatactcacgtcttcgtggtgaacacacaatgtccgaacgtttagctaaagaaatcatggacgcagcaaacaatacaggtgcagctgttaagaaacgtgaagatacacataagatggctgacgctaaccgtgcattcgcacattatcgctggtaa

SEQ ID NO: 970 - DNA, 2073 bp, Unknownn
  isolated from dental, unidentified
atgcgatatgatattaaagacgtgacttttaaagtcagaaaggagaagagcatgccaaagaataattataatgatgactcgattcaagttctaaagggcctagaagctgttagaaagcgccctgggatgtatataggctctacagattcacgtggattacatcacttagtatatgaaatatttgataacgcagttgatgaagcactatctggttatggcaaagaaattaacgttattattcataaagatgattcaataacagtagtcgataacggacgtggaatgccagttggaatgcattcaatgggaattccaacagtagaagtaatttttaccgttttacatgcaggtggtaaatttggtcaaggcgactataaaacttcaggcggattacacggcgttggtgcttctgtcgtcaacgcactctcctcaaagttaactgtaaatactgttcgagatggaattgaatatgaagaagattttgttaacggtgggcaacctgtgggaactttacgtaaaattggtaaggccaaacgtaaaagcggtacaaaagtaacttttaaacctgatgctaatattttttcaacaacaaaatataattttaatactttagcagaaagattaagagaatctgctttcttattaaagggtgtaaagaattctttaacagatgaaagaaccgacccatatactgaagaagaattcttatatgcggaaggaattaaagaattcgtagaatatttaaatgaagataaagatgtattaggtcctgtcatgtactttgaaggtaaaaaagatggtatcgaagttgaagttgcaggccaatataatgatggatattctgaaactataatgtcatttgttaataatgttcgtactaaagatggtgggacacacgaagctggaatgaaagctgcatggactaaggcttttaatgagtatgctagaaaaattaaccttcttaaagacaaagataagaatcttgaaggtagtgatgttcgtgaaggtctttcagcagttgtttctgttcgtattcctgaagaattactacagtttgaaggacaaactaaaggaaaattaggaactcctgaagctcgtcaaattgttgatagtgttgttaatgagcaattaggttatttcttaatggaaaatggtgattttgcccaagagttagttcgaaaatctattaaggcacgcgaagcacgtgaagcagctcgtaaagcacgtgatgaaagtagaaatggcaaaaagagacgtaaaagcgaacgcctattatcgggtaagttaacccctgcgcaatctaagaatgctaaacgtaatgaattgttcctagtcgaaggtgattctgctggtggttcagcaaaacaaggaagagatagaaaattccaagcaatcctaccattacgaggaaaagtattaaatacacaaaaggccaaattacaagatatcatgaagaatgaagaaatcaataccatgatctatactattggtgccggagtaggtgcagaatttaacatcgatgatgcaaattatgataaagtcattatcatgactgatgctgatactgatggtgcacatatccagacattattattaacattcttctacaagtatatgcgaccaatgattaatgcagggagagtatacatcgcattaccaccattatataagattgaaaaaactgttaagaaaaagcgcgttattaagtatgcatggactgatgctgaattagaaagtgctactaaagaactaaaaaaaggatacactttacaaagatataaagggttaggagaaatgaacgctgatcagctttgggaaacaactatgaatccggaaacaagaacgttagttcgtgtgagaatagatgatgatacaatagctgaaaaacgtgttacaactctaatgggtgataaagtagagcctcgtcgtaagtggattgaaaaaaatgttaaatttactttagaagaagatggaagcttgttagatacagttgtcgctgaaggagctcatggcgaaatttctgacgataagttaaaggatacagaggctttatttgataaaaatgattattaa

SEQ ID NO: 971 - DNA, 519 bp, Unknownn
  isolated from dental, unidentified
atgactaaatatactcaaaaattcaaattagatcttattcaagaatacctagatactggctgttcacaacgatgtctagaaaataagtattctttaccaaaggataccttaaaaaaatggtggactgtatacaatttaaaaggacccgaagggttgaaattacgacatttcaaacgtaaatttaatgttgattttaaacttcgtgtgataaactactacctaaataatgatatttcaatgtccaaagtggcggcttcccataatcttttgtgttcacagatatctatctggttgaagttgtttatggaagatggatctgaggccttgaaacccaagaagaaaggtaggccaagtaagatgtcaaaaatgacaaagaaggatgcacgtaaaattttaaaaaaggaaagtgatgaaattgcggcactaaagagtgaattacgtcaagtcaaaatggagcgtgatatcttaaaaaaatcgttgaccctgttcggaccctcaaagacaaggagaaaacaataa

SEQ ID NO: 972 - DNA, 1023 bp, Unknownn
  isolated from dental, unidentified
atgactatatttaaaaaacgtgcattttggctcgctgctcttcttacttttatttgttctgtcctaggtagttttttagcaaaacttccttaccttagtttaattggagctttagttctttcattattgttaggaattgcattccaatcatttcctcaaactattaataaagcttcctctggaataggttttatttctaataaatttctccgtttagggattatcctattaggattcaaacttaatctcataactttagctaatgcaggaataaaaaccattattctttcaattattgtcgtaagtggtatgattactctcacttattacctctgtaaaaaatttggtgctgaatctgaattggctatcctaactgcgtgtggttgtggaatttgtggtgcagctgctgtaatgggtgtttcccctcaaatagaaactactaatgaagaaagaaaacgtgaaaatgaagttttagctgttgcagttgtctgcgtaatgggtaccgtatttactttgattgaaatttttctaaaaccatttatcggattagatgccagccaatttggtattatggcgggtggatcacttcatgaaattgctcatgctgtagctactggtggtgctggcggtgcaatcagtcttcaaaatgcaattattatgaaattatcccgtgtcctacttcttgctcctgtagcacttctaataggtctttggtatcgtaaaaaaatggctgcaaatacccttaatactaaaactactaattctaaattacctatcccttggtttttaggtggtttcatcttaactagcattatcggtacatttgttccattcatcgcaccttatctcgatagccttgttcaaatcgcttatctctttttaggtatggctatggctgcattaggcatgtctgtaaactttaaagttatcttcaagcgtggtaaaagtgtattttcagctgctgcaattagctctactgttttattaatttttatgataattgccgctaaagccttattttaa

SEQ ID NO: 973 - DNA, 1302 bp, Unknownn
  isolated from dental, unidentified
gtgaagacgattagtattattgatgctaaacaccatgttaacgaaaaaataaaaataggtgtatggcttactaataaacgttccagtgggaagattgcttttttacaattgcgtgatggatcagcatatttccaaggagtagttgtgaaaaatgctgttagtgaggaaacatttgctcttgctaaggaagtaaagcaagagactagtttgtatgttacaggtgtcattcatgaagataaacgttcacatttcggatatgaaatcgaaattgaagaaatagaagttgttggtgaaagtaatgaatatcctattacacccaaagaacatggtacagactttttgatggaccatcgccatttatggctacgttctaagaaacaatttgctattatgcaaattcgtaatgaaatgattcgtgcaacttatgaattcttcaacaaagaagggttcattaaattggatgcacctattttgactggtagtgcaccagagggaacaactgaattattccatacagaatattttgatagagatgcatatttatcacaatctggacagttatatgaagaagctggagcaatggcttatggaaaagtattttcatttggtcctactttccgtgctgaaaaatctaagacacgtcgccatttgattgaattttggatgattgaacctgaaatggcattcatgcatcaagaagaaagtctagaaattcaagaacgttatgttgcatatttagtacaaagtgttttagacaactgtcaatatcctctacaaattttaggtagagatacggaagttcttaagagatatacggaattaccatatccacgtatttcttatgatgaagcaattgaattattgcaacaatctggtaaattcccagatgtaaaatggggagaagattttggttctcctgaagaaacatatttagctgaacattttagcaaaccagtttttgttatgaactatccaaaagctattaagccattttacatgaaaccacatccaactcgtgatgatgtagtaatttgtgctgatatgttagcacctgaaggatacggtgaaatcattggtggatctgaacgtgctacagatccaaaatatttggaagaacaaattattaaagctggtctagatgtaaaggattatgaatggtatttagacttgcgtagatatggtagtgttccacattctggttttggtttaggattagaacgtgctgtaacttggattacaggtgaagatcatattcgtgaagcaattccattcccaagattattgaatagaatttacccataa

SEQ ID NO: 974 - DNA, 690 bp, Unknownn
  isolated from dental, unidentified
atgagctactcgaccctattatttgatattgatgataccttattggattttcatgctactgaaaatcgagctctagaattactttttgaaaagcatggtattgaattaactgatactgtaaaagataattatgtaaaatttaatcaaagtctatggaaaaaattagaattgggagaaattagtagacaagaattcatgactaaccgttttactactttctttaaaaaggaatttgatcttaatatcgatggacttagtttgaacagagaatacttagagttcttatcaactggtactgatactattcctggagcaaaagatttactttctactttaaaaaaatctgggcataaattatacgtcgttacaaacggtatagattttgttcaagaacgtcgtttacgcaacaccggattcaattcattttttgatgatatctttatttctcaaaaaattggctatcaaaaaccagatgctagattttttaagagcgtatttaatgagctatctgaattcaatcctgatgacacgcttattgttggtgactcacttacatctgacattcaaggtgggcacaatgctaacatagactctatttggtacaatccaaaattatctcctattgataagaaaattacccctacttatcaagtaaataatttaccggatattttgcaaattgttggttaa

SEQ ID NO: 975 - DNA, 849 bp, Unknownn
  isolated from dental, unidentified
gtgaaaaaaataattttaaagatagtattgattattttacttgtattagtaggatttcaaattacaagtctattacctagtaaaaacaaaccattgagagaagataagttactcaatgatataaattatagtgatacaccaactttattgattccaggttgggcaggaaataagtggacatataatcgtatgatagatacatatcaagatgaaaatgttgcacaaaaaacaatgacaattcatgttagcccaacaggaaaagtaaaagtacatggaactgtaaaaaataagaaaaatgcgatgatacaagttttgtttgattggaattatactgttagttaccgactacaaacaaaatggttaactaatgtaatgctgattttacatgataaatatcatataaataaaatgaatgtaatagcccattcttggggtggtagtgcttggttgcatgccttagctggatctagtaaacttcaaaaagagataaagttttctcgagtaatattattaggtgttccagtagaggagagctttgatgatattagttataaaaaagctaagaaaattcactcaactgatggaaattatcaaaaattagtagcgcaaactaagtatttgagacttagagcgaaaataaagttctataatttcctaggtgagataaaaaatgagaatactgatggttcggtaccacatgtacaatcagaatttcttcagaaaatagtaaatcctaaatgggcctattatagccagatgacttttgaagatacaagtcattcaggtttgcatagcgatgagaaagttttaaaggaaatagaacaaatattgtgggaaaaagaaaaataa

SEQ ID NO: 976 - DNA, 1728 bp, Unknownn
  isolated from dental, unidentified
atgcaggagttttttatttttatatgggaggacaacatggattataaagttaaagttgctcaagttattgaacaagctgttgatggaaaattatcacaagaagatattttagctaagatagaaaaacctaagacacttaatttaggggattatgcatttccagcttttgtattatcaaaagtattacgtaaagcaccacaaatgatagctagtgaattggttgaaaagattgaccaaacaggatttgaaaaggtagaagcagtaggaccatatgtaaatttctttttagacaaaaaagaattcagtaaagatatattatctgaagttttatctgaaggttctgcttatggtaaccaagatttaggtcatggtggaaatgttcctattgacatgtcttcacctaatattgctaagccaatgtcaatgggacatctacgttctacagttatcggtaattctttagcattattacttgaaaaagtaaattataagccaataaaaatagatcatttaggtgactggggaacacaatttggtaaattaattgttgcatataaactatggggaagtgaagaagaagttaaagctgacccaatcaataatttattgaagtattacgttcgtttccatgaagaagatgttaataatcctgaattggatgaagaagcacgtgaatggtttaaaaagttagaagatggtgatgaagaagcacttaaactttggaaatggttccgtgaagaatctctaaagaaatttactgaagtatatgatcgtttaaatattacctttgattcatataatggtgaagcattctataatgataaaatggatgaaattacagacttgcttcaagaaaagggattattaaaagaaagtcaaggggcagaaattgtagatttagaaaaatacgatttaaaccctgctttaattagaaaaacagacggagcaacactatatattactcgtgatttagctgctgcattatatcgttaccgtacatatgattttgtacaatcattatacgtagtaggtcaagaacaaactaaccattttaagcaattgaaagctgtcttaaaagaaatgggatacgattggtcagatgatattcatcatattccatttggattgattacatccggtggtaagaagttatctactcgttctggacgtgtaattttattagaagaagttttagatgatgctgttaaattagctaataagcaaatcgaagaaaagaatccaaaccttgctgacaaggaagaagtagcagaagcagtaggtgtaggtgctgttgtcttccatgatttgaagaatgaaagaattaacagtttcgactttaacttagatgaagttgtccgttttgaaggagaaacaggaccatacgtacaatactcacatgcacgtgctatgagtatattacgtaaagcaggtgatttagaattagattctgataacttagaaattagtgatctagaagcatggcaaacactacgtttattggctgctttccctgaaacagtaaagaaagctgttagtgaatatgaaccttctgttgttgcaaaatatgcaattcatttagcgaaagcatttaataaatactatgcacattctagaattttgaatgatgatgctgaaaagaatgcaagattagcattagtacaaagtgttgctactacattaaaagaatctttacgtttattaggtgtaaaagctcctaatgaaatgtaa

SEQ ID NO: 977 - DNA, 978 bp, Unknownn
  isolated from dental, unidentified
atgtctggacaatattctgatccaaagcttaaaatttttgctttaaattcaaataagcctttagcagaaaaaattgctgaagctgttggggtacctttgggaaaaatctctgttgatcgtttcagtgatggtgaaatccgtatcaacattgaagaaagtattcgtggcgatgaagtatttatcgttcaatcaacatctgctcctgttaatgataatttaatggaactattaattatgattgatgctcttcgtcgtgctagtgcagcaactatcaacgttgtaattccttactatggatatgcacgtcaagatcgtaaggttcgttcacgtgaaccaattacagctaaattagttgcagatatgttagaaaaagctggtgcaactcgtgtagtagctcttgatttacatgctgctcaaattcaaggattctttgacatccctgttgaccacttaatgggtgcaccattattggctgattacttcttaactaatggtttggaaaaagacgcagttgttgtttctcctgaccatggtggtgttacacgtgctagaaaattagcagaattcttgaaagcaccaatcgctattattgataagcgtcgtcctaaggctaatgtagctgaagttatgaacattattggttctgttgatggcaaacgttgtatcttaattgacgatatgattgatacagctggaacaattactttagcagctcaagcattgaaagatgctggtgcagtagaagtatatgtttgtgctacacaccctgtattctcaggtccagccattgaacgtattgaaaaatctccaattaaggaaatggttattacagactctatcaaccttcctgaagacaagaagattgacaaagttgttcaagtttctgtaggtccacttattggtgacgctattaaacgtattcatgaacataagccagttagtccattgttcaagaatcgtttccacaaggaagattaa

SEQ ID NO: 978 - DNA, 837 bp, Unknownn
  isolated from dental, unidentified
atgagtgctaatcctttattgaatccagttccaactaaagacggtcatgtcgtaggatatgtacactctttggaaacttttggagctgttgatggaccaggtatacgttttgtcgcttttatgcaaggttgccatatgaggtgtaagttctgtcacaatccggacacttggaaaacaagggtaggttcacaaatgacgactgaagaagttctaaacaaggcacttccttatcgcagcttttggggcgacaaaggtggaataactttatcaggtggtgaaattctattgcaaatagattttgcactagagttattcaagatgtgcaaggaagaaggtattagcacttgtttggacacttgtggacagccatttacaagaagagaaccttggtttagtaagttcaatgagttaatggactataccgacattttattagttgatatcaagcatattaattcggacgaacataagagattaaccggattcccaaatgataatattttggatatgtgcgaatatctttctagtatagggaaacctgtttggattcgtcatgtccttatcccaggcatcacggataatgatgaatacttgaaacaattgggcgagtatgttaaggaaaatcttcataatgtcgaaaaatttgaagtattaccttatcatacaatgggcgttcataagtatcaggaaatgggtatcagatatcgtcttgaaggtgttgagcctcctacgccagaaagagtaaaaaatgctgaaaaactgctagaagtagatagatatcaaggatataaagattggtatccaggcattaatactttggatcaacaaccaagctag

SEQ ID NO: 979 - DNA, 1341 bp, Unknownn
  isolated from dental, unidentified
gtgagtaaagaatatttaacggtaagtgctctgacaaaatatttgcatactaaatttactcgtgatccttatttaagaagggtatatttaacaggtgaaatatctaattttagacgtagagctacacatcagtactttagtttaaaagatgataatgctgtgataagtgtaatgatgttccaaagtgccttttcaaaaataaagtttgaaccagaggaaggaatgaaagttttggtctctgggagagttgatttatatgaaaaatccggaagatatcaaataattattgatacaatgcaacctgatggagtaggtgcactatatcaagcatatgaacaactggtaaaaaaattacgaatagaaggattatttaatgaagaattaaagaaacctttggttaaataccccaagagaattgctgttattaccagtccatctggtgcagttattagagatattattactacaacgcatagacgctatccaattgcacaactagttttattcccagctgttgttcaaggagatgatgctgctgattctttagttggaagattaaaacaagtaaacgaagaaggaaattttgatacaataattattggtagaggcggaggatcaatagaggatttgtggccttttaatgaagaaaaggttgctagggcaattagtgatagcaagattccagttatatcttctgtaggtcatgaaactgatacaacaattgtagatttagtagcagatgttagagctgctacacctacagcagcagctgaattagcaacacctgtattgagtgaagaaatagtgaagattaagcagtatcgtttaagaataatacaagttctaaaaaataaaatatccaattatcaacagattttagataaagtatgtagttcatatattttgcaacaaccagatagactatatacagggtatgcgcaaaatttagattcattgattaatagaaaaaatcaagcttttaaaaatttagtttatcaaaatgaaaaacaattacagttattagaaagtaatttacaacataataatccaagcattagaattaaagatggaaaaaataatttacaacagttattagaaaaaatgcatctagggatgttaggtgtttttaatgataaaagctataaattagaaaaattaatgtcatctttagatatgttaagtccattgaaagttatgaatagaggatatagttatattttaaaagatggtaaaacagtaaaaaatgttaaatcattacagccaaatgatgatgtaacactttattttgaaaatggtagtgctgaagctagaataacaaaaattagagaggaaaaagaataa

SEQ ID NO: 980 - DNA, 1116 bp, Unknownn
  isolated from dental, unidentified
gtggcaacaatgaaaattttatttgttaacaatggtttagcaggcggtggtgttgagaaattattaaacgatatgttgccactgatcaatgaaagcagaaattactgcgaattactaattttatttgatggtaatgctaaatatttggaatcattgcgaaataatggagttaaggttcagattgttcctaaaaatatctataaaaaaggacattttcaacgaatactatacataatgaactatataaagaataatgattttgacatagttcacgctaatgaatttccattgatatattattgttccattataaaaatgattttaggaaaaaagatgcccaagttggtaatgacagaacataatactgataacaggcgtcgtcatattaagttaagtcgaccattagagaaactaatctatcgaaattatgataaggttatgtcgattagcgataaggtgcaagaggttctgttggattggctacgaccaaatgatagggacaaatacgcagttatctataatggaatagccacagaaaattttaaaaattccaagccatatgaaagaagtgatttggttccagagattagtgggaaagataagttactttgtgtaattggatcgctaactgaacaaaaaaattacttttttatgctagaagttatggaaagcttgcctgataactatcatgtattatgtctgggtgaaggaccattgaaacaaaagattattagtaaaattcagcaaaaagggctacaaaaaagagtgcatttattaggatttagaaaagatgctgctagaattttaaaaacagttgatgttttagttattccatcactttgggaaggatttggcttaattgcggtagaagcgatggctagtcaaactccagttgttgtatcaaacgtacctgggttagctgaagtagttggcgatgcaggaattaagtgttctgtaaataatgtcgatgagttcacacgagcaattaaaaaagtaactaatgataatgaatatgcatgtcaactagctaagttaggtgaaaaacaggttaataaatatgacgtaagaaaaatgactaaagattatttgaacctatataagcaattgttagagtga

SEQ ID NO: 981 - DNA, 1386 bp, Unknownn
  isolated from dental, unidentified
atggctgaaaaatttatttttgaaccatgggatatttcaaaattacaaagtagttatgatgttgtgatcgtaggttctggtagtacaggcttaacagcagctattcaagcacatgaattaggtttgaagccagttgttttagaaaaaatggaaaaattcggtggtaatactaatcgtgcttcttcaggaatgaatgctgctgaaactaacatccaattacatcatggaattgttgataatatggatgacttttataaggaaacttataaaggtggtggaaagttaaatgatccagaattattaaaatatttcactagtcattcagctcttgcaatcgactggctaaaagatcatggaattgaattagacgaactaactttcactggtggtatgagtaaaatgagaactcatcgcccatctagcatggcaccaattggagctttcttgataaagaacctattaaagattgctcaagatgaagaattaccagttttcaataatgtaactgttacaaaagttaacaaagaaaatggtcgagtaaatggtgtgactgtgaaaactagcgaaggtgaaaaagtaattaatgccaaaacagtattattagctacaggtggttttggtgctgctcaagatattatcaagaaatatcgtccagatttagctagctacaagacaactaaccatcccggagctactggagatggaattaagttagctgaagaattaggtgcccaagttgtacaaatgaatttaattcaagtgcatccaactgtacaacaagatacaccacatgccttcttaataggtgaagctgttcgtggtgaaggtggtattttagtaaatggtgaaggacaacgttttgtaaatgaacttaatacaagaaaagttgtttctaacgctattactgctttaccagaacacagtgcatacttgattttcgataaagatattcgcagtcgagtaaaagctattgaattctatgatagtatcggcttggtagaacatggatctgatttaaaagaattagcagaaaagattaatgttcctgcagataaattagaaacaacagttaacaactggaatcaaatggttgctgctggtaaagatactgattttgatcgtaaaacaggaatggaaagaaagattagtgaagctccatactacgctattcatattgcacctgctatccattacacaatgggtggaatccatatcgacagtcgtacaagagttatagatggaaatggtgatataattccaggtctcttagctgctggagaagttgcaggtggtttacacggtaataatcgtatcggtggtaactctattgcagaaacggttattttcggtatacaagctggacgcgaagcatttttagaaaaataa

SEQ ID NO: 982 - DNA, 672 bp, Filifactor alocis
  isolated from dental, Filifactor alocis
atggcatttacaatttacatggttcgtcatggacaaacatttttaaataagtataaccgtctccaaggttggtgcgattccccactaactcctaagggaatggaagatgctcatagtgctggacgtcatttagctcatattaactttgatcacgcatatcattcagatacaactcgtgctatgagaacatgtcgttatattcttgaagaaaacattgcatctaatgatattacacctaaagaaattcgcaatttccgtgaacaaagctttggttattttgaaggcaatgactcttcacaagtttggacaatgttaggtgctcaacacggtggctatcgttcatataacgaacttattgcaaactatagcttaggtaaaactcgtgactttttaaatgaaattgatccatttaaagatgcagaaacagatgaacaatactgggctagaatcaatgctggctttgatcatcttcgtcgtcatcgccaagatggtgaaaacattcttcttgttagtcacagtattacaatcagaagcattgtagatcgttttgccccagaattgggagcagctgaacttggacctagaaatggttcagttactaaattaattgtttcaaaagatgatattaaggttgagtattacaaccatcatttagataacgaaacttactaa

SEQ ID NO: 983 - DNA, 1443 bp, Unknownn
  isolated from dental, unidentified
atggaaaagataagtataaagtatttaactaaaaaaagtccgcttttaagcgataagaataaaaaatcagaaaataatttttggtctttacgagggatcacttttagcgtaactgaaggcgaagcgataggtttgattgggaggaatggttctggaaaagccttgttactaaaaatattagcagggctagaagaacctactacaggatttatatcaacaaagtcccatatatatttagcatcaatgacaaattctattaattttcagttaacaggacttgaaaatataaaaaaacaagtagaccaagcatacgatgatgaaattgaagctgatcatgtagttaaggcgattattgattttactgaaatcgggcaatgggtatatcgaccagtatcagaatactcaacaggaatgttgtctagactagcattatcgatagctttatttaacaaacctgaagtagttttgttggatgaagtatttgcatcgttagaaagagcattctttgaaaaagttattcgaaaaattcaagatttaaaagatcatggagtatcttttattattacagctactactggtttagtattagaaaccctatgtgaacgttcaatgtggttagactttggtgaagtaaaagaattaggtcctactcaaattgtaatgagtaaattccagtatcaaaatgattggtataatggtctaacattacctgaaaaaaataaatacttaaaagaaaaacaaatagaacaagagaattttgatattactaaagtatataatgagttcaaagttgaacaatttgagcatggatatactagacgcgatgaacctagaatgaaaaaagcattttatcacaatcatcgccaagacccagtaatatctgaagcagagaaagaagtaaaaagtaacaatctgaataagaatgttaaaggacataaaaagaaaaaaggtaataagggattagttagagttgtaggtgttgtactagttctaatcttattattaggtgcaggtaaggtgctgcattcacatcatgaaacaaagaacagacaagtggaatctagtaaaaaagttgaagctaagaaacgctatagcaaatcagtatccatctctaaagctgaggaagcaagtaagcagagtaagattgagagttcaaagaaagagcaaagtttagcagaaagtaaacgtgcaagtgaagcatcagcctcaagtgctgccgctgcaagtgaaagtgctagaaaggctagtgagagtgctgccagtgaaagtaaagcttctatgttatcaaactcacaggaagtgacagttaatgatggtgatactttagcaacgttagctagccaatatggaacgacagcacaagctattcaagatttgaatgatatggggacaagtaactcattaacggctgggcaaactattagagttccaaatagtaattag

SEQ ID NO: 984 - DNA, 483 bp, Unknownn
  isolated from dental, unidentified
atgttagaacataagccaaataaattagaaaatgaactatgttttgctgtttacacagctcaaaaattctataatcgtttttatacagaatcattgaaagaatttaagttaacttacccacaatacatcacattattggtattatgggaagaacaacgcccaatgatgatcaaagaattaggtgaacgcttaggcctagatacaggtactttgacaccattattgaaacgtatggaaaaaaatggttgggtaactcgtgaacgtacaggtgaagatggacgtaaggtatttgtttccttaacagactactcagttaaaatggaagcagaaattaaatcacacgtacaagactgttttgaaaatgttgatatgacacaagcagaatataagaagaatgttgagcttgttaaagaaattggggacaagatttacgacaataaccgtgaattagaagaacgccaaagaagaagattacgttcataa

SEQ ID NO: 985 - DNA, 954 bp, Unknownn
  isolated from dental, unidentified
atgaatacagtaaatatgaaaaaattaaagaatttaactcaatataattttactgcaacttttattaaagcagatgtaactgttcgtgaaagaaaatcaagtagcttagaatacatatatccaactgtattgctaaaaaatgtatgtttagtggatactggagaattaatcgctaaatattattggttgggatacgggaaaagtctagctaagcttggaaagctaacatcaggtacgcaattaaattttgaagcaagaccagatattaatgttttagggaacaagaataatggagatattgcatctttaattgcatggccaaagaaatttcaaagactggataaaacatatcaatatcaagctattcctgaaaacgaaaatcaactggtaggatatatactatctaataaaaaacaagaatatagtgagaatgaacaatggtatctggatcaatataagttatggcgagaagaaaatggagatgaattagatactattgtggaagatataccagcaatagatgattatcaagatatagaagtgaaagatatattagatgataaattagaaaaatatgctgctgtaaagtctgatgaattatcagatagtaaaaatagaaaatatgtaataattgatagaaaaacaaagaagattttggatgataataatcatgagggttacttaagagttaaagatgcttataaaagttatgaacatcgcctaatcaatgctaaagaacgttatcgaaaacgtcgtgcattaatctggttattgaatcatgctgattttgataagaaattattggaaatttatgttgaaataactgataaaggccaatgggaaggttatatcagttttgataaaaaattagttgaagatttgttgttacaaggaaatcatactcatttagaatttacttctaaagatttgcttgaagtttggtacaaaggataa

SEQ ID NO: 986 - DNA, 1248 bp, Unknownn
  isolated from dental, unidentified
ttgtcattacttgatatattattatttatcagtattttttcaatttggacaattttagcagttaatgttgtcttgatttttgctggttatatgaattatttaacaatgaaagttcatgataaattaccagcagatgcaccattcgtaacaattatggttcctgcacataatgaaggtattgtaattgttagaacggtaaaatcattgctagcattggactatcctcaagataaatatgaaattattgtaattaatgataattcatctgacaattcagctgaacttttagcacaggtacaaagtaagtatcccaaccgaaatcttaaaattatcaatactgataatataaccgggggaaaaggaaagtctaatgctttaaatattggcttaaaagaagctaagggttctattatcgcagtttatgatgctgataacactcctgaaaaacaggcattacgtattttggtagctgaattattagctgatgataaagctggagcagtaattggaaaattcagaacacgtaataagaatgctagcttattaacacgatttattaatattgagactttgtcatttcaatggatggcacaagcaggtagaaaaaaactatttaatttatgtacaataccaggaactaattttgttattcgtcgtagtttactggagaaaattggtggttgggacgtaaaagccctagctgaagatacagaaataagttttagaacttatataatgggttatcacattaattttcaaccggcagctgttacctgggaacaagagccacaaacttttgtggtttggtttagacaaagaacgagatgggttaaaggtaatatttatgtgattttaaaaaatttgaaattactatttaatcctaagagtaaggctattcgctttgatttgatatactttttatcaatttattttctattaatgacatctttagttatttcagatacagtttttgttttatcagtatctggattagttcatacatcaattaatggttttagtaattggttatggttctttgcggttatcttatttgtattaggaacttttataactattacaacagaaaagggtgagatgacgctccaaaatttattgatcattgttttgatgtatctagtctatagtcaaatgtggttaatagtagccttttatggcatgatcatgtatgttcaagaacaaatttttcataaaaaagctaaatggtataaaacacagaggtatgaatag

SEQ ID NO: 987 - DNA, 993 bp, Unknownn
  isolated from dental, unidentified
atggtagggattatcctagctagtcatggtggctttgccgatggtatttatcaatctggtgaaatgatttttggcaagcaagaaaacgtagcacatgttattttaaagcctgatgaaggtccagatgatgtgcgtgctaagatggaaaaggctattgaatcttttgataatcaagatgaaatccttttcttggttgatctttggggaggaactcctttcaatcaagcaaacaacttggttgaacaacacaaagataagtgggcaattgttgcaggcatgaacttgccaatggttatcgaagcttatgcatcacgtttctctatggagtctgcacatgaaattgctgctcatattattgaaacagctaaagatggtgttaaagtaatgcctgaatcattacaacctaaagaagcacctaaacaagcaacagcttctggtcaaccaactggagctattcctgaaggcactgttatcggtgatggtaagatcaaatatgttttagcacgtattgatacacgtttacttcatggacaagttgctacaggatggactaaagcaatgaatccaaatcgcatcattgttgtatctgacagtgttgctaaagataaattacgtaagaacatgattgctcaagctgccccaagtggtgtacatgctaatactgttccaattaagaagatgattgaagtagctaaagatcctcgttttggtaacacaaaggcaatgcttttatttgaaacacctcaagatgctcttgaagcaattaaaggtggcgttgatatcaaagaaatcaacgttggttcaatggcttatagcgatggcaaggttaacgttaaccaagttcttgctatggatcaaaaggatattgatacatttaatgaactcaagaaattgggcgtaaaatttgatgtccgcaaagttccttctagttctccagaaaatatggataacttattaaagaaggcacaagaccttgtaaatcaaggtaattaa

SEQ ID NO: 988 - DNA, 1950 bp, Unknownn; identical to SEQ ID NO: 202
  isolated from dental, unidentified

SEQ ID NO: 989 - DNA, 1200 bp, Unknownn
  isolated from dental, unidentified
gtgaatatcggaatatttacggatacttactatccgcacgtaaggggtgttgcgacctctatcaaaacgttacgagaacaattagagaaacagggacacacagcatatatttttacgacaactgatcctaatgttgataaaagtatttatgagcgcaatatttttcgcttttcaagtattccattcatctcatttacagatagacgtattgctgtaaggggactttttcatgcttatcaagtagctaaagaattaaatttagatattattcacacccaaacagaattttcgatgggattaattgggaaatttgttgctaaaaatttgaaaattccatgcatacatacttatcatacaatgtatgaggactatctacattatgtggctaaaggaagattattaaagccttatcacgttaagcaaatgtctaaatctttttgttaccacatgtcgggaatagtagcacctagtttaagagttaaagagacattagaacgatatggaattgatgaacctattgaaataattccaactggagtagatatctctaaattttctaaaagtacgaatgaaaatattagggaaaaatataaaataaatccagagcaacctttactactgactttgagtagattggcttttgaaaaaaatatagataagttactaaatgctatgccggatattttagctagagttccagaaactaaattgatgatttgtggcgatggacctgctagagagagtttggtacaacaggtatctgatatgaatttgattgatagcgttatttttactggagaaattaataatgatgaagtaggtggctactataaggctgctgatgttttcgtttcaacttcagtatcagaatcacaaggattgacttatatagaagcaattgcttcaggtacaaaagtaattactactcacagtccatatacagattcaattttgacagatgcaagtataggtatgacctttacaggcgaagatgaattggttaacaaggttgttgattacttattgaatggtgaaaaatataatgattctaaaccgagagaagaattgttgaatagtatttctgcagataattttgggagaaaagttgtttctttttatgaaaaatgtatgctagattttgatatgaaaaagaaattaagatttaattctgatgagctgaacaaagcgaaaggaagataa

SEQ ID NO: 990 - DNA, 1533 bp, Unknownn
  isolated from dental, unidentified
atggcattagaaataaccccagctttatctttattggatgaacaccacctcttaaaagaagtggttaacgaacaaaaattgacttttgaaaatgtaacttatgattcaagaaaagtgtcagataatactttgtttttctgtaaaggtaattttaaacctagttatttaacttcagctttggaaaaaggtgcaacagcctatgtttctgaacaaaagtatgctgaaggaatggatgcgacaggtattattgtaactaacgtacaaaaagcgatggcactattaggtgcagcattctatggttttcctcaaaatgagttatttattattgcttatacaggaacaaaaggaaagactacttcagcttattttgcggagcatattctagcaaaagcaacagataaaaaagtagctcttttttcaactattgatagagtgttgggaaatgaacctgatcaaagatttaaatcagatttaacaactccagaatcacttgatttattccatgatatgagagctgcagttaataatggtatgactcatttggtaatggaagtttcatcacaggcatacaagaagaatcgtgtgtatggacttacatttgatgtgggggtattcttaaatatctcaccagatcatattggtagaaatgaacatccaacatttgatgattatcttcattgtaaggaacaactcttagtaaattctaagcgttgtgtgattaatggagaaacagcttatttgagagatgtttactatactgcaaaagcaacaacagaaccagaagatatatatgtttttgcacgcaagggtgctcaaatttctgacaacattccagtagatattgaatatcaaaatgattttgaagatttgcataaaagtgtaattgaggttaagggacttagtgataaggctcaaaccttacatgttgatggaaagtatgaattaagtgtgccaggcgattataacgaaggaaatgctactagtgcgattatcgctactttacttgcaggtgctaaaggtgaagatgcacgcaagacacttgatagagtacatattcctggtagaatggaaattattaaaacaaaaaataatggtacaatctatgttgattatgctcataattatgctagtttaaaagctttatttgcctttttaaaacaacaaactcatgccggtcgagtaattgctgttttgggttctcctggagataagggtatttctcgtcgtccaggtttcggaaaagcagttagtgaagaagtggatcatgtgattttgacaacggatgatccaggctttgaagatccaatgaagattgctcaagaaattgatagttatatcaaccatgataatgtaaaagtagagtttgaactagacagagaaatggcaattgagaaagccattaaaatgagtactaataacgatatagtagtattagcaggtaaaggagaagatccttatcaaaagataaagggtgtcgatgtaccttatccatcagatgttaatgtagcaaagaaaattgtggaggaattataa

SEQ ID NO: 991 - DNA, 1086 bp, Unknownn
  isolated from dental, unidentified
atgaaaaagttactagcactaatatcaggaattattgtaattattgtatgtttatccttaggtgttatgagacttaatcgtacagaaaacacacaaacgaatagcagtagtaagaaagtgttaaatatctacaattggggagattacattgatccacaattgataaagaagtttgagaaacagacaggatataaggttaattacgaaactttcgattctaatgaagcaatgtttactaagattaagcaaggtggaacaccatatgatattgctgttccaagtgattatatgattcaaaaaatggcaaaggaaaaattgctattgccattagataaacacaagataaaaggaatggataacaatgatccacaattcttagatttaagttttgataagcataataaatattctgtaccttatttctggggaacactgggaattgtatataacgataagtatataaaaccaggtgaaataactaattggaatgacttgtggaattctaagtaccgtaagcaaattttgtttattgatggtgctagagagtttataggaattgggctaaatagtttaggatattctttaaactctaagaatgattctcagattaatcaggcatacgataagttaaagaatctaacacctaatgctaaagcttttgtagcagatgaaattaaaacatatatgcaaaacgatgaagcgcctttggcagtaacatattcgggagaagcatcagaaatgttagataataattctcatcttcactatgtaatcccagatgatggaactaacttgtggtttgataatattgttattcctaagacagctaagaatgttaaaggtgcgtatgaattcattaacttcatgttagaaccaaagaatgctgcacaaaatgcagaatatattggttatgctacaccaaatgataaagcagctaaattacttcctaagtctataacttctgataaacaattctatcctactaagaagcagatgagtaaaatggaagtatatgctgatctaggtcaaacatatctagaaaaatataacgatgactttttagaattaaaaatgtatcgacaataa

SEQ ID NO: 992 - DNA, 1284 bp, Unknownn
  isolated from dental, unidentified
atggcgacatctgaaaataaagatatcaaagaattaacaattgctgaattggaaaacatgacgctaaaggaaatttataattacgcaagaatttataaaattccttactatagcaaaatgaataaaaaagaattatctttagcggtaattcgagcacaagcaaataaaaatggtttctacatgaaaggaattttagaaatagttcctaatcaagatggttatggattcttgagacctatcaattatggaccatcacaagaggatatctatatttcagcatcacagattagacgatttggtttaagaaatggtgatgaagttgcagggacagctcgcccacctcgacaaggcgaaaaattttatggaattttacacgttgattctgtaaataataaggatcctgaagaagccaagaaacgcgatcattttccagctttaacgccaatttatccagataaacagatagaattggaaacaattaagggacaattatctacacgtgtgatagatttatttgcaccaattggatttggtcaacgtggtttaattgttgcgccacctaaagctggaaagactagtttgttaaaagcaattgccaaaggaatttctgcaaattacccagatgcgaaattgttattattactaattgatgaacgtccagaagaagttacagatttagaaagaacagttaacggtgaagttgtttactcaacttttgaccaacgtcctgaaaatcacgtacgagtagctgaattgttactagaaagagcgatgagattagtcgaagataaacaagatgtaattattttgttagattctttaactcgtttagctagagcttataatttagttgttccaccaagtggacgaacattatctggtggtattgatccggcagccttatataagccgaagaaattctttggagcagcacgtaatattgaagaaggcggaagtttgacgatcttagcgactgcattagtagatactggttctcgtatggatgatgttatctatgaagaatttaagggaactggtaaccaagaacttcacttatcacgtgaattggcagaaagaagagtctttcctgcagttgatataaagcgttcaggaacaagaaaagaagaattattattatcacaagagaaattggatgcattatggaaattgcgtaaaaacttgagtaatgatttagtttctgacactgaacaggtgctacaacttttacgtaattcgcaagataatactgaattttgtggtaaaattgaaaaaatgatgaaataa

SEQ ID NO: 993 - DNA, 945 bp, Selenomonas sputigena
  isolated from dental, Selenomonas sputigena
atgatcgaatttgaaaaaccaaaaattcataaaattgaagaagataataactacggcaagtttgttatagaaccgcttgaacgtggttatggtacaactttaggtaactctttacgtcgtatcttactttcttcattaccaggtgctgctattacagacgttcaaattgatggtgttcttcatgaattttctactattccaggcgttcttgaagacgttactttaatcattttgaatttgaagaaagttgctttaagtatggaatctgaagacagtcaagcattagaaattaatgttactggtccgatggaagtgactgctggagatatccagagtaatagtgatgtagaagttcttaatccagaacaatatatttgtacagttgctgatggggctgaacttcatgttcggatgaatgctaataagggtcgtggttatgtttcagctaatgataataaggctcttgcagatgatatgccaattggtgtattacctatcgactctatttataccccgatcgaacgcgttaactaccaagtagagaaaacacgtgttggtcaaaaaaatgattatgacaaattaactcttgatgtgtggacaaatggttctatcactcctagtgaagctattagtctttctgctaagattttgacagaacacttggcattatttgttgatttaacagatgaagctaagaatgctgaaatcatggtagaaaaagaagaaacgcataaagaaaaaatgttagaaatgacgattgaagagcttgatttgtcagttcgttcatataactgtctaaaacgtgcaggtatcaatacagttcaagaattaactaataagtctgaagctgacatgatgaaagtacgtaacttaggacgtaaatccttagacgaagttaaggctaaattggcagatcttggcttgtctttacgtcatgatgactag

SEQ ID NO: 994 - DNA, 1278 bp, Unknownn
  isolated from dental, unidentified
atgaagaagatgagtgatttagagtatcattatggattgaaaatgcgtatttatccaagcactaaccaaaagaagattatcaaaatcaatgggaacattgctagaactgtttataataaaatggttgctattgaccaagaattatataagttgaaacaagttaagttacctattgatagtgttaaagaacgtattaaagaattaaaaagtcgtaaaaacgctagaaatttgtctaatcattatcagtacatgcaagataagaatattgatagtttagctaaagctaacgctattcaaaattatcaaaaagcgtggaagatgtttagaaaagtacattcatctggtacacctaagttccataaaaagagttaccgtttgagttatcaaactaatgctcaatatggtaaggatgctaaaatggacgtttattctgctagcgtagaatttcttgataagaatcatattagtttgcctaaattaggtagattaagagtatctggttctcaccgtcgtattattgacaataaagatgatattagaatcggtactgttactgtctctaaagatacagctgatagatactttgtatcaatgcaattaggctctgatacaccatttgtaaaaaaattagcgaaagctaattctcaagttggtgttgatttgaatacagaaaattttttgaccgatagttttggtaaagtggtagctaatccacgttattaccgtactattaaaggtaaactagctaaagctcaaaaagtattatctagaaggcaaagaagagctaaaaaagaaaaacgttctttacatgatagtaaaaattaccaaaaacaaagagttttagtagctaagctccgtgacagagtgcgcaatcaacgtaataactttttgaatcatgttactactgcacttatcaataaccacgatttggtggtagtagaaaatttgagaagtaaaaatatgctcaagaatcacgctttagctatatctatatccgatgtaggctggagaagctttttacagaaattggattataaagctaatttgtataacagaacagttatatcagttaatcctaaaaatacaacacagacttgttatgcttgtggctttataatgggaacaaatggaactgataagttaaatcttaaggatagagaatggacttgtcctaattgtcatgaacaccatattagagattggaatgcagctaaaaatattctagctaaaggattagataagttagaaaaaccaaaaaacttagctaaagctaagtaa

SEQ ID NO: 995 - DNA, 1143 bp, Unknownn
  isolated from dental, unidentified
atgaaaattattggtattatagcagaatataatccatttcataatggtcatctatatcaaatagaaaaagttaaagagatttatccggaatcaatcatcattgttgctatgagtggtaattttctacaaagaggagagcctgcaattgttgataagtgggtaagagcaaaacaagcactgttgaatggtgtagatgtagttgtagagataccgattgctggatgcgtacagcctgccgatagatttgctgagaatggggtacgaatattaaataatatgggatgtgaagaacttttctttggtgctgaacatgctgagtatgattttatgacttatgcacagttagttcaaaatttagatagtactgaattttcaaaaaaaaatatatcttatgctgaagcattccaagaagctgttgcagcaaaaataggacataatatagattcacctaatgatgtcttaggcttggcatatgctaaggcaaatttgaaatttggaaaaaagttaaagttaaatcctatctctagaaatgttgcaggttatcatgataagtctttgtctcctgatagtaatatcgcaagtgctacagcaatcagaaaagttttgttttctaaagatcataatttagttgataagtatcttccttcctaccaagatttaaaggatgaaaaatacatttcttgggatgatttttggccatttctaagatataaactaatatctagtgatattgatgagttagctaatatttacgggatggctgaaggaattcaatatagaatgaaaaagaaagctttagaactaaaggtggaagcgacatttgatgaatggctaaaagctgttaaatcaaaaagattcacatatactaggctaacaagattatcagttgctactttagtaggaatgaaagttaatgatgttagtttgtataataaatttccttatgtgcatttattaggatttacgaaaaatggacagaaagctttgaatataatgaagaaaaatagtgaaataccattactggctaaaatatcccaacaagataaagacgacttttatcatgttgattatagagctgggaaaatttatcaatctcaaaattataaagagcaagatttaaaaagagcaccattgatattttga

SEQ ID NO: 996 - DNA, 609 bp, Unknownn
  isolated from dental, unidentified
atccctccagtggttaaaaccactggtatctcgcccactatgtcaatgaaagttgtagcaatttccggagctgtaattgggaaaaagactctaactgccatgaaatatgtagcagaaaagatgaataaagattttccagaggttgaatttgacttgatagatttgagtgaaaaggatattcaatttagcgatggacgtaattataccgaatatcaaggagatattttagaagttactactaagattatggaagcagatgccctaataattggaacaccgattttccaagcttcaattcctggatcagtgaaaaatatttttgacttactaccagaaaaagccttacgtgacaaagtggtttcaattgtggttactgctggttctgctaagcattatctagtagctgagatgcaacttaagccaatcttgtcatatatgaaggcacaagttttaccagaaattgtctttattgaaggacaagatttgttcagacaagaaatcatcaatgctgatattaatttcaggttggataaattagttgaagatactttgattatggttgaaacttttaaagaactgcgaaagaaacaagaagatgcattattctag

SEQ ID NO: 997 - DNA, 1248 bp, Unknownn
  isolated from dental, unidentified
atgactgtagatttaaataaaatgggacaggctgctagagaagcatctcgacaattagccttgttgggtgaacaaaagaagaatcaagttttagaaacagtagcccaagaattattagcaaaagctgacgaaataatagctgctaacaaagtagatttagaaaatgctactaatatgcctgaaaaatttattgatagattaaagattgataatgatagaattgcagcgatggcagaaggtgtaagacaagttgcgcaattagctgatccaattggtaagattgatgctggttgggttaactatgcaggactccaaattgaaaagaagagagttcctctaggtgttgtagggatgatttttgaagcacgtcctaacgtaactgtcgatgcctcagcattatgctttaagtcaggaaatgcagtaatcttacgtggtggtaaggaagctttacaaacgaatataaaaataactaaagttattcgtcaagctttggaacaagaaggaattaatcctgatgcagtacaagtaattactgaaacatcacatgaattagcaaatgaattcatgcaactaacagattacttggacgtattaattcctcgtggatctgcacgcttaattcaaactgttttgaacacagctaaagttccagttatcgaaactggtgctggtatctgccatgtttatgtagacaaatttgccgacaagaaaatggcagtagaaattacaacaaatgccaaagttcaacgtccatctgtctgcaatgcaattgaaaacttagtaattcaccaagatgttgctcaagaatacttaccagcaattgctgatgaattacaaaagtataatgtagaacttagaggcgatgaaaaagtttgtgaaatcttaggagataaagcaactttagctacagctgaagattgggatacagaatacaatgattacattattgcaatcaagattgtatcttcaattgatgaggcaattgatttcattaatgaacataatactaaacattcagaggcaattatcactgaaaactatacccgttctcaaaaattcttgaacgagatagacgctgcttgtgtctatgttaatgcttcaacacgtttcacagatggttttgaatttggatttggtgcagaaattgggatttcaactcaaaaattacatgcacgtggaccaatgggattagaagccttaacttcaactaaatatgtcattcgtggtaatggacaaataagaaaataa

SEQ ID NO: 998 - DNA, 2319 bp, Unknownn
  isolated from dental, unidentified
atggatagtaatgaaaattctagactttctcgtgtggcaaaacgtcgcgaagaagaaagtcgaaataaccctcgcaagcctaataaaaatagtggcttagtcaaaaagattattttaggcactttaacagcacttttggcactttttgttattggagctacggtatttttcgtttatgctaaaaatgcccctgaactttcagaaaacaaacttacaagtgccggtaattccgttatctacgacgctaatggtgataagataacttcacttggaaatgagaatcgtacttacataaagacggaagacattcctcaacaattgaaggatgctgttgtttccattgaagatagacgtttctataagcatcacggtgttgatcctgttcgtatcgtgtctgctgccctttcaaacgtcactggttcttccgccggtctacaaggtggtagtactttagatcaacagttaatcaagctttctttcttctcaactaagaagtcagatcaaacgctcaagcgtaagtcacaagaagcttggttagcgatgcaattggacaaagaatattccaaggaacaaattttgactttctacgttaacaaagttttcatgggatatggcacttatggtatggaaactgcagccaagtattattatggtaaatcattaaagaatcttgatttagcacaaactgcaatgattgcaggtattcctaacgctccttctacttacaatccatattcgagtcctaaattagctactcaacgtcgtaatgatgttttagatgcaatggtagctaataaaaagatctcacaagctcaagctaatgaagctaagcaagaggatgtaacagatggtcttgtccaaacacatgaacaagaaagcacaacttcacaaaaagcaaaaatttctgactcctatctaaaagaagtaattgctgaagctaaggaaaaaggctatgatccttattctggaaacttaaagatttacaccaatttagatatggatgcacaaaagaaactttataacatcgttaatactgactactatgtagccttccctaacgatactatgcaagttgcgacaacagttgttgatcctaataatggtaaagttattgctcagattggtggacgtaaaactggcgatgtaacttatggtttaaaccgcgctgttcaaactgaccgctctagtggttcgacagctaagcctgttatggattacgcaccagcaattgaatatctagattgggctacttatcatgctttgaaggataccaagttctactatcctggaacatcaactcaattatatgactttgataatcgctacaaaggtacaattaccatgcgtcaagctttaattgaatctcgaaacgttcctgcgattagagctctacaagcagttggtatgactaaggctaaatcgttcttgagtaatcttggttatgatactaaaggtttgtccttacaaaatggtattggacttccagcatcaacattacaaaatgcggctgcttatgctgcttttgctaacggtggtacttactatgaaccaacttatattgataagatcgaaactgcagacggtcaagtaaatgactactctagttctggtaaacgtgtaatgcaatcctcaactgcttacatgattactgatatgttgaagcaagttatcacttcatctaatggttctggtactgcagctaatatttctggtttataccaagctggtaaaactggtacaactgcttatccatctgatgtcagtggtcaattcccatctgatgcagcaatggattcttggttcgatggatatactaaacattattccatttctgtctgggttggatatgatcaccagtatgaacctggtaattatgttccgaataactctaagctggcacaacagatttataaagtgttgatgacttacctatcccaaggagtttcaaatactgactggactaaaccaagcaatgtttactctagaacaattaatggtcaacgcgaactttacctagctggttcagctgctcctacaatcactggtaaaggaagttcttcaggaatcaatgaatcttcatctagctcttcaagttcttctagtgataaagaatcttccggtagcacttcttctagcgatgaaaagtcttctggtagtgattctagcagtagtgctagcgaaagcagtccttctactgcaagcagtacaccagctaacagtagtgcaacaactactacaggtggtaacaacaatacacaaaacaataacactccagcaacaccagctggaaataatggcggtaaccaagccggacattag

SEQ ID NO: 999 - DNA, 1854 bp, Unknownn
  isolated from dental, unidentified
ttggcgagattaattccagaggcaacgattgaagaattaagaagtaatgtcaatattttagatgttattagtcagtatgtacaattgcataaatccggtaaaaattggtttggaatctgtccttttcattcagaaaagacaccatcattctcggtaaatgaacaaaaacagatttttcattgtttctcttgtcaccgtggtgggaatgtatttaagttcattatggaattagagggattgtcttttcctgaatcagttcaaagagttgctgaattagcaaattatgatttaggaatttctatagataattctgaaaatcaaaatgaaacttctgaaaatggtaaaattaggaaattatataaggaaacaaccaagctatatcaccatattttagttaatacagagttgggagaacctgctttagaatatctgcataaacgtggtattaaggataatttaatcgaagaatttgagataggatttgcccctgaaaataacattttagaagccttttttaaggagcaaaaattatatgattatcagattttacgaaaatcaggtctttttattgaaagacaaagcacagagcttgtagaaagatttaatggtagggtaatgtttcctattcgagatacatctggacaaacgattgcttattcaggaagattgttagagaaaagagatgatgctcctaagtatttgaattctccagaaactgctatttttaataaacgtaaagttttattcaattttgataaagcaaaaggtattattcgacgtgaaaaagaagcaattttatttgaaggttttatggatgtaatagcagcttatcgatctggtgtcaaaaatggaatagcgtcgatgggaacaagtttaactgatgaacaaatccaagctttaaatcggataacttcgcatttggtaatttgttatgatggcgataatgcaggacaaaatgcaacgaaacgtgctttagaaatcattgaaccaactggaaaatttagcttagaagttatcaaaattcctgaaaaactagatcctgatgaatttacaaaaaagtatggtagtgagaagtttgttgaattagctcgaaatgatcgtaaaagtccattagatttttatctaagttattacgaacaagataagaatctaaataatgaaaatgatcaactagaatacattcgtgatattttacaagaaatagcaaaagttagagattctttggaacaagacttatatctgaatcgtttagcacaaaggtttaatgtcgccaaagaaaatttagactcacaacttagacaaattcgtgagaaaatatttgctcaaagagctgaaaagcaagaggaacagagttatcaggctcagcaaatacctaggacagtcatccagaaaaatgaagtacaacatttttcaaaggcagagaaagcagaacgcttattattatatcgaatgttacatgataaaaatgtttggttgagaattaatggtataccagatttcaattttattcatgaaaactatcaagtcatctataatctgagtgaggcatattttgacacacatgacgagtatgaagttgccgatttcttagattttatcaatgaagatggattacgccaagttgtagttacattggagatgggtgactatgctgatgaggtaagcgagcaagaaattaatgattgtttgagtttgataatgagccaaacaccattagaggataaaataaaaaaagttcaaactgaaatgttagaagcaaaacgtcaaaatgacacggcaaaaataaccaagctaacaatggacttgatttctttattaaaagaacaacaaaatgctaagtcattaacaatatag

SEQ ID NO: 1000 - DNA, 2361 bp, Unknownn
  isolated from dental, unidentified
atgaacaaaaaggtattaaaaactttagaatatgataaagttaagcaaaatttatatgcttttactacaacttcaatgggaaagagattgattgacaagttggaaccatcatctgactatgatgaaatttccaattcactagcacagactaaagatggagctgacattttacgaattaagggtggtatacctgttccaaatcttatttccattaaaagttttttgaaaagattagatataggtgggactctcaatagtaaagaattagctgctattggacgagttttgagagctacaaatgaagttaatcgcttttttaaagatttagcagataataaaatcgagttagaagtgttatttgatgatgtagctaaattggaaagtctaccagaaattagtaaaaaattattagtttcaattgaaaatgatggacatgtaactgacgatgcatctacattgttaaagagtattagacaacaaatttcagtaactgaggaaactatacgtgaacgtttaaatgcatatactagaggaactaattctaagtatttgagtaatgcagtggttacaattcgtaatgagagatatgttttaccagttaaacaagaatatcgtagcaagtttggcggtattgtacacgatcaaagttcttcagggcaaacattatttgttgaacctgcagtgattgttgaattgaataatcgcttaagacagcaacaggttgcagaacgtgaagagataaatagaatcttggaagaattgtctaaggagttagcaccttatacacatgaactaaacaataatgccaaaattttgggaatgttggactttattaatgctaaagctaaatatgcacatagtattaaagcaacagaaccaatcttgtcgaaagaaaatgatgtttatctgagacaagtttggcatccattgctaggtatgaaaaaagctgtaaaaaatgacatcatgattggcaaggattatcaggcaattgtaataacaggacctaatacaggtggtaagacaatcaccttaaaaacgttagggttggtacagttgatggggcaatctgggctatatatacctgcttttgaagaaagtagaattggaatatttgacgatatatttgctgatattggtgatgaacagtcaatagaacaaagcttgagtacattttcttcacatatgactaatattgtagaaatattgaaaggtatagatgaaaaatcattagtgttatttgatgaattaggtgcaggaacagaccctcaagaaggtgcagctttggctatcagtattttagatgctgtgggtgctaaaggaagttatgtagttgcgacaactcactatccagagcttaaggcttatggttttgaaagacctaatactattaatgcaagtatggaatttgatgctaatacattacagccaacatatcgcttattaattggaattccaggtcgtagtaatgcttttgacatttctcaaagactgggactagataaaatgattgttatggctgctagacaacttacttcacaagatagtcaagatctaaatgagatgatttcagatttagttgctaaaagacatgatgccgaagaaaaagagattatgtatcgaaaatatttgcgtgaggctgaagaattgcaccatgatttagaaactaacttccatcaatttgaacgtcaaaaagaaaatatgttagaacaagctaaggaaagagctaatcaaattgttgaagaaactaagaaaaaatctgacgaattgatttctgaacttagaaagatgaaaatgtcagctgcttctaacatagaagaaggcagtctaatagatgctcaagggcgagttaatgctttacatcaagaaactaatttgaagaagaataaagtgttacgtaaggctaagcaacaacaagaattacatcctaacgatgatgttatggttaattcatatggtcaaagaggtgttctgttgcgtaaagcaggaaaccatgcttgggaagtacaattgggtattttgaagatgaaaatcgatgaaagcgaccttgaaaaaattaaggttaaagatactcaacctaaacgagcaggggcagtattgaaatcatctagttctagtcatgtttcaccaactttagatttacgtggtgaacgttatgaaaatgcgatggtaaaagttgataggtacattgatgctgccgttttagcaggttataactctgttactattattcatggtaaagggacaggtgcgttgagaacaggtatcattaactatctcaaacaaaataaagcagttaagaattttgagtttgccagtcctaacaatggtgggaatggagcaactgtggtatatttcaagtaa

SEQ ID NO: 1001 - DNA, 1662 bp, Unknownn
  isolated from dental, unidentified
atggtactgacaagttctaataagttaaataaaaatgctgaatttattaattcattaaacgtttttccagttcctgatggtgatacaggaaccaatatgagtttatccctagctagtggatataaatatgtttcagaatcaacatctactaaggtaggagacctaggagtagctttagctaaaggtttgttgatgggtgctagaggtaattcaggtgttattttatctcaaattttccgtggttttagcaagagtatggctaaaaaagaaaatttaacagctcaagatttagcagatgcaattacaagtggagttgagactgcatataaagcagttatgaaaccaactgaaggaactattttaacagttgctcgtaaagctgctgaagctgctagaaatacagtaaaaaatacagataattgtgttgaagttatggaagcaacttatgaagctgctaagcaagcattggcaacaactccagaacttttaccggttttaaaagaagtaggtgtagtggattctggtggtcaagggctgacatttgtatatgaaggtttctatgaagctttatcaggaaatattaccgatgatgagcatgtacctaatgtagaagaaatggacgaaatggtaaatgctgaacatcataagagtgtccaaagtcagttacatacagaggatattaaatacggttactgtactgaaataatggtaaagttaggtgcagggcgcttagtagaccaagaatttaagtacgataaatttagaaatcatttggctgaaattggagactctttactagtaattgcggatgatgaagttgttaaggttcatgtacatactgaacatccaggtaaagttttatcctacggtcaagaattcggttctttaatcaaggttaaagttgacaacatgcgattacaacatgaaactatccttgaaaaagatgaagataataataaagatgatgtagaagctaagaagttagctgatgctagaaagaatgctggtgattatggaatattaacagttgtttctggaaaaggattgaaagacttatttattagtttaggtgcaacagatatcttagatggtggtcaaacaatgaacccaagtacacaagattttgttgatattatctctgctagttcagctaaaaaattcattattttccctaacaacaaaaatatattcttagctgctaagcaagcaactgagttagtagatattcctgttaaagttgtacaatctagatctgtcttggaggggttatcaggaatatttgcattcaatccggatatggatcttgaagataacgtaacagatatggaagaaaatatatcttctgtgaaatctggtcaagtaacgatcgcagttagagatacaactctaaatggtaaggaaattaaaaaggacgattatatgggaattgtggatggagatattacagttactgctagtgattctaaaactgctgcaatttcaatggtagaatcaatgcttgatgatgatagtgaagttgtaactatcatttatggtgaagatggtaatgaagctgaagctaaagaaattgagcaggcaattcttgacatcgatgatgacttagaagtagagattcacgaaggagatcaacctgtttatccttatctaatttctgttgagtaa

SEQ ID NO: 1002 - DNA, 1227 bp, Unknownn
  isolated from dental, unidentified
atgtttgaaaatgaagataataagactcctgcgacatgttctttttgtggaaaaacagaagatcaagttaaaagtatgatttctggaccaggagtgtatatatgtaatgaatgtgtagaattagcacaatcaattattgatacagaaacaaaagcagaagcacaaaaagattttactaatgttcctactcctcatgaaattgttgatactttaaatcaatatgttgttggacaggaagaagctaagaaaacattagcagttgctgtatataatcactacaaacgtgttaatgcttcattatcagatgatgatggaacagaattacaaaagagtaatatttgtcttgttggaccaacaggttctggtaaaacattcttagctcagaatttagctagaattttgaacgtaccatttgcaattgcagatgcaacaactttaacagaagcaggttatgttggtgaagacgttgaaaatattttattgaaacttttacaaaatgctgattatgatgtagaaagagctcaaagaggcattatttatatagatgaaattgataaaattgctaaaaaatctgaaaatgtatcaattacacgtgatgtttctggtgaaggtgtacaacaagcgttacttaagattcttgaaggtacaatagctaatgttcctcctcaaggtggccgtaagcacccacaacaagaatttatacaaattgatactacaaatattttatttattgttggtggagcttttgatggtattgaaacaatggtaaaaaatcgtttaggagacaaaacaataggttttggtgtagattctaagcaggaatatgatcctgataagagtttaatgcaacaaatcattcctgaagacctattaaagtttggattaatccctgaatttattggtcgtttgccaattcttacagcacttgaaaaacttactgaagaagatttagtaagaattttaacagaacctaagaatgcattaattaagcaatatcaaaaattagtatcgtttgatgatgtatcattaagatttgaagatgatgctgttaaggaaattgcgcatttagctattgaaagaaacacaggtgccagaggtttgagatccattgtcgaagctactatgagagatattatgtttgatattcctagcgaagataatattaaagaggtagttattacaaaagatactgttgatggtaagagtaaacctgaaatagtaaaataa

SEQ ID NO: 1003 - DNA, 561 bp, Unknownn
  isolated from dental, unidentified
ttggtattaaaagtagaaaagatttcaactaagtcacaagatttcaagcagataaagagagtttatgaggaagtttttccaaaagttgaacgaattcctttgtggttattgaaaatgagagcgaatgaaggaaaagcagaattttgtagtctttatgatgaaaatgaatgggttggtttcttctatacaattttgacaaagaaattagcatatatcttctttctagcagtagatcctgatagacaaggcgatggttatggtagccaagctcttgaagtaatcaaagaacgttatcaagattatacaatgggattaagttctgagagacctagtccagaagctccaaacaatgagcaaagaattcgccgtcaaagcttttacgaacgtaatggttttacaaaggctggattctatagtatagaaaaaggtggggtaagatacgactttcttagtccacaaggcaaggttaaacctaacttatatgttgatttaatggctgaatttttcaagcaaagacaggcttattatttaccattaagagttgaaaaagatgatgaataa

SEQ ID NO: 1004 - DNA, 888 bp, Unknownn
  isolated from dental, unidentified
atgacagaaggaaattatggggaggtaggcacgatggatggaatagattttttgatagaatttttaaatgattattataaggcaaaattaaaaaatattcatgatattgctggtaatgtccatttatctggatatagtgaattatataaaaaagacttatttgttaagatttttagtaataaagatatgttttacgctgaacaacatgtaaatcaagtatattatcctgagatttatctagatagtgtgatttttgaagataattatgtagtagttcttaaggatagacaattagaggacacggataagaaaaaaatctctaaagaacaagcttatttatatggtaatttattagcagattttcataataaattaacaggaaatgtatctgtttatgaagataaaagttcattaggtgaacaaatagatactttagtaaaaacgctgcaaaacacagaatatatagatgatattaatgctgtaaataaaattattaaagaacgtcttgaaaaagcacaattggagtatgaattattgccgagagtagtgttgcatggtgactttagtattagaaatataaaaaaatatcaagatcaagtaatattaattgattttgaacgttctcgtattggagtagcatatcaagattttgtgaagttcttttttaatgaagtaaaagatttggatttaagaaatgctttcttgaagggctatagagaaaatagaccatttgaaattcctagtgaaactcttcaaagtgtattattatttaaaacagcattagagatattgaattttcatctatcacatcctgagaaaaaatttgggagaatggctgatgatatgttagtagctattagggaagataagggctttttagaattgtaa

SEQ ID NO: 1005 - DNA, 924 bp, Unknownn
  isolated from dental, unidentified
atgaataaaaataaaaaatacatactattaccttcatttctcacaatcgctctattattaagtggttgtgtacaaagaaccaaggatggaaaaccctatggattcatttacgaaaaattagctatacctactcaacatttattggaatggctatccggtgttctaggtggaagctatggctggtcaatcatagttattactttcattgttcgattaattatgatgcctattatgattaatcaatctaaaaaagcaaccattcaacaagaaaaaattgcaatgattagacctcaacttgctaaaattcaagagcagcaaaaaaatgccaagactcctgaagagagaaatgctgctagccaagctatgatgaaactttaccaagaaaataatatttctatggttggtggaattggttgtcttccattacttatacaaatgcctatcttcgctgctttatatgcggcaatacaatattctcctgagttatctaagacaacttttatgggaattaacttaggtcatagaagttttacttttgttgtgctaacatttgttatttatgctttacaaggttggttgtctacattaggactacctgaagaacaaaaaaagcaaatgcaatcaatgattattgtatctccagtaatgctaactggaatgacatacatttcccctgctggtttaggattgtatttctttattggtggtatttttgcttgcattcaaactctaattattaatttcatgcgtcctagaattcgtaaggatattaaaaaagagctgaaaaataaaccaattaaagaagttaccgttgaatcacctgtaaagaagactgatgatgaaaagaaagtaacctcagtttctaaggatatgcatgaaaaaaatcgtaaaagaaacgctggtaagcaaaatcgtaagaaatga

SEQ ID NO: 1006 - DNA, 1035 bp, Unknownn
  isolated from dental, unidentified
atgacagcaaaagaaccattaacaactcttgattgggacaacttgggatttgaatacatggatctcccttatcgttatcgtgcttattggaaagatggcgaatggcataaggcaggtttaactgaagactctacacttgctatgaatgaaggttcaacagctcttcattatggtcaacaagcttttgaaggtatgaaagcttaccgtacaaaagataaccatgtacaattattccgtcctgaccgcaatgctgctcgtttacaagacagttgtcgtcgcttattaatgcctgaagtttcaactgaaatgttcattgaagcatgtaaatcagttgttcgcgcaaatgaagcttatgttccaccatatggcactggcggtactttatacttacgtccattaatcattggggttggacctaacattggtgtacatccagctaaggaatacatctttactgtttttgctatgcctgttggaaattacttcaagggtggtatggttcctactcgtttcttagtttctaactatgatagagctgctcataaaggtactggtgcaagtaaagttggtggtaactacgctgctagtttacttcctggtgacaaagcccataaagaaggtttctccgattgtatttaccttgatccagttgaacataagaagattgaagaagttggttctgcaaacttcttcggtatcacaaaagatggcaagtttgtaactcctaaatcaccatctatcttaccttctgttactaagtactccctcttataccttgctaaagaacgctttggtatggaagttgaagaaggcgacgtttatatcgatgaattggatcactttgcagaagctggtgcatgtggtacagctgctgtaatttctccaattgctggtttccaagttggtgacaagtatcatcaattctacagtgaaacagaagttggacctgtaactaagaaattatacgatgaattaacaggaattcaatttggtgacaagcccgctcctgaaggctgggttgtccgtgttgactaa

SEQ ID NO: 1007 - DNA, 705 bp, Unknownn
  isolated from dental, unidentified
atgaaatattcactaaatttagctcatctatacggtgacttattaaacacttatggtgatatcggaaatatccttgctttacgctattatgctaaacaaatggacaccaatttaaaagttgatattatctccttaaatcaagaatttaatcctgaaaagtatgatattgccttttttggtggtggccaagattacgagcaaatgattgtttcaaaagatattcaatcaaaaaaagaagcattaactaaatatatacatgatggcgggccaatgcttgccatttgtggtgggtatcaattactaggtcaatactatattggggctgacggccaaaaaattgaaggtattcatgccctagatcattatactgaaagtcaagataataaccgtttcatcggagatattgttattagaaacgaagaaactaaccaagaatatcatggctttgaaaatcataatggagtcacatatttaggaaaaaatgagcgacctctaggtactgttgtaagtggacatggaaataatggaaaagacaaaactgaaggtgctatttttaaaaatacgtactgttcttacttccatggacctatcttagctagaaatggtgaattagctaaacgtatattaattactgctttacaaagaaaatatccagatgctgatttatcaaaacaacaagctctagaaatcaaacctacctactaa

SEQ ID NO: 1008 - DNA, 1848 bp, Unknownn
  isolated from dental, unidentified
atgtcaaaaatcattggtattgatttaggtacaacaaactcagctgttgctgtactagaaggtaaagatcctaaaattataacaaatccagaaggtaatagaacaactccatcagttgtatcattcaaaaatggtgaaacacaagttggtgaagtagctaagcgtcaagctattacaaatccaaatacagtatcttctataaagcgtcacatgggagatgcaaactataaggtaaagattgaagacaaggaatatactccacaagaaatttcagcaatgattttacaatacattaaagattatgctgaaagttacttaggtgaagaagtatcacaagctgttattacagttcctgcatactttaacgattcacaacgtcaagcaactaaagacgcaggtaagattgcgggtttgaaagttgaaagaattgttaatgaacctacagctgcagctttagcttatggtcttgataaattagataaagatgaacgtattttagtatttgaccttggtggtggtacttttgacgtttctatccttgaattaggtgatggagtatttgaagttctatcaactaatggtgatacacatcttggtggtgatgattttgataataagatcattgattggttagttgaaaactttaaagctgacaatggaattgatctatctcaagataaaatggctatgcaacgtttgaaagatgctgctgaaaaggctaagaaggacttatctggtacaacagaagcacaaatttcactaccatttattgctgctggtgaagctggtcctttacacttagaaacatcattatcacgtgctaagtttaatgaattaactgaagatttggttgaaagaacaaagattcctgtacgtaacgctttagctgatgcaggattaacaaatgctgatattgatgaagttattttagttggtggttccacacgtattcctgcagttaaggaagctgttaaggctgaaacaggacatactcctaatgaatcagttaacccagatgaagctgttgctttgggtgctgcaattcaaggtggagttattaccggtgatgttaaggatgttgttttattagacgttacacctctatcattaggtattgaaacaatgggtggcgtatttactaagttaattgatcgtaatacaactattccaacatctaagtctcaagtattttctacagcagctgataatcaaccagcagtggatattcacgttcttcaaggtgaacgtccaatggctgcagataataagacgttgggtcgtttccaattaacagatattcctgctgctcctcgtggtgtgccacaaattgaagttaagtttgatattgataaaaatggtattgttaatgtttctgctaaggacttaggaacaaataaagaacaaaagattactattaagagttcatctggtttgtctgatgaagaaattgatcgtatggttaaggaagctaaagaaaatgaagctgctgataagaaacgtaaggaagaagttgacttgcgtaatgaagtagatcaattattattccaaacagacaagactttgaaagaagttaaagataaagtttctgcagatgaagttaagagtgttgaagatgcgcgtgatgctctaaagaaagctcaagaacaaaatgatatcaatgaaatgaaagctaagaaagatgagttaactaagttaattcaagatatgtctgtaaaattgtatcaacaagcacaacaggctcaacaagctagtggtgcacaaggtgatacttcagctaataactctacaaacgatgataatacggttgatggagactttaaagaagtagatcctgatgaaaataagtag

SEQ ID NO: 1009 - DNA, 1311 bp, Unknownn
  isolated from dental, unidentified
atgtctataaagtgggaaaagaaagacggaacaaacgaaggtaaattaacttttgaaattgctccagaaaaaattaaagaaggcttgaattctgctttcaatcgtgtaaagaaatctttaaatgtacctggatttagaaagggtaaagttcctcgccaaatcttcaacaagatgtatggtgaagaagcattatatcaagaagctttaaatgatttattacctgaagcatattcaaatgctgttaaagaagcagatattaatcctgttgatcaaccacaaattgatgttgaatcaatggaatcagatgctgcatgggtattaactgcaaaagttactgttgaacctgaagttgaattaggccaatataaagatttagaagttacaaagcacccaacacgtgttttgaaagctgatattgaaaatgaattgaatagattacaacaacaagaagcagaattagttcttaaagaagatgaaccagcagaacaaggtgacactgttgttatcgattttgaaggtaagatcgatggagaaacttttgatggtggaaaaggtgaaaaccattctcttgaattaggttctggtcaatttattccaggttttgaagatcaattagtaggtcacaaagctggtgaagaagttgctgtaactgtaacattcccagaagattatcaagcaaaagatctagctggtaaagaagctgtttttgatacaaagattcatgaagtaaagacaaaagaattaccagaactagatgatgaatttgcaaaagatgttgatgaagatgttgcaactcttgaagaattaaaggcaaaaattaaagatcgtttgaaagatcaaaaagttgctgaagctaaagctgcaattcaagaagaagcacttgatattgctgtagaaaatgcaacaattggtgaaattccagctgttatgattgaagacgatgtacatcgtcaaatggataacttcttagcaggtatgcaaaaccaaggtattagtgctgatatgtattaccaattaacaggtacgtcagcagatgatttgcacaaacaatttgaagaaggtgctgaaaagcgcgttaagacaaatcttgttcttgaagcaattgttaaggctgaaaagattgaaccatctgaagatgaaatcaatgctgaaattaagagtttagctgaacaatatcaaatggatgaagcagcagttcgttctgctttatctgatgatatgttgaagcatgatattgcagttagaaaagtagttgatgaaattgctgattctgcaaagcaaactcgtgatgctaaaaaggatgaagaataa

SEQ ID NO: 1010 - DNA, 1164 bp, Unknownn
  isolated from dental, unidentified
atggataaaaaggtaattaatgataaatttacagaaatttttggtgaacaagctgaagctacattcttctcaccaggacgtattaatttaattggtgaacatacagactataatggtggtcatgttttcccatgtgcaattagcttaggaacttatggtgctgctcgtaaacgtgaagataataaattacgtttttattccgctaactttgaagatttaggaattatcgaaacatcgcttgatgatttaaagtacgacaaaaaagataattgggtaaattatgctaaagggatgatttatttcttaaaggaaacaggtcatgatgttgataaaggaatggacatctttattgaaggaaatattcctaacggttctggcttatcctcgtccgcttcattagaaatgttaattggtgtaattgcccaagaattatttaacttagatattgatcgtgttgacttagttaagttaggaatggaaacagaaaataaatttattggtgtaaattctggtattatggatcaatttgcagtaggaatgggtaaacaaaaccaagcaatcttattagatactaatactcttgaatattcatatgcaccagtagatatgggaaataacgtaattgttattatgaatacaaacaaacgtcgtgaattagctgattctaagtataatgaacgtcgtagtgaatgtgaaactgcagtaggtgaattacaagctaaattagatattaagactttaggtgaattagatgctcaaacttttgatgaatattcttacttaattgaagatgaaaatcgtttgaagagagcacgccatgctgtatgggaaaatcaacgtacaatgcaagcacaaacagcattagaagaaggtgacctagaaaaatttggtcgcttagtaaatgcatcacatgtttcacttgaacatgattatgaagttacaggaatcgagcttgatacattagcacatactgcttggaaacaagacggtgtacttggagctcgtatgactggtgctggctttggtggctgtggtatcgcaattgttgataaagacaaagttgaagcatttaaagaaaatgtgggtaaggtttatacagaaaagataggttatgctcctgcattctatattgcagaaattgcagatggaacaaaagtactttaa

SEQ ID NO: 1011 - DNA, 1146 bp, Unknownn
  isolated from dental, unidentified
ttgaaaaagtttggtataattatcagtttatgtctatcagctgctttaatggcttcttgtggaaaacttggtggtaattctaatactacaacagcaactacagagtcatctaaaagtggttatcagacaactggtgaaaacaatagtagtgattatcaaggaattattgaagatggagaatataagacaagtaagtctagaggggtagggatttctcaaaattcagataatctattgaatttgaagagttttgaagcaggtctaacaacaatttctaaggatcatttctctactaagagttacattttccaagaaggacaatatttaaataaggctactattcaagattggttagggagaaaatctagttctaatccagaaggtttgaatcctagcgacaatggtaagaaagaagcaaataagcgaaacccaatttatgttcaacaaatagaagaacaagattacatgaagcaaaataatggtaaattggaattagccggtatgacaattgggattggtatgaatcaaaaggattactaccaaaaagaacaatatggtgctacttattcaacaataatttctaaagaaaagagaattgaagaaggtaagatagctgctaagaaagttcttgcacgagttcgtcaaaaagtcggaaacaatgtaccaattgtgattgcgatgtttgctcaagctcctaatgatagtttagtaggtggttatttctactcctatactgtaagtaagagtgggacagatatcggaagttggacagaaacaaacattaagagttacgttcttccagctactgaagataacaaacttcctaatgacaatgattcaacatcatttgataatttccaaaaagaagttaagaatttcttccctaatatttctaatgtaacgggacaaggtcaatataaagataagactttgcaaggtttacacataacaattacaactcaattttatagtgaaaccgagataactagctttactcaatatgtagcacaagctgccaagtcatacttaccaagtggtattccagtagatattaagattaatggtagtgacggcgaaacacaaagttttgtttcaacaacaggtggcaatggcggatattatacccatgtattcggaagttactaa

SEQ ID NO: 1012 - DNA, 891 bp, Unknownn
  isolated from dental, unidentified
atgaaaaagaaatggttagttgccatatctggtattgttttaactttcggtcttgctgcttgttcaaagacagtagctacaacatctggcggaaagattactgaaagtgaatactatagtagtatgaagaaaacttcttctggtaagcaagttcttcaacaaatgatcttaaataaagttcttgaaaaagaatatggttcaaaagtttctgataaaaaagttaatgaacaatataatacttacaaaaaacaatatggttcttcttttgattctgttttagcacaaaatgacatgactaaatctagtttcaaacaagaaattcgttctaacttacttttaaaagaagctgtaaaagataatacaaaaatcactgataaacaattaaaagctcaatggaaagaatatgaacctaaagttacagtagctcatattttagtatccaagaaaagtactgctgaagacatcattaataaattaaaagaagatggaagttacgctaacttcaagaaattagctaagaaatattctactgactcttctactaagaacgatggtggtaaattagctgcctttgacaacacagatacttcattagatagtacttttaagaaggctgcttttggattaaaacaaggttctttcacaactgaacctgtaaaaactgaatatggttaccatgtaatttattctattaagaatcctggtaaaggtaaaatgtcagatcatacttctgaattaaaatcacaaatcattgattctaagatgagtgattctacaactctacaaacagttgtatctaaggttctaaagaagggtaatgtatctattaaagataaagatttacaaaatattttatctagctacttaggtagttcttctagttctaaatag

SEQ ID NO: 1013 - DNA, 858 bp, Unknownn
  isolated from dental, unidentified
atgggtgaaagaattgccgtcttttcagatgtgcatgggaatacgactgcattagaggcagtttatcaagattcaatcaaacaaaaagttgataagtactggtttttaggtgatttattttctcctggaccaggtgctcaggacttatgggatttatttaaacagataaatcctgaaatatgtattcgtggaaattgggatgatttgtttttaaatgctcttagaggagtagttgatactgataggacaagtttagtttatatctctaaattggcacaaacattgtctgaaaggctagacgctaatgaagtaacgtctactataaaaaaatggcctataagggaagaaacaagggttagagatattagggtaggattgacacacaatttacctgatttaaattacggacaggctttgtatcctactgagaaacagcgcaatttcaatgaattgtttgatggaaatcaaaatcttgatttagctatttatgcccatgttcatcacccactaatgagatatagtagcgatgagcaattcgttttaaatcctggatctgtagggcagccgttttttgcatgggataaatttcaaaaagatatgcgtgctgaatatttgattttagaaattgatgaacatggaattcaagaaacgaactttaggaaagtctattatgatagagatttagaatataagcgggctgaattagctaatttaccttatttagacatttataagttacaacttgtgacaggaaaagtacatacacatgatcatgaattgatgaagaagattaatgatgaacgtggttacttaaatgatgtaataaaatttaatgaaaaggtacgaaaaaaaggataa

SEQ ID NO: 1014 - DNA, 2109 bp, Unknownn
  isolated from dental, unidentified
atgaataatacaccttttgataactttaataatatggatgatatttttaatgaattgatgggaagtatgaatggtattaattctgaacgtcgttatttaattaatggtcgtgaagtgacaccagaagaatttgctcaatatcgtaagaccggaaaattaccaaataataatcaaatggcaagtcaaggcaaagctccaaataaagatggaattttagctaaattaggacgtaacttaactcaagaagctcgtgaaggcaagttagatccagttattggacgtaacaaagaaattcaagagactgctgaaattttagcacgtcgtacgaagaacaatcctgttctagtaggggatgctggtgttggtaagacagcagttgttgaaggcttagcacaagcaattgtgaatggcgatgtacctgcttcaattaagaataaagaaattatcagtattgatatctctggcttagaagctggtacacaatatcgtggtagctttgaagaaaatattcaaaacttaattaaggaagttaaagatagaggaaatgtgatcctattctttgatgaaatccaccaaatcttaggtgctggtggtatgggcggtgacaacggctctaaaggtttagctgatattttgaaaccagctttatctagaggtgaaatcacagttattggtgctacaacacaagatgaatatcgtaacacaattatgaagaacgcagctttggcacgtcgattcaatcaagttacggtaaatgctccaagtccagaagatacatttaagattttacaaggtatcagaaacttgtacgaaaagcatcacaatgttgtattgccagataatgttttaaaggctgctgtggactactcaattcaatatataccacaaagaagtttgccagataaagctattgatttgatagatatgacggctgcacatcttgctgcaaagcatcctgttacagatgttaaagaattagaaaatcaaattaaagatgaaaaagaaaagcaacaagcagctgctgacaaggaagattatgaagctgctttaaatgctaagactaagattgaagaattgcaaaagaagattgacaaccattctgaatctcaaaaaataacagccacagtcaatgatgttgctgaagccgtagaacgtttgacaggtattcctgtatccaagatgggtgctagtgatatcgaacgcttaaaggaaatcggcaagagattaaagggcaaagttattggtcaagatgaagctgtaaatgcagtagctcgtgctatccgtcgtaatcgtgctggttttgacgaaggaaatcgcccaatcggtagtttcttattcgttggaccaactggggtcggaaagacagaattagctaagcaattagctttggatatgtttggctctaaagatgcgattattcgcttggatatgtcagaatattccgatagaactgccgtatctaaattgattggtacaacagctggttatgtaggttatgacgacaatagtaacactttgactgaacgtgtacgtcgtaatccatattcaattatcttactagatgaaattgaaaaggctgacccacaagtaatcacattattacttcaagtattagatgatggtcgtttaactgatggtcaaggtaacactattgacttcaagaacacagttattatcgcaacatctaatgctggctttggtaacgaagatttaatgggcaaagacgaaaaagaagacaaggacattatgaagaagatcgctccttacttccgtccagaattcttgaatcgtttcaatgccgtaattgaattttcacatttgactaaggaagatttgaagcaaattgttgatttgatgttaggcgaagtaaacaagactttggctaagaaaggtctcgacttggtagtaactgatgctgctaagaactaccttatcgaacaaggctacgatgaagcaatgggtgctcgtccattacgtcgtgtcattgaacaacaaattcgtgataaagtaacagacttctacttggataatgtagatgtaaaacatttattagctgatatgaaagatggcgaattagtaatcagtgaaaggaaggatgcagataaataa

SEQ ID NO: 1015 - DNA, 597 bp, Unknownn
  isolated from dental, unidentified
atgtatctatttattaacccattaggtagtacatgctaccatactgaacaaaacatattaaaattaggtgattcattgaatgaaaaaattaacttcaattttgttcctttaatgaatttcaaaactattaatgatgttatgtgtcgcatgaatattccactaaataatgttgatatacgtaatagactatctgagaatatttatcattcatctatagattttaaagctgcctcttttcaaggaaagaagaaaggacggaatttcttgctaaatgtgcaacaacttgtagttaatgatcaaaaagattataattttgaaaccattaaattagctgcacaaaaaagtgggttagattgggatatttttgaacaagatagacattctaaattagcaatagaagcttttaaacaagatcaagaattagctaccgaaatgaatgtgactgaacatcctacaattgttgtttatgattgctcagctaataataattctgcgtattctttttctggttgtgaatcattagatgaaataaagaaagtcttactctcacagagacaacaaaatagtagtggaacatctattatgaaactttgttaa

SEQ ID NO: 1016 - DNA, 714 bp, Unknownn
  isolated from dental, unidentified
atgaaaaatttctttacaattattggtggtatgggcacgatggcaactgaaagctatattcatcagttgaatttacgtacaccagctaataatgatcaagaatatttgaattatattttggttaatcatgcaacagttccagatagaacagcctatatcttagataatagtaaaccaaatcctaagattccattattggaagattttaaacaacaagcaagtttaaaaccagatttctttacattgccatgtaacacagcacattatttttatgatgagttacaagctgcagttgatgtaccagtgttgcatatgccacgtctagcagttgaacaaattaagaaagattatcctaatgctaagagagtagggattgtcgcaaccaatggtaccttacatgatggtgtatatgataaagaaatcttagatgctggttatgagttagtaaaaccaacagctgaaattcaagctaagacaatggaattaatttatgatgacattaaagaaaaagattatgttgatggtaaattattctatgaattagttgaagatatggtaaaagatgaaaagtgtgatgcggttattttaggttgtacagagttatcattagctcaagagagagaacctattactgatttaccaattatcgatagtcaatcagtattggtcgataagacgttggaattagcactaaaaacacaaaagaataaatag

SEQ ID NO: 1017 - DNA, 1389 bp, Unknownn
  isolated from dental, unidentified
atgtacggaagaagaaaaatgcgaacgaggcagggcttgtctcgaattcaaattattactttgagttttctactagcgataatgattggtagcttgattttaatgttgcctattatgagtgctaatggagaaagtacagcttttgttgatgcattatttactgcaacaacaagtgtctgtattactggattagtaacagttacgacagcaactcattggtcgagtcttgggcatattgtaattttattgctaattcaacttggaggtttaggaacaataacgctgatgtcgttagctttttttgcgactggtaagcgaatatcgctacaaaatagattgttaatggcggatgcttttaatctagataataataaaggaattgtgaattttgtaattcgagttatcaaagaatcactgatgatagaaggattaggagcaatagcttattctatatatttcataccacactttggttttcttacaggaagttggtattcaatttttcattcagtgtctgctttttgtaatgccggaattgacctattggcagataatagtttaattgcttatgcaggcaattggtggctgaatatcgtaacaatgttacttattgtttgcggaggtctaggttttacagtatggaatgaattaataaagggttttgctaatcagtaccgttactacaaaaatggtaggggaaaaagattaaagaatacattatcacaacacactaagatggttttaacaacaacatttgccttgatatttggtggagcaattctatattacctttttgaaagaagtaatcctaacacattaggtagtgttaaaaatagtcaggcgatgttagaggcactattccaatctgtaactactagaacagctggttttgtaactattcctcaagcaaacttaaccatcccatcagtaatgttgacagtattcttaatgtttattggtggatctccaactggtacagctggtgggattaagacaactacattagcagtaatattggctgaagttagagcgacaataaagagtgagccagaagcaatttgcttcaaacgccaagtgccacgccaaacaactagaaaggcaattgcgattacactaatcagtgttgcagcgagtgttttagcggtgttactaatgtactttatccaacctggagatatgacagataatgtctttgaagtttatagtgctttgggaactgtaggtataagtcgtgatttaaccccacatttaacaacggcagcgaaatatttaatcatagtttgcatgtatttaggtagagtaggaccaatctctattttattggcattaatgagaagaaaacatcatgtaaatcttaagtatgccccgggaaatattcgagtaggttag

SEQ ID NO: 1018 - DNA, 1482 bp, Unknownn
  isolated from dental, unidentified
atgtcgacaatctcgattaaaaatctttctttcgcctataacggtcaagatctactctttgacaatgtttccctatcacttgatagccaatggaaattaggactgcttggacgcaatggtcgcggtaagactacccttttaaatattattcaaggaaagctggattacagtggtaaaattagcgccaatatagattttgaatattttcctcaagcaatcagtgataaagataatctaaccttatacgctattcaagataagtttcacgtggaacaatgggaactggaaaaagaattttcgcaacttcaattggatcctaaagtgttgtggcaacctttcaatacccttagtggtggcgagcaaactaaggtactgctagctctagctttcaaaaataaagacagtttcgttttacttgatgaacctactaatcatctagatgcacatacacgtcaacaagttgctacatatctgaataataagaaacaagggtttattattactagtcatgatcgcgattttctcaatcaagttattgatcatacactcgtaattgaagctcaaaatattcgcttgcaacaaggtgattatgctagatatgaagaacaaaaagcgattgaagataagagcaatctagctcaaaatgaaaaacttaaacgtagtatttcccaacttaaaacttctgctgctcaaaagaagaattgggctcgtagtgctgaacgcgaaaaggagaataactcccacgctgataaaggctttatcactgccaaggccgctagagttatgaaacgttcaactactatgcaaaaacgcatagaatctcaaattaaagataaagaaggcttactgacaaatattgaaactattaccccattgagtatcaactttcaaactagtcaccatcaagatatcttgaatgttgagaaacttactcttacttacccaggatatgatagtttgttcaagccgatttctttcaatctaaaacaaggacaacaagtagttctcaagggtgataatggttcaggaaaatcttcattaatcagggctatcttgaaacaagatgatattaagattattgaaggaaatatttctctagctagcaatctaaaaatcagttacttgcaacaattagaagataataacactgataatctcaagcaattcgctgaacatcatcatctggaatataacgaacttttaaatattctgcataaattaggcgtggaacgtaatacctttactaaccgcatttgtgacttaagtgctggtcaaaagaagaaagtttttcttgcaaaaagcttgctagaaccagctaatttatacctttgggatgaacctttaaactatcttgatactttcaatcaagaccaaattattgagttaatcaagacatatcgccctactatgctgattatcgagcatgatagtcgctttattgatgaaattgatgcagaagttattgaactgcaaaaattatag

SEQ ID NO: 1019 - DNA, 1932 bp, Unknownn
  isolated from dental, unidentified
atgctattagagagtcaaaataaaaaaattattgtcttaggctcatataatagtggggctttaagtgcaatttatacactaagcaaacaaggatataaaccaattctagttgctcctagaattaatgaaagtcagatgtcagagctattagatgaattctatagtatgaaaatgacagctgataatttagcagacatagttactaaaactagaccagatgccattattccgatttttggtgggcaaacaggaataaatgcatgtataaagctagcaaaggatggtttactaagcgctctaaatgtaaaaattttgggaacagatttagcatcattaagtagtatgtttgatagagaaaaatttagtaacttacttaatgaagaaagaattccaacgccaatctctaagaaaataacaaatatagaagaagcaatcgactttgctagtgaatataattatccagtaattgtcagagcttcagcaacgactaataaacctggtggagatttgtgtaacaatagaagagaactaatagttaatgtaaatcgagcatttgaagaatcgccaataagtaattgtctgatagaagcaagtgtaactgggtataaggaattagaattagaggttgtcagggatagttatgataactgtattttggttggggcatttgaaaatattgacgctgttgggatacattcagctgactcaatggtagtagcaccgattcaaacattagatgatcaggaatttcagaaacttcgaactgtttcattgcgattagcaagaatgtttaatatagttggaagttgcaatattcgaatagcgtttgattcattgagagatacgtattacatattagaaatgaatccatcttttaatagatcttcggttctgatctctgcgattacagcatatccattagctgatattattactaaaatttcacttggaatacgcctagatgcaattagaagaactggattttcaaatcttacagctgctagtgaaccaataatggattatttagccgttaaggttccaaattggtccaaaggtcaagctaagaggttagggactagaagacaggcaaagggacaaatagttgctttcggtagatcattggaaagtgcgctaatgaaagctattgagtcaatgactaatgaaagaattgatagtatgctaacccagtttttgaatattgatgattttcaattagaagaaaacttagttcaccctcaagcaaatcgtttattcataattgcagaagcttttagacgtggatatacaattggtgaaattagtgagttaactaagattgatgcgcagttcttatatacaatatacaaattaattgatttcatagaaaatataaaaaatgctgaaccaagtgagaaaagcattcgacaagcaaaggaacttggaatcagtgataaaatgttagctaaattatggaatattcaggtagataaaatagaacaaatacgtaatgatttggcgataagaccgacatataagaagatagatggagtcgcagggacgctagatgctaatgtatcatacttttatgcaacatacgaagaagaggatgagttggaggaaagtaaagcagatattttactaattgatggggttgaaagtttatccaatcgaagctttgccaataatcagcagctattgatattagcaaattctggattagatgtaagtttaatttcaaattctccagatacattggcttttagtctatctttgccaattacaactttctttgaaccgttgtcatatgaagttatagctgaaattacaagaaaatgtaatccagaaactctatgtttgaaaaaaccagaagaattatctgaggacttaaaatctgaattaaacaatttgaatataaaaataacagaatggaattatacaggaggaaaattatga

SEQ ID NO: 1020 - DNA, 423 bp, Unknownn
  isolated from dental, unidentified
gtgctagatataacagaaataaagagaataattccgcatcgctatcccatgttgttaattgacagagtagaagaattgattccaggggaaaaagcagtagctagaagaaatgttactatcaatgaagaattatttaatggacatttccctggtaatccagtgatgccaggggtattaattgtagaagcattggcacaaacaggtgctgttgctctattatctttaccagaatttaaagggaaaacagcatattttggtggaataaaatctgctaaatttagaaaagttgttagacctggtgattcattgcgtttagaagtaactttagagaagattcgaaataatgttggtttaggaaaagctattgcaactgtagatggaaaaaaagcatgtacagctgaactaacgtttatgattggatag

SEQ ID NO: 1021 - DNA, 1080 bp, Unknownn
  isolated from dental, unidentified
atgaaaaaaatagatttaacagggaaaagaattctgataactggcggggctggttttattggtgctaatttgatcttgtctctgctacagacagttaagagtgtaaatattttgacagtcgataacataaatgattattatgatgtttccttaaaagaatggcgccttcaacaaatagagtcagaggctaatcaacatgaagaaagtaaatttgagttcattaagggagatatttctgatgctggattagtaaatcaattctttgctgattttaagcctgatattgtggttaatttagcagctcaagctggagttagaaattcaattactaatccagatgcctacattaagagtaatattattgggttttacaatattttagaagcatgtcgccactcttatgacaatgaaaatggtgtagagcatttagtattcgcctcatcttcgtcaatttatggtaatggtaaagaaataccatataagactgacagtaatactgataagccaatttctttgtatgctgctactaaaaaatctgatgaaatgttagctcatgtatatagtcatctttttggaattccaataacaggattaagattctttacagtttatggaccaggtggaagaccagatatggcatattttaaatttactaagaaattaataaacggcgaaaaaattcagatttttaactatgggaattgtcgtcgcgatttcacttatattgacgatgtggttgaaggtgttaagcgtgtaatgtctggagttccagaaaagtcaaaacaagatttagaacaagcttatcgaatttacaatattggaaatcatcaccctgaaaatttgatgaagtttgtaaaaattttacaagacgaattagtaagggcaaatgttttaccaaaagattatgattttaaaggtcatatggaattagtcccaatgcaaccaggagatgtagctgttacatacgccgatattagtgaattagagaaagattttaactttaaaccagatactaaattaagagtaggtttgagaaaatttgctgaatggtatcgagatttttatgagttagggaagtga

SEQ ID NO: 1022 - DNA, 639 bp, Unknownn
  isolated from dental, unidentified
ttgcgattaagaaataaaccctgggctaagcctttgattgaagaaaatccagattttgtagtaacagaaccaacaaaattaaaaggaaaatggcacacacgttttcaaaataataatccaatttttgtcgaaataggaatgggaaaaggtcgttttattgttgaaatggccaaaaagaatccagaaaagaattacattggattagaattacagacagttgctgtaggaattgccttgaagaaacagttagaagagaaactacctaatcttcagttaatatgtgctaatggtagtggcttaggagaatattttgaaaaaggtgaaattgcaggtatctatttgaatttttctgatccttggcctaagaaacgtcaaactaaaagaagattgacgtacaaaacttttcttgaacaatataaagaggtattagattcagatggacatattgaatttaaaactgataaccaaggattgtttgaatattctttagttagcatgaataattttggaatgaaatttgacggagtttggttggacttacattcatctcctgaggctgaagataatgtaatgacagaatatgaggaaaaatttagtaaaaaagggcaaccaatttttaaattagaagcccatttctaa

SEQ ID NO: 1023 - DNA, 483 bp, Unknownn
  isolated from dental, unidentified
atggaatttaaaaaggtatgtccagaagaaatagatacgatagttagaattgaacaaagcggttttaccccggaagaagcgggaagtaaagctacttttattgaaagaattaagaatttttccgagacgtttttggtagcagttgaagatgataaaattagaggatttatttgtgcaattaggactgacgctcgttatgtagaagattggatgtatgaagcacaagctaagccagatgatagtggtaagtatttaaatgttttatctgttgctgtcgcacctgagtatcgtgggaatcatattggcagtgacttattgataaatttggagaaaattgctaaaaagttaggaatagatggtatttctttgacttgcttagaaagtaaagtgggattttatgagaaaaatggttattcaaacaaagggaaatcatcttctgaacatgctggggaaatttggtacaacatggaaaaggaattataa

SEQ ID NO: 1024 - DNA, 1062 bp, Unknownn
  isolated from dental, unidentified
atgacggatattattacattagaaaatatagatgtcacatttaaacaaggaaagcaaatcgttaatgctgttaagaatgtcaatttaaatgttgaaaagggagatatttttggagtagtaggttattcaggtgctggaaaatccacattagtacgtacaattaatctacttcaaaagccaacttcaggaactgtaaaagtgaatggaacattgttatttgcggataataagcaacaaattagtaacaaagaacttcaaaagcaaagacgaagcataggaatgatatttcaacattttaatcttctaaatgaaacaacagtagtagataacgtagcttttgccttacgtcatagttctttatccgataaagaaattgaagaaaaagctttaaacttattgaaactagtaggattagaagataaagcaaaattttatccgattcaattatctggtggggaacagcaaagagtagcaattgcaagagctttggcaaatgatccggaaatattgatttctgatgaatcaacttctgcgttagatccacgaacgacaaatcagattttagatcttttaaaagaactgaatgcaaaattaggtttgaccatagttttgattacccacgaaatggatgctgtaaaaagaatagctaataaaatagccattatggaacatggagtgatagttgaaaaaggaaaattgcgcgatgtatatcttcgtcctaaagaagaattgagtcgacaatttgtgggaggatcactcgcagctatcgaaaccttgaaggcattcaatttgggtaacctatcacctgatcaaaaattatttcaacttgtcttttctgcagcaaatgttacaaagtcaataattcttgaattgtataaagagttaggattagacgtgtcaatgttgtatgggaatattgaagttttagagagtgaacctgtaggaaccatgtttattttggctaagggagaaccggataaactcgataaggttgcagattatttgaaaaaagaaaatgttgaagtaacaagaattgatgaacgggggatttggaatgactag

SEQ ID NO: 1025 - DNA, 558 bp, Unknownn
  isolated from dental, unidentified
atggtagaagcaattaacttgaaaaaaggtatgatttttgaaatgaacggtaaacttattaaggtgttggaagcaaatcaccacaagcctggtaagggaaatactgttatgcaaatgaaattaaatgatgtgcgaacaggagcaatcgttcaaacaaccatgcgtccttctgaaaaagtagagttagccatagttgataagaaaaatgcccaatacctatatggtgaaggcgaccttgaagtatttatggatatggatacttatgaacaatatgaattaactaaagaacaattagcaaatgaagaaaagtatttaatgccaaatatggaagttcaactagacttttgtaaaaatgaattaattgggattgaattaccaacaactgttgaaatgaaagtaactgaaactgaaccaacaattaagggtgctacagcagctagtggtggtaagccagcaacaatggaaacaggattagtagttacagttccagactttattaatgtaggagatacattagtaataaacactacaacaggtgaatataaagcacgtgcataa

SEQ ID NO: 1026 - DNA, 1479 bp, Unknownn
  isolated from dental, unidentified
atgaaattcatatatcaacaaatgttagcttttttgtctattataattattttgtctggaacgttagcgatggtcttttttcatttaactaaggaaatgacgtatgaaaatgcctggcaacagatgcaaggctatgcttatactttaagaaaagaagctctcaaattgacgacggataaagctgggaagacaataattgtattgaatgtctcacaattaaaagctacagaaaaactattatcagcacaaaacacacattttactatttatacaagtagaacagatgtgttatatcctgacaattcagtcattcgtgagaatagaagtattagtaaggctgattggaaaaagttgacagcaggtaatgttgttaagagaaaacaggactttagaccaagaaaaagtaagagtgaagtagatgggtcggatgttaaaataacggatatttacgccccttgttttgattatcagggaaatttagtagctgttattaaagtaggtgaagacttatctaatatcacacagaacctacaaattataagacgaaatgtagttttgaccgttgcctttgcaattttagtaggagttattttaagtatcataattgctcatttcttaactaaaaaaatagctcgattgagaaatgctacggacctagttgctgcgggaaattttgatgtgcatttagatactaatggtgacagtgaattggataaattaacattggacttcaattcaatggtacaatcattgcgtgaatcaaatgaagaaataaagcgtcaagaagaacgtagacgccaattttttgctgatgcagcacatgaaatgaggacaccgttaactactattaatgggttacttgaaggcttggcatatgatgctattcctgaagaaagtaaagagaaaagtattgaattaatgcgtaatgaaactaaacgtttgataagattagtaaatgaaaatttagactatgaaaaaattagatcaggacaaattgaactttccaaaactgagtttgatgttgttcaagttttaaataacattattaagcaattaagaaataaagctgaacaagtaggagataaatttgaattgtatacacctgataaattaatggtttatgcagattatgataggttagttcaaattatttttaatattacacaaaatgcgatacaatttacagaaaatggtgtaattagcatctctgctgaaaaaggaaatgaagaaacaattattcgcatctctgataatggaattggtatgaacgaagaacaattaagaaatatttgggaacgatactataaagctgatccttcaagaaaaaataccaagtatggcgaatctggactaggattatctattgttcatcaattaatgcaattacaccaaggaagcgttactgttgaaagtaaggaagggaaggggacaacctttactttacgctttccaaataaaaataagttaagtaaaatttag

SEQ ID NO: 1027 - DNA, 3582 bp, Unknownn
  isolated from dental, unidentified
atgagtttaggatttattttaggtgatgctactaaaaatcatcgtcaagtattgctagagcaaataactaactggcaagcagaagatccacaagccaagatttactacatagttcctaaccataataaatttagtgctgaagtaaaagtattagactatttaaaaagccagcaagataatcaagacttgtttgcgacaagtaacgtacagactttctcatttacacgtttagcttggtattttatgaaagatacggctacatatcaagttaatagaataactaatgctggcttgaatatgattgtttatcgtagtttgcaggaacatagtgatgaattgacaatttttaagggtgaacagacccaaccgggctttatcgctcaattggtatcacaattgatagaactacaacaatcttgcattacatacgatgatatagaaagaatgaaagaaaacttaagtcaacaagatacagctgatagtgcagagttggaagccaaattacatgatatagcgattatctatcgtgattttatgcagatgacagacagtaagtatttaaaacctgctgatattttgccaagtttgactcagtacttacaaaatgaagatctaagcaatagttattttattatcgaaggattttcacaattcacagctcaagaacaagctataatttcagttttgcttcaacgagctaaagaagtgagaattgatttgattttgaatcgtggagtgactgatattgaagatttaagtgataagcagtcattattttaccgatctgagagaacttactatttactttatcaacaggctagaaaagcacaagtcaaaattctgaatgatgtttatccacaggaattacgtgtggaaacccttgaattacaatccttagctaagtattggaaagaatccacagatttgaaaccaattaatgttgaaaaaattggggataatcataatttacaagtcataaaagctgatacaagaatgacggaaataaaggaaatagccacaagaataaagcaaatggtcgctttgaaagactatcgttatgcagattttttgctattaacaccggatttgaataagtatcgaaatatcattgaacctatttttaatgactataaggttccaatctttgtggatttagctaagaagatgattgatcatccacttgtggaattgttgacagccttattcaacgtcaaagcacatcactatcgttatgtggatatgatgcgacttttaaaaaccgaattgttaattcccaaaaccgaatatggttatttggaaattaaacaatttagacaagatctagatctaactgaaaacttgatcttgaaattcggtttagaaggaagtcaatggttgcgtaaagatgattgggtatactatcgctttggaagctccgactttggtactcagactgatgtccaagagaaaataaccaagcaagttaacgttattcgtcattacattaaggaaattttaccgccatttttcaagcaattggataaagctgaaaatggtaaagaagccgcacaaattttgatgaatttcttaattaccaatggtgttccagaacagttgattaattggagaaacaaagcactagaacaaggtgatatggtgatggcagattgtcctgaacaagtgtggaacctattttgtgcattaatggatgaatatgtagatactttaggagatctatcatttaaggaagaagatttcttgaacttactacaaacaggatttgaaggagctacttatcgccaagttccatcaacacttgatcaagttattatttctgaaacaactgcgacacaaatgaatgatagaaaagtaacatttatctttggtgctacggacttagtaatgccaaatcgtattcaaaatacaatgttactgacagatatggatagagaattagttcaaggaacactagatgatgagaaatatttatctgacactgccgaaggacgaatggcagcagaaccatttatgaactatttagcatttatgacacctagggaaagattgtacttctcttatccagttgctggagtcaatgaagatggattaagaatgtctccatacgtaaatcgcatcatgaaacaatttgatttaccactgtatgaagctaatagtgaaccaacattggaagataaaaaagtcttgaaatttgtggcaactaaacggacggctttgagcaatttaattggagtagctcgtcaagctaaagggcaaaagcaacctttacctgtaatgtggagatatgtctatcagaagttacaagaagatgctacttatcgtagacttacgcgtaaattgatggcagggatcgaatatagtaacattcctgaaagattaaagacagaatacgcagaaaaattatatggtaagactttgaatacctctgtatctaaatttgaggaattcttcaaaaatcactatgcctttttcttaaagtatggattgaaattaaaagaacgtgacgtgtttgaattatcaccagctaatacaggtgaattctatcatatggccttagataaactattgaagactcttaaacaagataaagtctcaattgctgatataaataagcctcagcttgacgcatatcttcaacaagttctaggtggcatggaacaattgccacaatttcaaattttacaaagttcgaacagaatgcaatttatcttgaagcaacttggagctactgtaagtcagatgggatgggctttacataaccaaggccaaagaacgaaaatgcgtcctttagaaactgaagtattgtttggacacgtaggaactgaaaatggtttgaaggctttgacttatgatttaggtaatggtcataaggttaatgttcgtggaaagattgaccgaattgatcagatgattatagacaaccaacgttatttaggaattgttgattataaatcaagtagtcataagtttaactatcaagatgcctactatggactggcattacaaatgttgacatatttaaatgctatgctacaaaatacagatttattgcttgatttaaatgccggagaagagattaaaccggctggggcagtttatatgcacttgcaaaatccagttatcaagcaaaaggatattttgaaaaatccatatagcgaagtattgttgaaacaaaataaatacgatggcttagttttagatgatcaagaattattaagtaatttagatacatcaattgaaaaagctggtaattctatcgtatatcctgttagaaaatatgcagatggtcattttggaggggttaagaatagcggtaatgtaatcacatttgataatttaatgttactcctaaaacgaaatgaagaactaattcaagaagctgcaaaacttatctttgctggtgatgtggcattaaatccagttctatggccagatagacgatcagcattacaatattcaccatataaggcgattatgcaatttgatgaacttttaggaaatcaatattatcgtttaccaaaagaaaataccgctgatattctccaaaaattagcacaagaaaattcagcagaaagtgaggtttaa

SEQ ID NO: 1028 - DNA, 1146 bp, Unknownn
  isolated from dental, unidentified
atggcagcagaaccagcaattaaatatcgtttgataaaaaaagaaaagcatacaggggctagattaggagaaattataactcctcatggaacttttccaacgccaatgtttatgcctgtaggaacacaagcttcagtaaaatcaattgcaccggaagaattagatgcaatgggtgctaacattattttatctaacacatatcatttatggttgagaccaggtgaagatttggttgaagaagctggtggcttacataaatttatgaattggaacaaaggtattttaactgattcaggtggtttccaagtattttctttagctgatttgagaaacattaaagaagaaggggtatatttccgcaatcatttaaatgggcaaaaactcttcttatcaccagaaaaagctattaatattgaaaatgctttaggagcggatatcatcatgagttttgatgaatgtccacctttctttgaaagctacgattatataaagaaatctgttgagcgtacaagtcgttgggctgaacgtggtttgaaagctcataagtatcctgaccgccaaggattgtttggaattgttcaaggtgggggacataaagatttacgtcaacaaagtgcaagagatttagtatcattagattttccaggctattcaattggtggattatcagttggtgaatcaaaagcagaaatgaataatgttctagaatttacaacaccattattgccagaaaataaaccacgttatttaatgggtgttggttcacctgatgccttaattgacggggtaattcgtggagttgatatgtttgactgcgtattaccaaccagaattgctcgtaacggtacatgtatgacatcacatggacgtctagttgtgaaaaatgctaagtatgcacgtgactttactccaatagatgataattgtaactgctacacatgtcgtaacttcactagagcttatgtccgtcatttattaaaagcagatgaaacatttggattacgcttaacaagctaccataacttgtatttcttaattaatttaatgaagcaagttagagaagctattatgaatgacaatttattagaatttagagaacatttctttgaagaatatggatataatgaaagtaagagaaatttctaa

SEQ ID NO: 1029 - DNA, 891 bp, Unknownn
  isolated from dental, unidentified
atgaaaaatacaaagtttcaaaataatgttgcaatggcgataataaagctaattgctgctatggttgtactaatattagttttattactaggaaaaattctaatctcaggagtaccacatatttcttggaagttcttagtaacaccttcaaaggcatttacagcaggtgggggaattagcgtccaaatatttaattctttctatttattgatattaacgttattaatatcgtttcctatatcattgggtgcaggaatatacttagctaaatacgcagcaaaaaataaaataacatcgctaattagaatggtgatagaaattttaagctcgttaccatcagtagttgttgggctattcgtatttttagtttgcgtggtccaaatgcaaataggattttcaatattagcaggagctattgctttaacgttctttaatttaccactactaacaagaaatatagaagagtctattaaagctgtccctaatctacaattagaaggtggattagcattaggattatctaagtggaaaactatcactaaaataattctgcctgaagctttgccgggaattatcacaggcgttatcttgagtgctgggagagtttttggtgaagcagctgcacttatttatacagcaggtcaaagtgcaccagccgttgattttactaattggaatatttttgatgaaactagtccgttaaacttgatgcgtccagctgagacactagccgttcacatttggaaaattaattcagaaggaattatgccagatgcaaacgcaatttcagcaggaacttcagcagttttaattattgcaattttgatatttaatttatcagctcgatacttaggtaattatttatatcgtaaattaacatcagcgaggtaa

SEQ ID NO: 1030 - DNA, 1923 bp, Clostridium sp
  isolated from dental, Clostridium sp
atgtgtggatttgtcggttatgttaaccaaacagatgtccaagatgatgtaattgaaaagatggctaatcgaattcgtcaccgtggacctgatgatgaagctttctttagagataacaatgtttctatgggatttcgtcgtttatcaattattgacttagctcatggtaaacaacctatgtataaccaagaccaaaccaaagtattaacctttaatggtgaaatttataactataaagaaattagaaaagaacttaaagaattaggatataactttagaacagaagttgactcagaagttttaatccatggctatgatgcttggggcccagagttgcttcaaaagactcgaggtatgtatgctttcgcaatctataaccaaaaagaaaacgaagtatttttagctcgtgatcattttggaattaaaccattgtactactatgatgatggtgaaacattcttatgggcttctgaaatcaaagctttcttagatcatccaaacttcaagaaggaattcaataaggaactactacctattcatttgagttttgaatttattccttccaaggaaacaatgtttaaacatgtttataaagttatgccaggtcaatatgtaattcataagaatggcaagactgaagtacatcaatattataaatttaattatgataagattgacaactcacaaacagtagaaagcgatgctagtcaaattcgtaaattagtacgtgaatctgttgatgcgcatatggttgcggacgttgaagtaggtagtttcttatctagtggtgttgactcaagttatgtatttaatgaagcaacaaaaattaagaaacaacatattcaatcatttacattaggatatgatcgttctaaatatagcgaaattgactgggcacatgattttgctgaagggattggtcaaaagaatacaccaatcaagattgatgcagatgattattttggtattttaccaacaatcatgtattacatggatgaaccattatctaatccatctgctatgcaattatacttcttatcaaaaggtacacgtgaacacgttaaggttgctttatctggtgaaggtgcagatgaattctttggtggatataatacataccttgaagctggtccattcgaacgttatcaaaaatgggtaccaggctttgtacgtaaaggtttagctaaagcagttgaaaacctacctcgtttccatggtcaacgtttcttagttcgtggtgcacaaccattgagtgaacgttactaccgtgtaaactatgtttataactaccatgaacgtgaaaaaatcttaaaagataagagtttaaatattgatacaggtgcatatacaaagcacatctttgatgaagtaaaagataaagatgaaatgacacaaatgcaatactttgatatcaacacttggttaccatttgatatcttacaaaaagctgatcgcatgagtatggcaaactcacttgaagttcgtacaccgttggttgaccgtgaagttgctaaatttgcagctacaatgccaattaagactcgtattcaaggtgatacaactaagatttctttacgtaaagcagcacaagcagaattacctgaaaaagttgctaataaggaaaaattaggtttcccatctccagttgctcaatggatgaaagaacctaagtacaagaagatgatagaagatgccttcacatctgatgttgccaagaaattctttgatattgatgcattacttgaaatcttcaaagaacatttgaatggtaaatcaagtatgcaaaagatttttacaatctatacatttattttgtggtatcaagtatacttccctgaagactgtgaacatgacattagggatcaaattcgttttaacaatgttaaagcacatgcaaatgaacagaattttgcagaagcttaa

SEQ ID NO: 1031 - DNA, 858 bp, Unknownn
  isolated from dental, unidentified
atggcgatcatacaatggtttcctggacatatggcgaaagctttacgtcaggtaaaagaaaacttaaaatctgtagatatcgtacttgaattggtagatgcacgactaccagaatcatcgcgtaatccacaattagctgaagttttacaagataaacctagtattattgtattgactaaaatggatttagctgatccagctgaaacaaaaagatggattaactattatgaaagtatgggacaacctgcaatagctgttaatagtaacagtggcaatttgaagataattgaaaagaagattaaagaaattcttgcagataagcttcaaagcagaaaagaaaagggaattcaaaaccaaaaattacgtgcgatgtgtattgggattcctaatgttggcaagtcaactttattaaatcacctagtaaaaaagaatgttgcacaaactggtaatcgtccaggggttactaaggctcaacaatggcttaaagctggaaaagatttgcaattattagacacaccaggaatattatggcctaaatttgaagatcctttagtagggaaaaaattagcattaactggtgccataaaagatacattatatgcaaaagatgatgttgctttatatgcagtagaacattttatccataccaatccagatgcgcttgctcaaagatatagattaacacaatcagaattagaagatacaactgttgagactttgttagctattacaagaaacatgggatttaaagaagactatgatagagctagcgaaagattaatttttgaaattcgtaaaggtaaattgggcagatatactttggacaagccgccagtagatgctagtccagaaaattag

SEQ ID NO: 1032 - DNA, 1467 bp, Unknownn
  isolated from dental, unidentified
atgaaaaaaacattaccagatgatagttatactttacatactgatttgtatcaattaaatatgattgagacatattggagaaagggtattgatcagaaaaaagcaatcttcgaagttttctttagagatttgccttttgataatggttatgctatttttgctggtttggaacgacttgtttcttatatcaataaattaaaatttactgagacagatttagagtacttacgtgacgaagttggttacaaagatgattttattgattatcttagaaatttcaaatttactgctacaattcgttctgttgttgaaggagaagtcgtttttaacaaagaaccattaattcaagttgagggtcctttggtagattgtcagttagttgagactgctattttaaatatcgtaaattatcaaactttgatagcaactaaagctgctagaattcgttctgtagttggtaatgatgctttaatggaatttggtactagacgtgctcaagaactagatgcagccatttggggaacaagagcagcttatattggtggttttgatgctacaagtaatgtacgtgcaggaaagatttttggtattcctgccagtggtacccatgctcatgcacttgtacaagcatatcgtaatgattatgaagcatttaaagcatatgcaactacacataaagattgtgtattcttagtagatacatatgatacattgaagagtggtgttccaaatgctatcagagtcgctaaagaaatgggcgataagattaatttcttaggtgtaagaatagactctggtgacatggcttatatatctaaacgtgtgcgtgaacaattagatgaagcaggatttaaagatgctaaaatatatgcttcaaatgacttagacgaaaaaacaatcatgaacttgaaaatgcaaggtgctaagattagtgtttggggtgtaggtactaagttaataacagcttatgaccaaccagccttaggtgcggtatataagatggtagccattgaagatgaaaatggtgaaatggaagatactatcaagatttcaagtaatgctagcaaggtttctacacctggtcgcaagcaagtatggagaatcaataaaaaggctgatggaaagtctgaaggggattacgttgctttatggtatgaagatccacgtaatgaagaagaattatacatgttccatcctcaatatacttacattaacaaaaaagtcaaagattttactgcaagacctttattaaaagatatttttgttgatggtgaacaagtatatgacttaccatccttgaatgaaattaaacaatatgcccatgaaagattagatagtttgtgggaagaatatcgtcgagaattgaatccacaagaatatcctgttgatttatctaaagattgttatgataataagatgaagataatccatgatattcatgaaaaaattaatagtggtaaaatttaa

SEQ ID NO: 1033 - DNA, 1218 bp, Unknownn
  isolated from dental, unidentified
atgcaatatacagaaataatggttcgttacggcgaactatctactaaaggtaaaaataggaaaaacttcattgatcgtttaggatttaatgtgcgtgaaagtttgcatagttttgaaaatttggtaatcaaggcacaccgtgatcgtatgcatatccaattacatggagaagattacgaagctgttatgaaacgtttgaagcaagtttttgggatccaaaatttctcaccatctattaaagttgaacgtgatatagagaaagtcaaggttactgcggtagaaatggtgaaagaaaaatttaaagaaggaatgacatttaaaatcaatactcgtcgttctgatcataactatcaatacgatacaaatgagatgaatgatattctaggtagtcatattttacgtgaagttccaggtattaaagtgaagatgaaaaatcctgatatgactttacgttgtgaagttcgtgcggatggtatttatctttcacatgaaaagattgacggtgctggtggtttgcctgttggaactgctggtaaagcaatgttgatgctttctggcggaattgattcaccagtagctggatatttagcaatgaagcgtggagtagatattgaaatggttcatttcttcagtcctccatatacaagtgaacaagctttgaataaagctaaagacttaactgctaaattgacaccatatgttggtaagataagatttattcaagttccatttactgaaattcaagaaacagttaaggaaaaagtgccatcaggatatttaatgacaattcaaagaagattcatgttgcgcttaacagaagcaattgctcaaagaagaaagggattagctatctttaatggtgaagctttaggacaagtagcatctcaaacacttgaaagtatggctgctattaacgatgtaactactatgccaattttacgtccagtagtttcaatggataaaaatgaaattattaaaatagctcaagatattgatacttttgatttgtcaattatgccatttgaagattgctgtacaatttttgcaccaccagctccaaaaactaagccacgtattgataaggcacgttactatgaagaacgtttagacgtagatgctttagttcaacgagcacttgatggtattgaaattacagaaattaagattggcgatactttcttaaaccaagaaaagaaagtttttgctgaattactataa

SEQ ID NO: 1034 - DNA, 804 bp, Unknownn
  isolated from dental, unidentified
ttgaatttaactgagaatagtggtactatactagaggaggttgtgaaagtgcttgcagaagaaagacatagaataattttagaactgttaaaagagcataacgtggttaagttacaggatatctgtgaaagaacacaatgttcagaatcatcaggaagaagagacttgcagttattggaagaacgtggattgttagttcgtgtccatggcggtgctaagatgaagcaacctttgcaacgagaacttgatgtaatgggaaaatctactcaaaatactcaagaaaaagagagtttaggcgcaaaggcagcaagttatattcaagatgatgacgttatttatttagatgctggaacttcaactatagcaatcattccttatttatctgaagatcagcatttaactgttgttacaaatggagttgagcatgcttcattattagccgataagaatattaggactttcttgttaggtggtagattaaaaaatactactaaagcaattattggtgttgaagcagcgaatgatttgaaaagatttagatttaataaagcatttttaggaatcaatggtgtccatgaaaagtatggattgacaaccccagatcctgatgaagctgagattaaaagaaccgcacttgaaagaagtgaaaaaggttatgtaatcgctgataagtctaaatttggttatgtgtcttttgtgaaagttgcagatgttacagatgcaacgattatcacaagtactttacctgctagtgtagctaagcagtatagttcacaggcaacaatacaggaggttatattatga

SEQ ID NO: 1035 - DNA, 1212 bp, Unknownn
  isolated from dental, unidentified
actgacaataaaagcactggatttgttatacttttaatgaaaacatattttgaagagggacggatgttaatgaaaaaaataaaagtaatgacggtttttggaacaagaccagaagcgataaaaatggcaccgttagtattggaattacaaaaacaaagtcagcgttttgaagcaattacaacagtatctgcacaacatcgcgaaatgttagaccaagttttagatatttttcatatcaagcctgactatgatttaaatattatgcatgctagacaaactttaactgatataacttctaatgtactaatcaatctagataaaatcttaaaagaggctaaaccggatattgtattagttcatggggatacaacaactacatttgctgcaagtgtagcagcattttataatcaaatacctattggacatgtggaagctggacttagaacatgggaaaaatattccccatatcctgaagaaatgaatcgccaaatgacagatgcgatgacagacttgtattttgctcctacaactcaaagtaaagctaatttgcttaaagaaaaccataaagaagataatatctatattacaggaaatacagctatagatgcacttaaacaaacagtagataaagggtatcaccatgatattctagataaggtttctcctgataataaattaattttactaacaatgcatcgtcgcgaaaatcagggaggacctatgagacgtgtgtttaaagtgattcgcgaagtagttgaatcaagagaagatgtagaagttatttatccagttcatttaagtccggcagtccaagaagcagcaaaagaaatcttaggaaatacagaaagaatacacttgatttcaccacttgatgttgttgattttcataatttagcagctagaagttactttattatgacagattctggtggtgttcaagaagaagcaccttcattaggtaaaccggtattagtattgagagatacaactgaacgtccagaaggtgtagaagcaggtaccttaaaattagtcggtacagaatctgaaaaagtaaaacaggaaatggaagagttgctagataacgctgctgagtatcaaagaatgtcacaagcaaagaatccatatggcgacggaaaggcatcggaacgaattttagatgcaattgcgtattattttggtgtgacagataaaaagccaatagagtttgaataa

SEQ ID NO: 1036 - DNA, 1101 bp, Unknownn
  isolated from dental, unidentified
atggcattaacagcaggtattgttggcttacctaacgttggtaaatcaacattgtttaacgcaattacaaaagcaggagcagaaatggcaaactatccatttgctacaatcgatcctaatgtagggatggttgaagtaccagatagtcgtttagcaagaattgatgaaattattcctgctaagaagattgtacatacaacttttgaatttactgatattgcgggaatcgtaaaaggtgctagcaaaggtgaaggtttaggaaacaagttcttggaaaatatccgtcaagtagacgcgattgttcatgtggtacgtgcttttgacgatgataatattacacacgtagcaaacaaagttgatcctttggaagatattgatactatcaacatggaattaactttagctgacttggaatctgtaaataaacgttatgctagagtagaaaaagttgctcgtactaaggataaagatgctgtggctgaatttgcagttttacaaaaaattaagccagttcttgaagaaggtaagccagttcgtagtattgaattcaacgatgaagaaaagaagattgttaagggcttattcttattgacttctaagccagtattatacgtggcaaacattgctgaagaagatatggcagatccagaacaaagcgaatactaccaacaagttaagaggttcgcagaagatgaaggttctcaagcattagctgtatctgcaagaactgaagaagaaattgctgaacttcctgatgatgaaaagcaagaattcttagaagctgaaggtgtagaagaatcaggtttagaccgtttaattcgtgcttcttacaagttattgggtctagcaacattcttcactgctggtggtaaagaaacacgtgcatggacatttaagcgtggtatgaaagcacctcaagtggcaggggttattcactctgactttgaacgtggatttattcgtgcagaaactgtttctttcgatgatttagataagtacggcagtatgcaagctgttaaagaagctggtagattacgtcttgaaggtaaagaatatgaagttcaagacggagatattatcgaatttagatttaacgtctaa

SEQ ID NO: 1037 - DNA, 1311 bp, Unknownn
  isolated from dental, unidentified
atggcaaatccagtagtagcaattgttggtagacctaacgttgggaaatcaacaatttttaatcgattagccggggaaagaatttctattgttgaagatacacctggtgttacaagagatagaatttatgctcgcactgaatggttgggacatcctttcaacttaattgatacaggtggtatcgatattggtgatgaaccatttttaactcaaattactgagcaagcagaaatcgcaatcgaagaagctgatgtaattatctttgtagttagtgttaaagaaggagttacagatgcagacgaaaaggttgcaaggattttatatcgtaccgataaaccagtagttctagccgttaataaggtagataatcctgaattaagagctgatatttacgatttttactcacttggttttggtgaaccaattccagttgctggtactcacggtattggtactggtgatttacttgataaaattattaaagaatttcctaaagatgcaactaacgaagaagatgattccattaaatttagttttattggacgtccaaatgttggtaaatcttcattagttaatgccattttaggtgaaaatcgagttattgtttcaaacattgaaggtacaactcgagatgcaattgacactcgctttgaaactgaagatggtacaaagtatactatgattgatacagctggtattcgaaagaaaggtaaagtttacgaaaatactgaaaaatattcagttttacgtgctatgcgtgctattgatagatctgatgtggtatgtgtggtattaaatgctgaagaaggtattcgtgaacaagataaacacgtagctggatatgctcatgaagctggacgagcaattgttattgttgttaataaatgggatactttgaagaaagacaacaaaacaatgtctgactttgaaaatcttattagacaagaattccaatacctaagttatgctccaattgtttttgtatctgctaaaacaaagcaacgacttgataaacttcctgagttaattaagcgtgtaaatgataatcatgaacaacgtatctcatctgctgtcctaaatgatgttgtaatggatgcaattgcacataatccaacaccaacagataatggtaagagattaagaatttactatgcaactcaagtagcaattaagccacctacatttgtaattttcgtaaatgatccagaattaatgcatttttcatatgaacgattcttagaaaatcaaattcgtgaagcttttgactttgaaggtactccaattcatatcattgaacgcagaagaaaataa

SEQ ID NO: 1038 - DNA, 510 bp, Unknownn
  isolated from dental, unidentified
atgaatagagaatttaaaataagccaaagtgttcaaaattttaaactaccaaggtatgatgatttacctgaagttgaattatatttagaccaaactactgcatacatcagcgaaaggcttgaaattttaggcgatgtaaagctaactagttcaatgattagtaattatgttaaacataaattaattcgccgtcctgttaaaaaacgttatgcagctgatcaaattgcagaattattttttattgctgttgctaaaaatgtgatgcaacttagcgatttaaaagcagcaattgaattacagagacaaacttactcaacaaaagttgcttatgattattttgtggcagaattggaaaatgttctcccttatgtgtttggtttgaaatctgaactagatgaagtgggtaacgaacataccgaatatcaacgcatgctgcataatattgttatggctgttagttataaagcttacattgataaatactatgctgatttgcgtcaagaaaattag

SEQ ID NO: 1039 - DNA, 1395 bp, Unknownn
  isolated from dental, unidentified
atagtttggaaggtgaatgtattggcgaaaactaagacaagatatgtttgtcaaaattgtgaatatatctctccacgttatttaggacgctgccctaattgtggttcctggaatagcttggtagaggaaatagagaaaaaggaaagttcaactaaagcacaacctagagttagtatctctggtacaacagtgaaacctaaattaattgatgatgtttctactgtggaaaccccaagatttaaaacaaacttagaagaattgaatcgtgttttgggtggcggaattgttccaggatctttagtgttaattggtggagatccaggtattggtaagtctacgttattactacaagtttctgggcaattatctactctcgggaaaaaggttctttatgtttctggagaagagagtgcaactcaaattaaattacgtgcggatcgtttaggagttcatggaactgagctatatttatatcccgaaacagatatggatagtattagaaaaaatattgaacttttaaagcctgattttgttgtaattgattcggtgcagacaatgcaggagccagaaatgacagctgcagttggaagtgtttctcaaattagggaagtaactggagatttgatgcaaattgcgaaaactaatgggataactgtctttgttgtaggacatgttactaaagggggagcaattgcaggacctaaaattttagaacacatggtagatactgttctttattttgagggagaccaacatagaacatttagaattttacgagctgttaaaaatagatttggttcaactaatgaaattggaatttttgaaatgaaaaatggaggattaagtgaagttgctaatccgtcagagatttttctagaagaaagattaaaaggagctacgggatcagctgtcgttgcttcgcttgaaggaactaggcctatattggtagaattacaagcactagtaacgcctactgcatttggaaatgctaagagaacaacaactggtttagatcataatcgagttgcgttactgatggcggtacttgaaaaaagagctggtttgttattacaaaatcaggatgcttatttgaaagctgctggtggagtgaagttagatgagccagcaatagacttagccattgctgttagcttagtttctagttatcgcgatgcagaaacaagaccaactgactgttttataggagaagtaggattgactggtgaaataagacgagttaatcgtatcgaacagcgtgttgtagaggctgctaaattaggatttaagcgagtatttttaccaaaaaataacttagatggttggatgcctccaaaagatattgaggtagtaggcgtaagtacactaaatcaagcattaaaactaatttttagttaa

SEQ ID NO: 1040 - DNA, 1761 bp, Unknownn
  isolated from dental, unidentified
atgtttaagaaaattccattattacaagaattgaaaaaagatacttgggttaagcctttcttgaaaaaatacaagaaaactttggtactagcaattttcttaggaattttaacattcttttgtgcaggagccttgatgtttaattctggttatctaattagtcgttcagctacacgtccagaaaatattttgctagtttatgttccaattgttttgacacgtgcatttggtgtaggtagaccggtattccattatcttgaaagattaacaagtcataactgggtttttaaaatgacttctgatttacgtgttaagttgtataaggctttggaaaaagatgcggtattctttaagagtaagtatcaactcggcgatgttttaggattattatcagaagatattaatcacatccaaaatttatatttaagaaccattttcccaacctttgttgcatggggactttatgtatttgttgttattggagttggtattttttcaatttggatgggacttttaatgttattaatgataggtattatgttagtagcattcccaatctggtcagttatcgtaaatggtgctagacaagaatatgaaaagaaaataaagaatgaattatacctagacttaactgataatattgttgggattacagattggatttttgctcaacgtggtcgtgattatgttaagctacatgaacaaaatgaggaaaaattgatggatgttcaagaaaaactacatcattttgatcaaatcagagattatctcttacagttagtgtttatgttggtagttgtgagtcttattttatggggcggtacatacctaggtggcagtaatggagtatatacaggtctagctaactggattgctgcttttgttttgtgtcttttccctgtggttgatgcatttgcagtaattccagctgcttcacaagaaactaatgtatataaggattctttagttagattaaatagactacaagataattcatttgaagaagaaaaatcagaaattaaattaattgcgccttatgatattaaattagataatgtgcattttagatatgaaaatggtagtcgtgaaatccttaagggtattaacttagatatatcttctggcgataagttagcaattttaggtcgaagtggttcaggtaaaagtacgttagctaacttgattagaggggatagagttgctactgaaggtgcgattactataaatggtattgacgtaagcaaagttggcgatcaaatttccaattatattggagtaatacatcagactccatatttatttaatactactattttaaataatcttagaatcggaaatgaagaggctactatcgagcaagtatggcaagtgctggaacgtgtaggcttgaaagatatggttaaagctttaccacaaggactggaaacaatggtggacgaagccggaatgcgtttttctggtggtgaaaggcatcgaatggcattggcaagaattttgttaaaagatgctccaattatcattttagatgaaccaactgtgggcttagatccattaactgaacaagaagtaatttcaatttttaatcgtgaattgaaagataaaactttaatttggataactcatcacttacaaggtgttgaagcaatggatcaagttatctttattgaagatggaactattgaaatgcagggtagtcctgattatttgagaaaaacaaacgaacgttatcaaaagcttaaagcaattgatgaaggacgataa

SEQ ID NO: 1041 - DNA, 813 bp, Unknownn
  isolated from dental, unidentified
gatattaaattaattgcgattgatattgatggaactttagtaaattctaaaaaagaattaactgctggtgtaaaagcagcaattgaaaaagcgaaagcacaaggaattaaagtagttatttgtacaggaagaccgctaccaggggcgttgaaactattagctgaattaggtttggataatgatgataaccaatatgtagttagttttggtggtgcagtagttcaaagcacaagtggaaaagtaatttatcatcaaggacttacatatgaagatttcgttgatttagaagccattgcacgtaaaatgaatcttcatttccaagtgatcagtcctgatagaatttatacatgcaacaaggatattggttactacactttatacgaagcaaatcttgtatcaatgggtatttcctaccgtacacctgatgagttaagagatgtacctttgattaaggggatgtttattgatgaacctgaaattttggatccagctatcgcagatcgtacttatttcggacaattggaagatagactagaattcaccaaaacagcagctttttactatgaagcatatacaaaaggtgtaagtaaaggaaatgcagtagccaagttatgcgaagaattaggtttaacagctgaaaatgtaatggcaattggcgatgaagaaaacgacatttcgatgattgaatttgcgggaatcggagtagcgatggaaaatgcagtcccagcagttaaggaagctgctaatgaaataacagtcgacaatgatcatgatggagtagcgaaagttattgaaaaatttgcgttaaaataa

SEQ ID NO: 1042 - DNA, 690 bp, Unknownn
  isolated from dental, unidentified
atggaaaatacctttcttgatcaagttcatggaaaattaattatttcttgtcaagcacttgaaggtgagcctttacatagctccttcattatggcacgtatggcacgtgctgctaaaatggctggtgctcctgcaattagagctaattctgtcgttgatattcaagctattcaagacgagactggacttccaattattggaattataaaaaaagattatccagattctgacgtatatattactccaactcttaaagaaatgcgtcaagttgctgctactggagttgaagttgttgcttgccaagtaacaggacaagcacgtcctaatggagaaaaattggaagaaatcattcctcaattccgcgaagaatttcctaatactcttcttatggctgatactggtgatctcaatgatgtcaaagaagctaatagacttggtttcgatattatcggtacgactatgcatggctatacccctactactaaaggtatgaatattgctgataatgattttgaatatttaaaagaagttctaaaagttgctgagcatccagttattgctgaaggtaaaattgatctcccccaaaaagctaaacgtgttttagaattaggtgtacatgccttagtagttggtggcgcgattactcgtccactagaaattgcaaataaatttatggacgcaattaagtaa

SEQ ID NO: 1043 - DNA, 1296 bp, Unknownn
  isolated from dental, unidentified
atgaaaaaaagatatattattctatcggtagtattgatcgttctagtaataataagtgggatttttatttatcagaagaaacaaaaagttattactatcggcatttacagtgatagtagttgggatgttcctaatgataatgaatacaaattcattgattatgtcgtgaagaaattcgagaaagaaaatccaaatgttaaagttaagtacgagagtggcattaataaaaatgattacttagaatggttgtcacaaaagattgttgataataaggcaccagatgtttttatcgttccttctgagcaatttggctttttatcttctctaggaactatgcgaaatttaaattatttcatggatttatctggattaaacaccgacgactattaccctactaatttaaaagctggaatgtccgcaggtaaacaatacgcactcccacttgaaagtaatccgatgatgatgtgcgttaatactgatttactcaaaaaagaacacattactattccaaaatcaggatggacactaaatgacttctatcgaatttgtcgtcaagttacaaaagatactaatcatgatggtgtagtggatcaatttggttatgcagattattcttggaaagatgcagcccaagcctataatgccaaattattcaatagtcaaggtacagctagctattttaattcagataaagtacgccaagctttaaccatgatggaaaaattatataatttacaaaaagattataaggtaaccgcagatgactttgataagggaaaagttgcttttcttcctatgacgctagctcaatatcgcacttatgaatcatacccttatcgcgtttcgcgctactcatcattttcttggacgtgcattagaatgcctggagctactccagatattaactcaacctatgtgaatacttccatggtggcaatgtcttctcaaagcacacatccacttttatcatggaaacttgttaaatttttgtccaataacggcgatgttcaacagaaactctttacctactctcaaggagcttcagttcttaaaagcgttatgaaaagtaaagatattatcgaaaatttacagaaggaaaataatgctgacaatgctttaaccgaggaaaaattcgcaagtattatggcaaagtcacaaaaatatcctgaattcaaaaattataataatgtcatgcagacagctgattatttaattaataatgcccttgaaaatggcaacgttgaagtacaattatcaaatattcaaaatcagatccaagaagaattagcgaaataa

SEQ ID NO: 1044 - DNA, 972 bp, Unknownn
  isolated from dental, unidentified
atgacaacggcaattgaatttcagcacgtccaaaaagactttaatgggcaaaccgtgattcccgatttgaatctaatggtcgatcagggtgaactgttcgtcctagtgggcacctctggcagtggcaagacgacgtcgcttaaaatgattaatcgtttggaacccttaacggccggaaaaatcctggtcaacggggccgacaccatcacggtaccagtacgggatttgcggtggcagatggggtacgtcttgcaacaaatcgctctatttccaaccatgacggtagcacaaaatatcgcggtgatttccgagatgaaggggacggcgaagaagactatcaatcaaacgattgacgagttattgacggaagtcggcctggacccccaagaataccgcgaccggatgccatcagaattatctggtggtgaacaacaacgaatcggtattttgcgggcaatcgcagcgcaacccgatattgtgttgatggatgaaccgttcagtgcgctggacccaatttcgcggcaacaattacaagatctagtcctagggttacacgcccgctatcataatacgatcgtctttgtgacccatgatatgaacgaggcgctcaaactaggcgaccgcattggggtcatgcaacatggacagctcgtccaagtcgacacaccaacggcactggcccaacatccggtcaatgacttcgtgcgggacttcttcggtgcgagtcgtgcgaaaaacgtgtatgacgtttacgtgggccgcgtcgggctcgtccaaggctatctcaaaactgcgccggacgtggcggatggccgtattcagtcactagatattcaggcgacgttgcggacggcctttaccgccttgaccgaccatgattacttggcggtcacggaagatgatcacgtggtgggttacctggaccgacaacgggtcgtcgcttatctgagtcagcatgaagaagtatcttag

SEQ ID NO: 1045 - DNA, 888 bp, Unknownn
  isolated from dental, unidentified
atgactaaaaaacgaacaagaattatcttatttgtgaccttaatttttatcattttactcgcaattccttcttatttttggactaagagtaatatcaaagagttaaatgctttctacaactctaaactttcgccggtaattatgattccaggaagttcagccacagagaatagatttgatactttggtaacaaaactcaatcaacatactagaaataaacatagcttattgaaggttaaagtttggaataatggaaaaattacctataagggtaaaattagggctaatgacaatgaaccaattattgtagtgggatttgaaaataataaagatggttatagcaatataaagaaacaagcacgcatgtttaatcaagcattcgcagcattgcaaactcgatataaatttaataattttaaaggaattggtcattctaatggtggattaatatatactgacttcttagaacagtatttcaatgagtatagtcaagttgagattaaacgactaatgacaattggtacaccgtataattttgatgaaacgtctatttctaataaaacagaaatgttggcagactttattgcgaatagagaaagtattccaaccaatcttactgtttattcggtggcagggactgaaacctatgattctgatcgattagtaccggaaagtagtgtttcagctggtaaatatatttatcaaaagcaggttaagcattttactgaaataactgttacaggagaagatgcggaacactctgacttgccacaaaatgatgaagttgtaagtttgattgaacgctacatgcttgataatcaaaatcagggaatgaatcgaaaaggaaagaatccacaagataacttacaaaaacaagataaaaaatag

SEQ ID NO: 1046 - DNA, 1419 bp, Unknownn
  isolated from dental, unidentified
atgagtattttaagtttggctcgtttccaatttgccatgacgaccatattccatttcttcttcgttccattttcaatcggaatggtttttatggttgcgttgatggaaacatgctatgttcgtacaaagaacgaagcttataagaaaatgacaaagttctgggggaatattttcttgttgagcttcgctgttggtgttgtaaccgggcttattcaagagttccaatttggtatgaactggtcagattactctagattcatgggggatatctttggtgctccacttgctatggaagctttactatctttcttcattgaatctacatttattggtttatggatgtttacttgggatagagtgaaaccaggtttgcacttattctttgtttggatggttgtaattggtacaatgacatctgctctttggattttgactgctaactcatttatgcaacatccagtaggttacacaatccgtaatggacgtgctgaaatgacaagtttttctgctctattaagaaacccacaagtttggtatgaatggggacacgttatttctggtgctatcatgatggatggtgtagttgtagctggtatggctgcatttagacttttgaagagaaagtctctatctgaagtaagtaaggatattttcaaacgttcaatgcgtttaggtatgattgtaagtttactaggttccttatctgtaatgggtgtaggtgaccttcaaatgaaagacttacttcacacacaaccaatgaaatttagcgcaatggaagcattgtacaaagatactggtaaatcagcaggttggacagttgtcggaattgctgataccaagaatcataagacaaattatacaattgaaattccaggtatgttgagtgttctttcctatggtaagacaactggttcagttaaaggtatggacacaatcaacaaagaattacaagcaaaatacggaactaagaataattactacgttccagttaacacattattctggagtttccgtgtaatggcaggttttggtgctttaacattccttgtatctgctttaggattgttcttcacacgtaagaagaaggcaagcttatttaatacaaattggatgttgtgggttgtagctttaatgacatttacaccattcttggcaaatacatgtggttggttaattacagaattaggtcgttacccatggactgtatatggattgtttacaatcgcacaaagtgtatcaccaagtgtttctgcaacatcattattgatttcaaacatcttatactttacaatcttcacagttctagctattgtaatggttggctttgtagttaaggaacttcgtaaaggtcctgacgaagctagtgaacctgaatttgcaaaacatggtttagatccttttgacaaggaggcgttttag

SEQ ID NO: 1047 - DNA, 873 bp, Unknownn
  isolated from dental, unidentified
atgaaagttgcaattttaactgatacttcagcttgtctgacagttgataagataaaagaacttaatattcatcaaattgaattgtctattgaatttgaaggtagtagatatccagaaaaaacagggatgacgccttatctaagagataaaatgttagacaaaaggactgatactccggttttagaaccaatatcaacggcttatctagaagaatattttgaaagtctagaaaaagagggctatgatgagttcttgtatatttctttagctaacggaatcagtagtttgcctaaagtcgtatcatcatatgcaaaaacttcagatagaaagataactgtatttgattcttactctagtggagccatacaaggacaaatggttgaattagctggtaaaatgcttttatctggaaaaacagttaatcaagttgtggatcaacttattaatttaagaaataacaatcgcacttatatgcttatttctgatatctatcaactaatgaagacgggatatgtatcgaacggtgtaaattcaatgtcgaatctatttttgcgtccattaacaatgatgaaatttaatgagaacgggaaattagcgatggtaaatacacactatcgagagaaaagggcctatagtgaggtattagagctaattatttctcagtatcacagtatgaatgatcagatgcggattaccctaatgggcgatgagaataatagtcaatttgacgaattatatgaattgttacaagaaaattttccaactgctaaaattgaaaaagatgaacttccaatatctttagctatttatacaggaaagaaaagtatagggataagttttggcttagattggaaaaccgttttatatgaataa

SEQ ID NO: 1048 - DNA, 1143 bp, Unknownn
  isolated from dental, unidentified
atgaagaaatttgtgttagcaccagattcttttaaagaaagcatgacggctaaagaagtatgcgttgctatggaaaaaggtataaaaaaggtttttagcgatgcagaaattatacatgtaccaatggcagatggtggagaaggtacagtggaatctttagttgatgctacaaatggtcataaagagtatattgaagttcaaggacctttacctgaacagaaagtaaaggcgtattatggaattttaggtgatgagaagacagctgtaatcgagatggctcaagcaagtggattaatgttagtagaacctagagatagaaatcctctgacaactactacttatggtactggagaattaataaaagcagcactagataagggagtatcaactgttattataggaattggtggaagtgcaaccgttgatggcggtataggtatggcccaagccttaggggtgaaatttactgataaatatggaaataatattgagccaactggtagaggtcttactaagattgataaaatttcaacggaaaacatggataaacgaatcaaaaatgtaaacttcattattgctagcgatgtagaaaatacattaactggtaaaaatggtgctgcagcagtatttggaccacaaaaaggggcaactcaggatgaagttgaattattggataaaggattatcacattatgccgagatattaagaaaggatctagataaagatgtaaaagacattgcaggcagtggtgctgcaggaggcttaggagctggtttaatagcatttttggatgctaagttacaatctggtgtggaagtagtagctaatacagttaatttagcagaaaaaatatctaacgcagactacgtatttactggtgaaggtggaatggatttccagactaaatatgggaaaacaccatttggagtcgcacaagttgctaaaaagtatcataaaccagtttttgctgaagcaggatatttaggagaaagaattgaagacctatacgatataggaatatctgcaatttttggaattgtagataaagctgaaagtatagaagaatctttagaaaaaggtccacaaaacgtagaaagaacaactgaaaatattgcccgattaatatcgagtatcctagattag

SEQ ID NO: 1049 - DNA, 531 bp, Unknownn
  isolated from dental, unidentified
atgaaaaagaatatcttgattgttgatgcatataatatgataggaaattggccacaattagataaattaaagaaaagtggtagactagaggatgctagggatttacttttgaaaatattatctaattaccgtaagcaggctaatacagaaattattgtagtgtttgatgcgatgtatgtacctggtatgactaaacaatatgagcaatatgacttacaagtggtatggacagctgaagatcaaacggcagatacttatattgaatcattggctggaagattacaaacaccattgactcaggtaagagtagcaacaagtgatcaagctgaacaatggacaattttttcgcaaggagcattgagacttccggcttggaaattatatcaggaaataaaaagatccaaaaaagaggttagacaacaggcaaagatatatcaaaatcaaaaagccgcaagacgtttaacttggaatgatgatcagctagaaaaattagctgaatatcgggataaattaatgggaaaagaaaaatag

SEQ ID NO: 1050 - DNA, 1248 bp, Unknownn
  isolated from dental, unidentified
gtgtatctagcgataaatattgttggtgtacttgtctttttagcgattggttggcttttatctaaggatcgtaagcaaattaattggcgtgccatcgctgtaatggtattgtttaacttatttttggcatggttcttaacaagtttttcaatcggacgtgcaattgttgatggagctgcagctggatttaatgaattaatgaaagttgcctatgtaggtatcgaatttgcggttcctagcatggttaaagttaagcaaatggactggtttgtttctgtacttctaccaattttgatgatcgttcctttattcgatatcttgacatatattggtattttaccttgggttattaaatggataggaagaggactttcttggttgacaggacaacctaaatttgaatctttctttgctattgaaatgatgtttttaggtaacacagaagctttggctatttcaagtttgcaattaaagcaaatgaaggctgaacgtaacttaactttagctatgatgtctatgagttgtgttactgcttcaattattggtgcatatactcaaatgatgccaggtagttatattttaactgctgttccagttaacgttattaatgctttgattgtgacatctatgttgaatccagtaacagtgactaaagaagaagatacagttgctacaatgaaaggatcagcagctgctgaaactgaagtgggcgatgttgatgctgaaggtaatgcagtaaaagaaccattcttctcattcttaggtgattctatcttaggtgctggtcgtttggtattaatcattgctgctaacgttattgcttttgttgctttagctgcattaattgataagcttttaggatatattaatccatggttatctttagaacatattttaggtattgtaatgttcccattcgcatggttaacaggtttgaatgttcaagactctttccaatttgctcaatacatgggtatgaagttggtaacaaatgaatttgttgtaatgggtaaggttacaggcacaattagtacacacgcatttaatcctcattatcgagcaatgttaacagtatttttaacatcctttgctaacttctcaactattggtatgattattggatgctttaagggtattgtaaataaggaaaagaatgatttaatttctaagaatgttggttatatgttagtttccggtattctagtatcactcctttctgctgctatggttggtttgttcgtttggtag

SEQ ID NO: 1051 - DNA, 936 bp, Unknownn
  isolated from dental, unidentified
atgaagaagagaaagttaatatattctttaatagtaggtttagtgatattgattttacttgggataacaggtggaagctattatttagttagttatgcttttaaaccagacccaacagttaagtcaggaccaaaaggaaaagttgataagaaattactagcagatcaaaattggttaaagaaacagaattatcaaaattggtatgaagaatctgctacagacaatttaaaacttagagctatttatttaccagcggagaataaaactaataaaaccatcatcgtcgctcatggatataaaggagaagcgatgcatatggctagatatattagactatttcataatttaggttataatgttttagctccagatgatagggcaagtggacagagtcaaggtaaatatattacattcggctggccagatagactggattatgtgaaatggattaaacaagttattgctaagaaagggtctgattcacagattggactatttggtgtaagtatgggtggcgctactgttatgatggtaagtggagaacgtctacctaaacaagtaaaagcaattgttgaagattgtggatattcaagtatagaatcggaattaagcgaacaattaaaacaacaatttaatttgcctaaagaaccgatgataactgcagcacgaattatgggaacaattcgagttggatatgactttggtaagggcagttcaacaaaacagttagaaaagaataagttaccgattttctttattcatggagatagtgatacctttgtaccaacgaaaatggtatatgaaaattataaagcaacttcagcccctaaaaagttatgggtaactaaaaatacagggcatgcaaattcatataataatcatcctaaagagtatcaaaaaagagtaaatgaattttttaataaatatctaaaataa

SEQ ID NO: 1052 - DNA, 639 bp, Shuttleworthia satelles
  isolated from dental, Shuttleworthia satelles
atgatattaaaatctttaatccaaactaaggacgaattagttacagttcaagaagatatatctctagctgaagccctagatattttagaagataccggatttcgttgtgtccctattctcgataaaacaggtaaaatttttagaggtaacatctacaaaatgcacatatatcgtcataaatctcgcggtggtgatatgactctgcccgtcacttatctattaaaaaatgctacaaaattcatctctatcaacgctgcattttttaatatatttttcactattaaggatctaccatacattacagttttagatgaaaataattacttttttggtatcttaacccataatcgtctattaaaaatgttatctcgttcttggaatgttgagctcggaagctatgttcttacagttctttcaaaaggcgaacgtggtgatttggtagatattgcgaaagctattacccaatattctgaaatagctagctgtatttctttaggatttcgtaaaaaagataatttacatcgtactttattcactctaccatctggaattgaagaaaaacgtctaaacaggattgttactaaattaaagcgtagagggttcgaaattgaagaaattgaagatttaagtaagatttaa

SEQ ID NO: 1053 - DNA, 3024 bp, Unknownn
  isolated from dental, unidentified
atggaaaatacaaaagcaaaattaagttggctagagaaacccgatgtttttgcaataaatcgtttggaggctcattcgagtcataaattttatgctagtcaagaagaatatcaaaataagaaaacaagtttaaaacaaagtttaaacggattatggaaattttcttatgcacaaaatccagatttaagagtaaaaaaattctataaagaagattttaacgatagtggatttgatacgataaaagttccaggtcacattcaaacccagggatatgatcatttgcagtatatcaatacacaatatccatgggatggattagatgaattacgaccaccatatatttcaagaaaatataatccagttggaagctatgttaagacatttacagtagataaatctttaaaaaacaagcgtatctttatctcgtttcagggtgttgaaacagcgatgtatctttggttaaatggaaaatttattggttatagtgaagattcatttacacctcatgattttgaactgacagacttcatcagggaagattcagaaaataggttagcggttgaagtatataaacgttcatcagcaagttggatagaagatcaagatatgttcagattttctggaattttccgtgatgtatttctttatgcaattccagaagttcatgtgcgtgatatatttgcgaaaactactttagatgatagctataaggatggaattttgctattagatactaagttagaaggaaatatagaaaatacagaaattaatgtagagttatatgatgaagatcaggtagtctggtctcaaaaagaaaaagcacgcgagaaaacatttatggatataaaactagaaaatataagaaaatggagtgctgaaacgccttatctctacgatttgaagattacattggtaaagaatggagaagtaattgaagtagcaactcaaaaaataggtttccgcagatttgaaatgaaagatggaatcatgctaatcaatgggaagcgaattatttttaaaggagttaaccgtcatgaatttgactatctccatggcagagcaatttctgaagatgtaatgctacatgatattaagttttttaaacaaaacaatattaatgctgtaagaacttcacattatcctaatcaaacacgatggtatgaactgtgtgacgaatatggtatttatgttattgatgaaactaacttagaaagtcacggttcatggcaaaaattgggtgaatgtgaaccatcttggaatgtgcctggaagcaaaaaagaatggttagataatgtcttagacagggcaaattcaatgtttcagcgtgataagaatcatgtatctgtaattatatggtcatgtggtaatgaatcctatgctggtgatgatatcgtaaaaatgcatgatttcttccataaagtggatgattcacgtttagtacattatgaaggtgtaacttggaatcgtgattttgaggaagcaactgacatggaaagtagaatgtacgctaaacctcaagaaattgaagagtatttgcaaggaaatccttcaaaaccatatatatcttgtgaatatatgcattcaatgggaaattccacaggtggtatgaagttatatacagatttagaagatgaatatccacaatatcaaggtggtttcatatgggactatgttgaccaagcaatgttaaaaactgatgactttggcgaaaaagttttaggttatggtggagattttgatgagagggcaactgattatgaattttctggagacggtattgtttttgcagatcgtacaccgtctcctaaagctgctgaagttaagcaattgtatgctaatgttaaagtgaaagttactgaagaaggagtaattataaagaatgacaatctcttcattgacacaagtgcgtatatttttgaaactattgtaaaacgtgatggtcaaaaaatatggcagaaagattattcatttaacgttttaccacaaacaaaacaagaagaagtcattgattggccaaacattgaaaaaatcccaggagaatatatttttggagtaaatgtttgtctaaaagagagcgctgcttgggcaaatgaaagacatgaattatcattcggacagttagtaactaaagtatcgtctaaggataatgaaatagtatctgggaaattaaatgttgtgcatggtgatgttaatattggtataaatggtaatgggtttagtgtgctactttctagagctgaaggtggaatagtatctttggcttataatggtaaagagtatattacacgtacacctaaaacaacattttggagagcgatgactgataatgatcgtggtgttaagcatggtttcgatcgtggggtatggttgcaagcaggtttatatcaaaaattagttgatgttaatgtaaaggaaggattaagtgagataactgtttcatttaagtggaaattgccattagctaaagaagtatataacgtaataagttatacagttacaccggatggaaaagtaaaagtaactgctaaatattttggagttgacggactaccatcattacctgcatatggatatgagttaaaattaaaacgtaaatacaatcagtataaattctacggcttaggtccagatgaaaactatatcgatcgagataatggagtaaaactaggcatatacgaaggtgatgctgatactaatttagctccatatttagtaccacaagaaacagggaatcatcgtggcactagatggttggaagtaactgatgtatacggagaagggttaagatttgtggcaaacggtgatactttcgaaagttcagtacttccatatagcgaatatgaaatagaacaagcaatgcatcaagaaaaattgagtaatcctcattatacttgggtaagattattagctgctcaaatgggtgtaggtggagatgattcttggggtgcacctgtacaaaaacaattttggattccatcaaataaagatttgacagtatcatttacaattgaaccaacaatttaa

SEQ ID NO: 1054 - DNA, 852 bp, Unknownn
  isolated from dental, unidentified
gtgaaaaaaatagatagagcaaaattatttattcaaaataatatggaaattttccggtgtcctttttgtcaaaataaaataaccagtttacaaggtaacagtattgtatgtattaatggacacgttatcaatcttaataaaaaaggaacattacatttattaactcatggtgtgaaaagtgactatgataataaagaattgtggaatgcgagacgaactttgttacaagccggtctattttcaccaattattgagcagataataaaagaattaccagcaaaaaaattaaagataattgatgtaggttgtggagagggcacaccattaattaatttagcaaaatcaagagagaagtataatgataccctaataggatttgatatttctaaggatgcgataaatttagcaacacaaaatgagttacatccatttttttgtattgcagatttagcaaatcttccgtttatggataatagtattgatgctattattgatattttttcaccttcatcttacggagaatttttaagagttctgaaaaatgaaggtaagttatacaaagtaattcctaatgcaaattatttaattgaactacgacatcttttatatggtgatacaggttcaagaaaatcaagttatagtaacgataaggtgttaaatttattttcaaagcattttcctaactttgaaagcaagcgtataagatacaaatttaatttaacaccggaaaattttaaaaatttattgttaatgacgccacttagttggggtgcaagtaatgagcaatcagagtatgctaggcaaaatctattaaatgaaataactgtagatgttaccttattaatagcatag

SEQ ID NO: 1055 - DNA, 1299 bp, Unknownn
  isolated from dental, unidentified
atgacaattcaagatcaaacaaaagcaacagatagattcgaaactttacaagtacacgctggacaaacaattgatgaaacaggatcaagagcagtgcctatttaccaaacaacatcatatgtttttaagaatgcacaagaagcagcagatagatttgcattgagagatgcaggaaatatttacactaggttaacaaatcctaccactgatgtagttgataaaagagtagcagcgttggaaaaaggaagtgcaggtataacattagcaactggatcagcagctattacatatgcgatattgaatattgcaggacaaggcgatgaaattgttgctgctagcacactttatggtggtacttataacttatttagtattactttaaaacgattagggattaaaacaaatttcgtaaatcctgataatcctgcaaactttgaagcagcaattaatgataagactaaggcaatttatgtagagagtattggaaatcccggaattaatttagtcgattttgaagagattgggaaaattgctcataaatacggtattctctttattgttgataatacttttggaacaccatacttagtacgaccacttgaacatggagcagatattgtcgtacattctgctacaaaatttatcggcggtcatgggacaaccatgggtggagtaattgttgaaaagggagattttgattatgaagctagcggacgttatcctgatttcacagaacctaatcaacaatatgaaggattgaaatttgcagatattaaaggtgcagctttcactaccaaggtacgagctgaaattggtcgtgataccggtgcttcaattagtcctttcaactcatttttactattacaaggtttagaaacattatccttacgagtagagcgtcatgttgaaaatacaagaaaactaatttcattcttgaagtctcgtccagaagtagcatggatcaattatccagagttagaagacagtccatactatgatttggcacagaaatatttccctaagggtgtaagctcaatctttactttaggattaaaaggtggcaaagaagacggtaagaaattaattgaaaatttacgactattttctctattagcaaatgttgcggatgctaaatctttaattatccatccagcttcaacaacacatgcacaattaagcgacgaagaattgaaggcagctggagtaacgccagaattgttaagaatttcagttggaattgaaaatgcagatgatttaattgatgactttgctcaagctttggataaattgaaagattaa

SEQ ID NO: 1056 - DNA, 573 bp, Unknownn
  isolated from dental, unidentified
aaaacttacaacgaaaataaaaatgaagaaaatatttgtggatttacttttttaagacagagaaaaaatggggatctatttggaaaagcctttcctagagaaggtagatataatttctcagaatggagactaagcaaaatttctactggtgaaagatgcgatgtattttatagtgaaattatgaaacaatatccattcagtgagtatgaaggtgaaaaatatattggtgaaagtacaatgatgattaagatgtcatataaatacgatatgattggtaaaaatattgtgattggcatttcagattacttagaaggtggtttgactgacagtaatagaatgttaagattacactctttattgggaagtatagagtactgtaatttatgcatgatgccaggaatatattggagaagaagattaaaatcagctcttttatatgatacatatggatttttgaaaaatataggacttaggaaactcattaacgatagtaatgcaccattgttgacgacgatattttatccaatatctataattataggaaagtattggaaaaataaatataagttatag

SEQ ID NO: 1057 - DNA, 1137 bp, Unknownn
  isolated from dental, unidentified
atgccatcacgaagagatgataattatgttgttcgaagtgatgagaacggttatatagatacagagcatatgactcgttctcaacgctatcatcaacgtaataataaaccgaaaaaaaaaggacataaattactatggttagttatagttattgtagtagcaattattgggggattttatgcttatagaaaatatactaatgctaaacaagctgctaatgcaatttatagttcaactcaagttacaaaggccagaaatgttagtgacgctttgaagaagaaaagacctatctcaattttgctaatgggtactgatactggagctttaggacgtgattttaaaggaagaacagatacaatgatactttgtgtcttgaatcctgaagacaagaagatgacgttagtatcattacctcgtgatactgaggtagctgtttatggttatgaagattacttcccaagcaagataaattcagcatacgaatatggtggatcagcaacggcagttaaaactgtgcaaaaattcttaaatgtgccaattgatttctatgcaactatcaatatgggtgggttagaaaaattaattgacgcagttggaggagttaaagtagaaccaaccattagctttacctatgacggatatactttcaaaaagggtaaggaagttaatatggacggggaaaaagctttggcatatgttcgtatgcgccatgaagatccacgcggagattatggtagacaagaacgtcaacgtcaagtattaactaaacttgcatttaagagttcagggttaacaagcttagttaatcaaaagttcctaagtactatttctaagcaaatgaagacagacttaacatttgatgatttattaacactaggaactaagtatcgtgttgctacacatgatatggattcagacttcttacaaggaacttctgaaatgattaatggagaatcttttgaagtagcatcaacaacagaaaaacaacgtattactaataagcttagagaagcacttggtttatctaaggctaaaacaggaaatacactttctagtgataatgatgtgaatatcagttcagaaggcgaagatactaattatagtaatgatgataacacttattatggtggatattag

SEQ ID NO: 1058 - DNA, 684 bp, Unknownn
  isolated from dental, unidentified
atgcctactaaattaaaatggttcattcgaacaatctttgttttatttatgatttacatttatatagctgattatagccgcggaactttttttagtttcttacttttaaatacatttttaggatatatccctgttgaattagcgatgcatattaacgaaaaacaaaatcctgttattttttggcttttatttttcttctggttattattctatcccaatgcaccttatgtcttaacagacttgttccatttagcacgttttaatccgtacgaccctacaacaggtcttatgactttaagattaaaaatgtggctagaatttactaatttaatttcaagtgctctaggttgtacattgatgggattatggagttttgatcactttattaatgttattgctattcgttggaataaacgttcaattcctttcagaatatcattggcctttattttgacaattctttcctcaattggaatttatgttggtagatttttaagacttcattcagcttacctcttcactagtcctaaatgggtggttgatttattaataggtatgtggaatgctagaatgttaaccttcgttatctttatgacaataattcaattaattgtctgggcttctgtggctattggacgtcactcaatttatttatatgcaaaacaaaataatttagaaatataa

SEQ ID NO: 1059 - DNA, 1674 bp, Unknownn
  isolated from dental, unidentified
atgagtgaaactatggataacgagaaatttgaaaaagaagcgttgcaagtagtagagaattttttaaagagtaatacacaggtattaatagtatctggacgagctggtagtggaaagtcgactttggctggaaaaatttatgaattagcaaataagaataatgggtctgaatatttccaagcacagatcctatctcctacgggtcaatctgtaggtctaattaaacaaaaatttcctcaaattccagaacaagattgtcaaacgatctatcgtaaaatctatcgaagagcaacaaaaaagattgatgatggagataatttaatatttgatttcaaattgaacaaacaagaagataagaatatttttattatagacgatgcttcttacatttctgatgaagaaagtaataagggaaacttacactttggttctggaaaactattaacggacttattgacttctactcaaatttttgaaaaaggtaatgtcaaaataatatttattggcgatgaatatcgattattaccaattagagatactagtgctaaggctttaaagcaaacttattttgaagagttaggcttaaatactatgaaatatgaattgaaaactcagtatcgtatgcatggggaactagctagaggtatagataaatatgctgaattgattactagtgtagaaaatcatcaaaaaataataccttatgaatttaaaaatactggtaatgttagaaatattgatgaggctgattggagtaaggaagaaaagaaacaaaagattgctgggcaatttaatcgtgacaataagagaaataaggtagtagtaacttactcaactagggtagctcaagaatataataaattgatccgtagaaaacttcaaaatgtggaagatgcgccgattagtagtggcgatttagtagtattttctaaaaaccaatatgatttacttgtaatggatgctgcaggtaatgagtttaatgaggactttttcactggagatattgccgaaataatcgcaacctatgatcgaaagtcaagtaatgtaagagttaataaccaagatgtaactttgtcttatgtaaaggttaaatatcgtttggaacgaacaggaaaagagtatgtgagctacttattagaaaatgttctaaattcagatgattctcaactttcatcagatgagaggacagcactgttttacgatgctgaagaacgtataggaattacagaaactccagaagaacatcgccgccatattaaaagtaataatgaatactgggaagcagccgtaaagaaattagccaatattggagaaagtggattatctgtatcagataaggataggataagagaacttttgagaaagcatccgatttgtgatcctaaaaatgaatgtgaaagatatcaactactagataagatttatcaggataaattttataatagtattcaagtgaaatatgcttatgcgatgactggtcacaaagttcaaggaaatgaatggaacgatgtatatgtagattttactgacagaaatggattagatgaatctagtttacgttggacttatacagctttatcaagagcgataaaaaatgtattagtatttaacgcaactagtttatttggtaactttgatatctcaaatgaatttattggcaaaaagaagaatctt

SEQ ID NO: 1060 - DNA, 1338 bp, Streptococcus infantis
  isolated from dental, Streptococcus infantis
atgaaaattaggacatggatgttacatctgggtttaattttgactgttgttatcagtattgcttttacctggttaatctggtttaatcctactaccttctttcaaaacgttggacgtacaccagttgatacaagcagtggtgtaacgaatgcttcaaataaaaggctagatgatgtatatactccaacgagcttgatgtataacgagactactactaagaaatatcaatatttcaatcatcgttcagatattactaatcaagctaaaaagattatgaatagagttgaaataacatcattaaaaaccgtagcgaagcagaatgttcctaaatatttagccacagttaatcaaagtcatagtttgattttgaattacccagatgtattgccaataaagtatgtgtgcatcttgtttgataaggcacctaaaaagattgctgaaaataaagaaaatgtcgatcagattattattccgactggcaattcaggaaatacaatttattttctaaatagtaagaagcaaaatatttataaagtaagtgtgaaaaatctgaatgttaaatctttaatggcattgactaaagacaagcatacacagtcagtagcgactgctttggaaaatataggtgatggctatcgttggacatatccgcaaggggtaaaattaaacgaatatagctatctaattaataaagaatctgctggtaatatggtggctaagttgttgggagctaatacttcagcgacaattacaaccaagcaacaagatggtaagacggtttattctgatgacgctaatcagaggatgacagttgataataaacatggtgaagtcgaatatatcaattatgatagtaatgataaaaataagccaaaagtcagctttagtaagactttggagattaatctagccaagcttaattctctaggagttacattagatgatgttagatattcgaattatgagagtaagactggcgaagtaatttatcgtaactatattgcaggatttccaattgtttcagagtataattatgggacttatagcttacaaaatgttacttcaaatggacaaagatttatgttctctttgtatggtttacaagtaccattgccaaatactaataagcaaaagacactaccatcaacgagcgatattttaaatcgtttatcaagcataggttatagttctaatcgtgtaagagctataaaaatcgcatactcttggcaacgtaatgatagttcaagtcaagtcgtggatctggtaccaacttacctaataaaagttgatggcagatggattgattatgaacaactatttcaaaattttggaaagtag

SEQ ID NO: 1061 - DNA, 2658 bp, Unknownn
  isolated from dental, unidentified
atggttaacaagacaaacaacaaagaagaagatgctcgtgtatacactgatggtttagtagaaaaagcattaaaagctgaacaagaatattctactttctcacaagaacaagtagataagattgttgcagctgctgctttggctggctcagaggctgctttgattttagctcatgaagcagtagatgaaactggacgtggggttgtagaagataaggatacaaagaaccgtttcgcaactgaaaatgtctataatgctattaagaatgataaaacagttggtgtaattgaagaagataagattaaaggcgaagtaaaaattgcagctccacttggtgttttagcaggtattgtacctacaacaaacccaacatcaacagcaatgtttaagtcattattagcattgaagactagaaacgcaattgtattcgctttccacccacaagctcaaaagagttcagcacatgctgcaaagatcgtttatgatgcagctgtaaaagctggtgctccaaagaacattattcaatggattgaagaaccaagtctagaaaagacaacagctcttattcaaaatccaaagattgcttctattttggctactggtggtccaggaatggttaatgcagctttgaagtctggtaatccatcaatgggtgtaggtgctggtaatggtgctatctacgttgatcatacagcacaccttgacagagctgttgaagatttacttctatctaagagatttgataacggtatgatttgtgctactgaaaactctgcagttgttgaagctcctatctatgatgaatggctaaagaagatggaagaaaaaggagcatacgttgttcctaagaaagactataagaagattgaagatttcgtattcaatgatagacatggtgtaaatggtccagttgctggtaagccagctcgctggattgctgaacaagctggtgtagaacttccagaaggtaaagatgtaatgttattcgaactttctgctaagaacatcggtgaaaaactatcatctgaaaagctttctccattattgtcagtatataaagcaaaagatcgtgaagatggtattaagaccgttgctgcattattagattatcaaggtgcaggccataacgctgctatccaaattggttctcaatccgatccatttgtaaaagaatttggtgatagaactaaagcagctcgtatcttggtaaatcaacctgattccattggtggtattggtgatatttacacagatggcttacgtgcaagtttgacacttggaacaggatcatgggggaagaattcattgtcacataatttatcaacatcagacctattaaatgttaagacagttgctaagagacgtaacaggcctcaatgggttcgtttaccagaaaagatctactacgaaaagaatgctatcagctatctacaagatgaaactgaagatattaaccgtgcattcatcgtagctgacccaggaatggttaagtttggatttgtagacaaagtttacgatcaattagcagcaagagaaaatgaagttaaaatatctctttatggaactgtaagacctgacccaatgttaggacaaacaattgaaattgctcaacaaatggcacaattcgaaccagatacagttattgctatcggtggtggctccgcattggatgctacaaagattgctcgttatatctacgaatactccttagatcaagaaccaggattcttagatagctacgaaaaagttagtgaagtatttaaagaattacaacaaaaattcgttgatatccgtaagagaattgttaagttccatcatgcaaagaagacaagaatgtttgcaattccaacaacatctggtacaggttccgaagtaacaccatatgctgttattacagatgacaatacacatgttaagtatccattaacagactatgaattgacaccacaagtatcaatcgtagacccagaatttgttatgactgttcctaagagaactgtagcattgtctggattggatagtttatcacatgcccttgaatcatatgtatcagttatggcatctgacttcacacgtccatggtcaatgcaagctatcaagttagtatttgaaaacttggaagcttcatacaactacgatccaaaacatcctacattggaaggtgaaaaggctcgtgaaaacatgcactatgctgcaacattagcaggtatggcatttgctaacgcattcttaggtatcaaccactcaatcgctcataagactggtggggaatttggattaccacatggtttggcaatttccatcgctatgcaacatgtaattaaatttaacggtgcttctggtcgtgtaaagcgtacaccattcccacgttatgaagtatatcgtgctcaaaaagattatgcagatattgctcgtgcattaggcttgaaaggcaactcagatgctgaattagtagatgcattatgcaacaagattaacgatttaatgaagaagttagacgttgaacctaagttatctgcaaatggtgtaactaaagaacaatttgaaaaagctcttgataagatggttgatcgtatttacgatgatcaatgcacaactgcaaatcctcgtcaaccatacttggaagaaattcgtcaattgttgatcgatcaattctaa

SEQ ID NO: 1062 - DNA, 1404 bp, Unknownn
  isolated from dental, unidentified
atgttagaaacattgaataattttttcactatttttggtgccagcatcatagtaccaataataattttcattattgctctatttttacatgttaaattttccaaagctataatgagtgctttttatgcaggtgtaggattaacaggatttaactgggttattgctgaattcacaccaattgtaaccaagattgtaaaacaaatggtaaataatactgggattaaattgccagtggtcgacatagggtggcaagcaggctctttagcaagctttggctcatctgtaggaataactttctttgtatttggcttaatttttgaattaattatttttgcattgggtatcaccaaggtctttatggcatctaatttatggaataattttggatttatgatttgggggaccttagcttactatgtaactcataatttttggttatcattaagtttatcctttttcatgttactatacactttagtaattgcagaaattcaagctgatagatggtcggaatattttgatataaaaaatgcgacagtagcttcattgcataacatagaacagactattcctgcaattttgctggatcctttatggaacttgttgggatttaataaggtgaaattaactccgaaagttttcaaggatagattaggagtgtttggggagccaacaagtttaggaataatattaggaataattataggaattttaggtaacttaaacaatttaacggatatagatgcttggggagaggtattaaagtttgcaattcaacttgctgccgttatgacaatttttccattaattacagacgtttttgctaaagcattcattcctttggctgatgcaattgatagtagacaaaaagaggaaatgaaagagaaaacacaccctaagagatggttcttaggtattgatgatggtgtaggttatggagaaccagctactataatatctgggatgatattgattccaatcatggtactacttgcatttgtattaccaggtaataggacattaccagtggtagatttaatagcattaccttttatggttgagtcaatagttgcaataactagaggtaatatcttaaaaatcattgcaaatggaattatttggtttagtttaggattatatgcatcaagttggttaggttcagtttatacagaagcagtatcaaattatggtgctacaattccaactggtgtagtgttgattacaagttttaatctaatggccagaccattaaatgcagtggtatttgcagcatttatttcacaaaatccattttggatagggttatgcttagtaatttatctcgtattgttattcttacttagaagatatagaagtcagatatggagctatctaagaaaaatgtcagagaaaaatataaattaa

SEQ ID NO: 1063 - DNA, 2592 bp, Unknownn
  isolated from dental, unidentified
atggataacgaaaattatacaactgaagttcaaaaaagtttggcagaagcacaaaaggtggcaattaaccgaaaacatcaagaaattggaattaatgaattatttaaagtgttagttcaacctggagaaatagctgctgagatctataaaaaagcaggtttagacatacaggcctttgaaagctttattgatggcgaattagataaagtcagtgttgttgaaggtggtaatgttcaatatggacaatcaataagtcagcaacttttttcattactacaaaaagcacaagaaatagctaaaagtaatcaagatacttatgtgtctgtagataccttaatgttagctttaatggagttagagtacaatcccttaacagaatatttaaagcaaactggattaacaaaagatcagttaggcaaagttgtagctgattatcgaggaggagaaagagtgacaagtcaagatcaggaaaaaggctataaatcacttgaaaagtacggagtaaatttaaacaaggaagttagaaatggtaatcaagatcctattattggacgcgatgaagaaattcgcgatgttattcgaatcttatcaagaaaagctaagaataatccagttttgataggtgaacctggtgttggtaaaactgccattgttgaagggttagcacagagaattgttcgaaatgacgttccagataacttaaaagataagactataatttctttggatatgggttccttaattgctggagctaaatatcgtggagaatttgaagaacgattaaagaatgtattaaaagaagtgaagaaaagcgaaggaaagatcctacttttcattgatgaaattcataatatagttggagcaggtaagactgaaggttcaatggatgctggaaatttattgaagccaatgttagctagaggtgaattacatttaattggtgctactaccttggatgaatatcgagaatacattgaaaaagataaggcccttgaaagacgtttccaaaaagtacttgttaaggagccaactgttgaagatacaatttcaattttgcgtgggttaaaagaacgttatgaaattcatcacggagttcgtattcatgataatgccttagtagcagcagcaactctatctaatcgctatattacggatagatttttaccagataaagcccttgatttaatcgatgaagcttgtgctgaaatacgtgtagaaatgaattctgttcctaatgaattagatcaagtaactcgcgagttaatgcgtgaagaagttgaagaagctgctttgaagaaagaaacagatgctgcatctaagaaacgcttagaggagttacaagccgaattatccaatttacgtgaaaaagctaataaacttcgtcaacgttgggaagatgaaaaactagacatccaaaaagtatctgataagaaatctgaattagataaagctcgtcatcaattagaagaagctgaaaataattacgatttagaaaaggctgctaagttacaacatgcaacgattccacaactagaaaaagaactacaacaattggaaaatagtgaacgtcctaaagaatggatggttgaagagtctgtcactgataaggaaattgcagaagtaattagtagaatgactggtattccaattagtaaactggttgaaggagaacgtgaaaagcttttacatttagcagacaatttgcataagcgtgtaataggacaagatgaagctgtagatgcagtttctgatgcagtcttaagatctagagctggtttgcaaaatcctaacaagccattgggatctttcttgttcttggggccaacaggtgtcggtaaaacagaactagctaaagctttagccgagaatttatttgattctgaaagtcatatggtaagaattgacatgtcagaatatatggaaaaatattcagtttcaagattagttggtgctgctcctggctatgtaggatacgaagaaggtggacaacttacagaagctgttcgtcgcaacccttatactattattttattagatgaagttgaaaaagctcatccagatgttttcaacattttattacaggttctagatgatggacgtttaactgatggtcaaggaaggacagttaactttaagaacacaattttaatcatgacatctaatttaggttcagagttcttgctagaaaatgattctacagatggtacaatttctcctgaaataaagaagaaagtcatgcaactaacacaggcgcacttcaaaccagaattcttaaaccgtattgatgatattttgatgtttacaccattaacaatggattctgtacaaaagattgttgaaaaattcattcatcaattgtcagacaggttagaaagtcaagagattacattaggcattgatgaagatgctcagaagtggattgctaaagaaggatataacccagcttatggtgcaagaccactgcaaagatttataactaataacgttgaaacgccgctagctaaggaaatcattgctgggaaaattctacctcattctaaagtgacggtaactttagtagataaccaattaaaatttataactcaagcataa

SEQ ID NO: 1064 - DNA, 1038 bp, Neisseria flavescens
  isolated from dental, Neisseria flavescens
atgaaagttatggaaaaaatgcaatacgttgtaatgaaaacagatgatattagaacaaacttggccacagaacaatatttaatgaatagcgataagataaaacctccgttcatgttattctacattgaaaagccatgtattattgttggtcgtaaccaaaatacaatggaagaaatcaaccaaaaatattgtgaagaacatggaattactattacacgccgtctatcaggtggtggagctatgtaccaagatttaggtaacctttgctttagtttcgtagtaccagcagaaaatcaaaaatttggtgactttaaatctttagtacaacctgttgtagatgctttgcataagatgggtgtaacaggtgcaaaaacaaccggacgtaatgatattgtggtcgatggtaagaaattctctggtaatgcaatgtatacgcgtggtggcaaaactttctctcacggtacactaatgtttgatgttgatactgatgcagttgctgatgctttacgtgttcctaaggataagattgaatccaaaggaattaaatcagtacgttctcgtgttacaaacctaaagccatatgttagtgaagaatacaaagactttgatacatttcaatttagagatgaattaattaaactaatttggggtgttgactctttagaagaagcacaacaatatgaataccaattagatgacgaagataaaaaaggtattgaagcaatcgaacaaaagctttataagaactgggactgggtgtatggcaagtctccagaattcacagttaagcgtcgtaaacactttactagtggtacaattgatgcacgtttcttagttgaagatggtaagatcaaagatattaagatttacggtgacttctttggttcaggcgatgtaaaagatgtcgaagatgctttacgtgggttgaagtatgatgtgtcaactataaaagaagcattaggtaaacttgacttgaataaatattttgttggaattgatgctgaagatgttaaagaattaatctcaacacaacaatag

SEQ ID NO: 1065 - DNA, 987 bp, Unknownn
  isolated from dental, unidentified
atgtttggtataggaatagcgatttttttattctctttacgagaaatatcttttcgtagctttgtacatgatgttaccaccttaaatttgtggtggttaggaatagcatttttgtgtatgtttctttccttagtatttgaagcgttagtcataaaaatactagttcaaaggcagattaaaagttatcctttttttgatgcgttacgcgtgccaatgttagagcaactatttaatgggataacacctttttcaacagggggacaaccggcacaattatttgcattaatgcaatcaggcttagatgctgggcgagcaacatcaagtacattgatgaaatttattgtttaccaagctatgatagttgttaactttgtattgtgtttattaataggttttaattttattcaagaaaaaatacatacgctagcgtggttggtagtatttggctttattatccacctagctgttatcgttagtttactaatggtgatgtattggtatgattttactaagaagtttataaaagtaacattattaccaataaaatggatatttaatgacgaaaaatatcgaaattggaataaaatagttgatgagaaaattaataatttctatgaagagagtttaaaattgaaatctaattggaaattattattaaaaataagtgcaataacttttgtacagttagctgtatattatattattccatatttcatcttattatcattaggagtgacacatgttaacgtcatcatggtaatttctatgcatgtcttaatagttatggttgtatctttatttccaatacctggaggagctggaggggctgaatatagcttttcggtaatctttagtagttttatcggtactggaagcaagttagttttagcaatgcttttatggagaatagttacttattattctgggatgctgagtggcttgatagcaatgttaattcaacctaaacgaattgtaacgaaaaaatag

SEQ ID NO: 1066 - DNA, 765 bp, Unknownn
  isolated from dental, unidentified
atgtcacaactaagcgttaataatttatctttagcattagcttttgcgttagtattagtagctgtttatatcagtaatcgcgaaaaattaggcctaacaaaggatattttctatagtatttcccgggcaataatccaacttgtaatcgtaggatacattcttaaatatatcttcaatgtaaataatgttatcttaacagcagcaatgagtttctttattgtgttaaatgccgcttacaacgctcataagcgaaatcctaacgaccacaagagttactttaattcattattagctatttttgttagtacatatgtaactatgggagtattagtagcttccggttcaattagatttattccatctcaaattgtccctatcagtgggatgattgcaagtaactctatggttgcgattggtctttgctacagaaatttaaatacactttttaaaaaccaaagacaacaggttttagaaaaattggccttaggagcatctatgaagcaagcttcattacctttattacatgcaagtattaagactgcgatgcaaccaacgatagattctgcaaaaacagttggtttggtaagtttaccaggaatgatgtcaggtttgatttttgctggagtagatccagtaagggcaattaagtatcagattatggttacgtttatgcttttatcggctacgagtttaggatcaattattgcaggatatcgaacatataaagattactacaatgaaagattacaattaagagttaaataa

SEQ ID NO: 1067 - DNA, 1152 bp, Unknownn
  isolated from dental, unidentified
gtgagaaagttgaagtatatttacttagataatgcaggcacaactccaatggctacaaaagttgttgagaagatgactgaaactatgaccaatactttcggcaacgcttctgccgtaaattattatggtcgtcaagcacgtgctatcttagataatagtcgtcacgtaatagctgagtcaattaacgctaaaaatgacaatgaaattgtatttactagtggcggtacagaaagtgacaacactgctattatccaaacagcaatggctagaaaaaatgaaggtcgtcatttgattactacagcaattgaacatgaagcagttctaaaaccaatggcatatttagaacaagaaggctttgaagttacttatcttccagttgatgagtatggtcaaattaatttagatgatctaaaacaagctatcagaccagatacaattttagtatctattatgatgggtaataatgaagttggaagtcatcttcctattaaagaaataggtgaaattgttgcgccaactaatgcttggttccatacagattcagttcaaacttatggtgcaattgacatagatgttcaagatttaaaagttgatttattatcagtgtctgcacataaattgaatggtcctaaaatgttaggatttctatatcgcagagatggaattaattttccacccctaatcaaaggcggagatcaagaattaaagcgccgtgcagggactgaaaatgtaccagcgattgcagggtttgcagaagctgttagtttattaccagcagaggtaaaggaagaacatcgtcaaaaatacctatcttttaaacatcaattagtagatggattaaaggaaaatgaaattgactttgagattaatgggcatcttgaagaaaatcaattacctcaaatcattagtatctggtttaaaggctttgctagtgatagtttactaactaatcttgatttaagtggcatttcagcggctgctggttcagcatgtacagctggctcattggaaccttctcatgttttagcagcaatgtatggtgaagatagtccaagagttgctgaatccttacgttttagttttggaatcaataatactagtgaggacattgattacttgattaagacgctagtaaaaattattaagaaatag

SEQ ID NO: 1068 - DNA, 1053 bp, Unknownn
  isolated from dental, unidentified
atgaaaattcatcaacatcgcaaaaatgaacatctttctttagctgaaaaattttttaaaactcaatcatctaatcagttagatgaagtgcaattaatttatagtaacttacctgagttaaatttatcagatatagatataagaagtacgttagttggtaaagatattcctgtacccttttttattaacgcaattactggaggaagtccacaaactgatgatataaactataaattatcaactgtcgctgctaaaacaaatatacctatggcctgtggctctcaaagtattgctttaaaatatcctagtttatcaccaaatttcagtaaaataaggcaactaaatccaaatggctttttgttaggtaaccttggagcaggtcattcttactcaaacttcaatgttgctcaacaaatgattgatgctaatgcaatggaactgcatcttaatgtttctcaagaattagtcatgcctgaaggcgatactgaatttgtgtggaaagataatattcgtgaaatagttaataattcatcatttcctttacttgttaagggggttggacaaggattaactcctatgactattaaagaattagctgatattggtgttaagtatatcgatctttctggcaaaggtggtactaattttatagaaattgaaaatcgtcgtcgtaaacaaaaagaattagcatttttgcaagatattggtatgactactgctcaatccttagtagctgctaaacttgtagatgaagacatttctttcactgcctctgggggaattagaaattctcttgatatagtaaaatgtttagttttaggagctgacaatgttggtatttctggcctatttttacatattttattacgtcaaggaactgagagtttaattgaatatataactaatttaaaagttgaaataaaaaaagttatgttgatgctaggttgtaaaaatattgatgacttacataaattaccagtaattttaagttctgagttattagtttttaaaaagcaaatgactgagttattaaaaaataaaggttgggattaa

SEQ ID NO: 1069 - DNA, 1215 bp, Unknownn
  isolated from dental, unidentified
atgattgtagaaaatataccagatgagtttaaaaaagcattacctattttagagaaaattagagaagctggatttgaagcatactttgttggtggtagtgttcgtgatactttacttggtctaccaattcatgatgttgatattgcttcaagtgcctatcctgaggagattaaacaaatatttagtaagactgttgatacaggtgtagaacatggtacggtgatggttttagaccacggtactggatatgaaattactacttttcgaacagaatcaacttatcaagactatcgaagacctgataaggttgagtttgtgcgctctttagaagaagatttaaaacgaagagatttaacaatcaatgctcttgcgatggatgataagggtaaaatcatagacttattcgatggattgaaagatttgaaaaatggcattataagagccgttggaaatcctgaagaacgattccatgaagatgcattacgtatgatgcgtgccgtcagatttggtagtcaattagattttaaagtagaactagataccttcaatgctattaagaaaaattcccatttacttgaaaaaattgcaattgaaagaattcatgtagaatgggttaaacttctcttgggtaaaaaccctaaacaaggattacaagaatttttagatacagaattatataaatattgtccattatttgcagataaatatgctgaattaaagtctatattagaattttcagactttaaattaaatacagaagaagaatgttggacattattatctgatgtttttaagttaaaagatactgatataagcaatttattacgttcttggaagagttctaataacattattaaatatgttattgcagctagtttatgtgtccaaaaaatcaaagatagtaagttagatattgagacatattatcaaaatggaatagaaattattttaacagctaaccaaattgcaaaaatacgaggatttggtatggatgataatgagcttaaaatcaattatgataaattaccgattaaatctagaaaagaaatgaagattaatggtaaagatcttgtgcaagaagcaggggtcaaacctggaaaaataatgggtgaaattttaaataaacttgaaaaagaaatagtttttgggaatattattaatgacaaagagatattaatagaaaatgcaaagaaactattagaagagaaagtgtga

SEQ ID NO: 1070 - DNA, 699 bp, Unknownn
  isolated from dental, unidentified
atggacggaaataaattatcatatcgtttacaaaaagtggcagaatatgtccctgcagatagtagattagcggacattggttctgatcatgcttatttaccagcgtatctagcattaaaaggtaaaattaactttgggattgctggtgaagttgttaaaggaccttttcaaaatgctcaaaatgaaattaaaaaagaaaacttacaagagataatagatgttcgtttggctgacggattagctgcagttgaactttcagatgagattaatgtagttacaatctgtggtatgggtggcccattaatttgtcagattctagaagaaggaaaggctaaattagctaatcatcctcgcttagttttacaacctaatgtaggtgagaaaaatgtcagagaatggttagtagctaataactatcaaataattgccgaagatattttagaagaagacaaacatatctatgaaattatcgtagcggaatttgttgatgtaaaggctgagctaacagctaaagaattagaatttggtccttacttaatgaaagaaaagaacgaagtctttaagcataaatggcaaaaggaattagataagattgaaacagttagagttcagctggaaaaagccaaggaaaagccagttgctaagttagaatatctagacgaacaagtaaaactaatagaaggtgtattaaatgactaa

SEQ ID NO: 1071 - DNA, 849 bp, Unknownn
  isolated from dental, unidentified
atgacagtacaagctgtaaatggaatagctttagcacaaaaacaatggaagaataaactgaacgataaacaaaatttagaaatattaattgtaaatttaatgccaaccaaggaaacaacagaattacaatttttaaagttattggaaaaaacaaaaattaattgtagagtgacttttgcatatcctgatagtcatcattttcatcatggtaatagtgaaattataaagaaacattatctgcccttgagcaaggttttacaacaaaactttgatgggctaatagttacaggtgcaccagtagaacatctggatttcacagaagtagactattgggatgattttcaaaagttggttgaatggagtagacaaacaaaaattcacacgatttttgaatgttgggctagtcaagcagctttgaaagtaaaatttgatattgataaattacctttagtttctaaattatttggagtctatcaagcggaaaaaatagacacgaatagttccttcttattaggttttggaagtgggggaccaattcgaatgccacagtctcgacatactaaattaatcttaccggtaaaattacctgatgagttgcaggtactagctaagagtcaggaagtagaagcatttttattagcgactactgatcaaaaaaatttatttattactggtcatccagaatacgatacaagaacgttagatagagaatataaacgagatttagaaaaagggaaaccaattagtaaacctaacaattactatcaaaataatcagatagttaatcaatggtttcaaagtagtgtcaagctatatacgaactggttgaacctaattcacacaacttag

SEQ ID NO: 1072 - DNA, 828 bp, Unknownn
  isolated from dental, unidentified
atgaaacttatttcatggaatatcgattctttgaatgctgctttaactagtgattctgctcgcgctaaacaatcacgtgaagtcttagcaactattattgatgaaaatccagatataatagcaattcaagaaacaaaattatcagctacaggtccaactaaaaaacatcaaactattttagctgaacaatttccagattatgaaattgcttggagaagttcacaagaaccagctcgtaaaggttatgctggtactatgtttctttataaaaacaatttaaatcctactatcagctatcctgaaattgatgcacctgaacctatggattctgaaggtagaatcatcacacttgaattcgataatttttacgttactcaagtatatactcctaatgctggcgatggtttgagacgtttagctgaacgtcaggtttgggatgaaaagtacgctgactacctagtttcattggatcaaaataaacctcttctttctagcggtgatttcaatgttgctcataaggaaatcgacttagctcatcctggtaataatcatcattctgctggtttcactgatgaagaaagagcaggctttactaacttgcttaataagggctttacagataccttccgctatgttcatggcgatgttaaggatgtttactcttggtgggctcaaagaagtcgtacaagcaagattaacaactctggttggagaattgattattggctagcaagtaatcgtattgctgataaaattgttcgttctgaaatgttggattctggtgaacgtcgcgatcatactccaatagtgttagaaattaatatctag

SEQ ID NO: 1073 - DNA, 1845 bp, Unknownn
  isolated from dental, unidentified
atggttaaagtaaataattgggatgctgagtatgatgtagttgttttagggtttggtggagctggagccacagcagccagattcgctgcagatgaaggagcaaaagttttattagttgatgctgctcctgaaggtaatgaaggtggtaacactcgttattctgctcaaatgatcagtgcaagtgatgactttgaagctgaaaagaaatatttcgcagctctaacagatccgataacacttgaccaagaaatagcagatacttatgttgaaggtatggcaaatatggctaaatatttgaaggaacatttaggcgtggaaccttatcaatataagcgcgattattggaataatcctaaatttgcagcattgagaaaagctattattgataatacagtggaatatccagaatttgaaggcagcgaacaccatgatattttatcagttagtttgggattctttgatggtgctttgtggaagatgctaagacaaaatgtagttgatcgttcagataagattgacgtatggtttagttcaccagctcgtcatttaattcaagatcctgcaacaaaaactgtaataggggttcaaattgaacgtgatcatgtattgagaaatattaaagctaataatggtgtagttatggctactggtggtttcgaaaataacccagaaatgttagaagattacctgggtgcatctaagttagtaccattaggaaccttatacaataaaggcgatggaattaagatggcaactgaagtcggtgctagtttatggcacatgaataactatgaatctttaggaatgcttcatggactagcatttacggttccaactggtaaacgtggtaaattaattttgggagattggaaagctatttatgacggcagtgtcttccttgcaggagatgatggtacacgctattatcctgaagatatgactaatagacatggccatgtttatagccatggttattggaaagttccacaaaataatcatcatccacatattatttttgataaaaaacaatacgaaaaatttgcagataaagagacaagtatctacccacaagcactagatatggtgattgaagctaacacactagaagaattagctaaaaagataggtgctgtaccagaaaaattgcaagaacaagtggcagagtttaacttctttgcaactgaaggaaaggattatgcattccaccgtaatccagaaacgatgcaagcatttgatgctgagggtccatactatgccttatcagtatcacaaacagttttaaacacacaaggtgggccacgccgtaatgcacgtgctgaaattttgtccaatgatggtacacctattccacatctttatggagctggagaactcggtggaatttctgctggacgttatcaagctggagaaaacattgctgaatgcttaatttttggtaaaattgcaggcttaaatgcagctcgtgttaaagaagaagtttttgaacacacgacagaagaacctgacgctgtatcttcagcatctcaaactgaaaaaaaggtcaatttaggtagtgacttagatgttaaagaaacttatatggtgggtgctaaccaatatttaggaagaagtaatgctagtgtaggtaacgaagttgtagttagaattacagtagatgatgataaaaaattaaaagatattgagattttaaaacaaagtgaaactggaattggagcccaagcaattgagagtatgccaaaagaaatgatcagtaagaatacttacgacgttgatagcatttcgggagcatcagcaacaagtagagctttaaaagaagctgtaaaagatgcgatgaataaaatttaa

SEQ ID NO: 1074 - DNA, 780 bp, Unknownn
  isolated from dental, unidentified
atggataggacaagtgattttgatttaatgaaacataacctgacagatgtaattgaattcaccaaaattatcattgattatgacggattcaacccaaccacagatttttggcaacccctagtaacaacatactttaaatcattcttgcgtatcttcggaaagccggaaggtatcgacgaactgcttgtattccgagctggaagttccaaaggattcgaggccatagaggccagcggacgagtaaacgacctctcgacgcatgatcaccgaggagtcctcgctatcgtgaccggtgtaggaaatggccatatgcccgtccacggtggtgaaggaatacttgtcaatctgcagaagacgagcgacattggtcaagaccttacgtttctgcgcgtcattgaaccccttggagtcctcgacttgcttccgagtgaatttggtgacggacacagcgtagttgatgtgatccttgtcattaaccgtcgaatagcgggcataagcgccggtgggatccttataggtgtccttctccggaacgcccgggaaatagacggaatagcccagatccttggacgtgaactttttccagccctggggggcagtgacggaggaagtggctttgttcgccgatggggcagtcgactgggaggaaccgcaggcggccagacctgtcgtgaaagccatcgttgctatgacagcggaaatccgcctgaaagaccttttcatatcaaacctctttttctttcttgtcgtttcttgctttttcattgtaacaccttctaa

SEQ ID NO: 1075 - DNA, 1386 bp, Unknownn
  isolated from dental, unidentified
atgagtaaaattagacttgttttattaaatattgttttggttttagtatcaatgctaggtgcagtattgataatggttgattttaaaaaatcagttctatcagagtttttagaaaaagaatcgtggatacaaattataattgctgttgtagtacttgtagtattagatacaggaattgacttgtggaatagtagaaaacaaagaaaagagatagaaagattaaataagaaaattatagaagatatcaaattaactgataatgtgatagataagaagaatccttattacgagttatctcaatctataggttatgttcaagataaacaaaataagctttctaaaaaatatgataaaagaaaaagggaatatttgagcttattagaatatatcgatattggaatattagttattgattataaagatagattaacaatgtctaatgaattaggaaaagatttttttgattttgataatgaatggaaaaatcaagattatcaaaattatatttacaatcttgatgtgagaaaattaattgagcaagttaagttgaccaaggaagataagaaaaaacagattgtattaaaagtcgatacagttcaaaaaattgttgagacaagtgctatctatattccgatagattctgagcgctacttaataatgctgatgttacgagatttaacagctcaaaaagaagtagagaaaaagcaattagattttgtgggaaatcttagtcatgaaataaaaacgcctattactgcaataacaggatttagtgagacactattagatggtgctctagatgataaaaaagttagtaaacaatttattgaaattattcatgatgaaagtacaaaactgtcaaacttggttgatgacatgataactatttctagattaaacgagcatggaagtttgaatattgagttggtgaatatctttaagttggttaaagatacattacaattatttagtcatgaaattgagaaaaaaggattgaatgttaggatagaaatagatgaagaattaagcttatattgtgataaattgaaattaaagcatattatcactaatttaattcaaaatgcaattcgatataatttagaaaatggggaaataaaaattaaggttcaaaatgacaaaaaaaatgagtgggtctttgtcatcagtgatacaggtattggcatatcggatgaagataaagaaagaatctttgagagattttatcgtgtagataaatcacatagtaaaacagttggtggaacaggattaggtttagctgttgtaagggaatcagttgatgctttatctggaaggataaaagttaaaagtcaaattaatgaaggaacaacattttatgtgattttaccgagatttaaagcaaggtag

SEQ ID NO: 1076 - DNA, 657 bp, Unknownn
  isolated from dental, unidentified
gtgggtcaaaaagtaaatccaacaggtttacgtgtcggaatcattcgtgattgggacgcaaagtggtacgcagaaaaagactttgcttctaacttacacgaagatttacgcatccgtaagtatatcgaaagtaaattagccgacgcttctgtttctaccgtagaaattgaacgtgcagcaaaacgcgttaacatttcaatccatactgctaaaccaggtatggttattggtaaaggtggatctgaagttgaaaagcttcgtaaagaattaaataacttgacaggtaagagagttcacattaacattgttgaaatcaagaaacctgatttagatgcaaaattagttggtgaaagcattgcagaacaattagaaaaccgtgttgctttccgccgtgctatgaagcaagctattcaacgtacaatgcgtgcaggtgctaagggtatcaaagttcaagttgcaggtcgtttgaacggtgctgatatgtcccgtgtagaacgtttctctgaaggaacagttcctttgcacacattgcgtgcagatatcgattattcatgggttgaagctcacactacatatggtaaattaggtgttaagacatggatttaccgtggtgaagttttaccagcaaagaaagaaaacagtaaaggagggaaataa

SEQ ID NO: 1077 - DNA, 909 bp, Unknownn
  isolated from dental, unidentified
atggatggaattctacctttgtataaagaacgtggaatgactagtaatgatgctgtcataaaatgtagaaaaatttttaagactagaaaaataggacatagtggaactttagatcctgaagttgatggtgttttaccgatttgtgtgggaaaagctacaaaagtggttaattatttaatggattcaggtaaagtatataaaggcgaaataacattgggatttgctactactactgaagatttggaaggcgaagtaatttcgaaagtaaaactttctgaaccattttcagatgagaaaataaatgaaattttgtctagttttataggtgatataatacaggttccgcctatatattctgctataaaagttaacggtaaaaaattatatgagtatgctagagctggtgaaaaagtagatattccagaaagaagagttcatatagaatattttaaacaaattttcccttcaaaatttgataaagaaaaaggacagcaaactatatattttgaagtcggttgtggtaagggtacatatgttagaactttagcagtagatgttggaaaaaaattaggtgttccagctgttatgagtgatttgacaaggcttaaaagtggtggctttcaaattggaatggcgaagtcattatcacaattagaaaaattagcacatgaaaataaattatctgaatcattatatcctattgattatgctgttaaagatttaccaagatatgatttgaaattagaacaatggaagatagtgaaaaatggaggctttttatccgtaaatacttttaaagaaaattacgatagagtgaatcttttctatgatgatagaattagatgtatttatcaatataataaagaaaaaaatagatatcaatctgagagaatgatagatttaagttag

SEQ ID NO: 1078 - DNA, 654 bp, Unknownn
  isolated from dental, unidentified
atgtcaacatttgaacaagcatattcatggataaatctacgctttcttttagaaggattgtgggtaacactagaagtatcagtaatttcaattgttttaagctttataattggtttaattctaggagtaatcagatatgttaagattaaatatttatctgcagctgtaggctttttgattgatattattagaaatcttcctttgctgttaattattttctttacttattttggtttaccagagctaggtttaagaatgacaccaatgttagcggctgttactgccttggtagtttttgaatctgcgatgttagcagaaattgttcgtagtggtattcaagctgttccggttggacaaatggaaggtgcaaggtcaagtgggctgacctatgtacaagcaatgtggcatataattatgcctcaagcattacaaaagatgataccacctttagtatcacaatttatatctttagttaaagatacatctttagcaactatcatcgttttaccagaattactatatcatgcacagattatatatagtcaaaatacgacttacatggtaccaatgtacttaatgattgcagttatgtattttgtagtatgttattgcttgtcattggtagctagaagattagaaaaaagatacggttag

SEQ ID NO: 1079 - DNA, 1437 bp, Unknownn
  isolated from dental, unidentified
ttggagaaagagaaaatttcacaacaattatctgcgcaagtagatgttaaacatccctggcttgcgatgactagtatgttaattggggcttttgttggtatgttaagtgaaacatcattaaacatcgcccttccaactttaggtaaggtttttaatgttgaacctagttcactacaatggttagtaacaggatatatgttagttattgggattgttttaccatttttaagccttatttctaagtggtttactactcgtcaaattgttatttttgctttagctgatttcgcaattggtgctctaatttcaggttttgcaaatagttttactgttttattaattggacgtttaattcaaggtatcggaactggtttaatcctacctttaatgtttactgtcgctatgttaatcttcccaccacaaaaactaggtgcggtaatgggggttaacgccttagttattatgtttgctccagctattggacctactattactggtatcattttaggagctttatcttggagagatatcttctttatctttacagttttattagttattggtctattatttgcgattttcacacttgaaaatgttaataagattactcgaccacatgttgatgttctttctgttttaggttcaattatcggattttcatctcttgttgctggggtaagttttgccagtgaatctggttggacttcatttaaagttttaggtcttattttagttgcgataatcgttttagttttatatgctcgtcgtcaattaaaacttgaaaatcctgtattaaatctacgcgttttcagtaaagttaactttagaactggtgcgttcttagtcatgattgactttggaattatcttatcatctatgtacttattaccacagttcatccaaaatgcgatgttacttccagttgctatgacaggtatcatcatgcttccaggtggtattattaacgctttggtttccgcaatttctggtcgtttatatgatagtattggtgctaaaattcctgctactatcggattttttatagcattactcggatcaatcatgttcatttttgcatctgaaaaatcctcagttgcttacgttatcacagctcatattatcttaatgattggttgcccacttgctatgtcaccatcacaaactcatggacttaatgctttgcaaggtcctgaatcagctgatggttcaactatcatgaatacacttcaacaaattgttggtgcgatcgctactgcaattgctactagccttttaggtattggcgaagcagtttcacatagctctaataaagctatctcctttacttctggagttcattttggattctacttcactgctttcctaacaattgttggtttactcttagctttaacaattaaaggtaaaaataagagtcaagatatcgaattacattaa

SEQ ID NO: 1080 - DNA, 4356 bp, Unknownn
  isolated from dental, unidentified
ttggggaaaggagctacttctttggaaaccaataaacaagatctatttaagaaattattaagacagattaattgggaaaataaacatgggtttgaagaggtatttacgaatgcagaaattcaaaaagttgaagttcatgtagagagtaaagtttggaattttcatttacagatagaagatatactgccatatgaagtattttaccaattttatcagcaactacagttagcgtttaaagatattgccaaagttgacatcactttgcatacaaaaaatcccattataacgaatcaaaagttaggagattattggaaatgggttgtatttaatagtggtattcaatcatcatttatacaagaactttccagaagtaaagtaccatatttagataataatagagtaattttactggcagaaaatgaaattgtaaaacgttttttagtagatcaagctttaggtccattagaatcaacatatcacaagatagggtttcctaaattttcagttaatactctagttgatgaaactaaggctcaggagataattgagaatattaaagaacagaaagctaagagcgatgccgaattggctcaaaaagctgtagaagccataaagaaacaaagtgaacaaagagaaaaatctaaagcagaagttcctagtatagaagggccggtccaactaggaaagaaaatttcacctgatcaagaaattacgcaaatgattaatataactgaagaagaacgttcagttacagttcaaggctacgtgttcgacaaagaagttagagagttacgttcaggaagaaaattattaatcctggaagttacagattacacttcatcatttgtcgttaagaagttttcacgaactgaagaagatgaagcaatgttcgatgctataaattctggtgtctggattaaggtgcgtggaagtgttcaagaagataactatatgagagacctagttattaatgcatatgatttgaatgaaataaaacatgagagtagaaaagatacggcccctgaaaatgaaaagcgagttgaattacaccttcactctaatatgagtatgatggatgctactaatagcattacagaatacgtatctaaagctgcggagtggggacataaagctattgcaattacagaccatgggacgttacaggcatttcctgaagcacatgctgctgggcaaaaaaataatgtcaagattctctatggtgttgaggcaaatattgtagatgatggagttcctattgcgtataatgagcaacacaaaaacttgagagatgcaacatatgttatttttgatactgaaacaacaggtttgtcagcacaatatgataaagtaatagaacttgctgctgtaaaaatggaaaaaggaaatgttattgatacgtttgaagaatttattgatcccggtcatcctctttcacagactacaattaatttaacaagtattactgatgacatggtaagaggttctaaaagtgaggaagaagtttttaggttattcaaagaattttgtaaagattgcattattgtaggacacaatgctacttttgacgtagatttcatgaatacaggatacgaacgtcataatatggaaatgatacaggaaccttggattgatacattaccgttagcaagatatttatatcctgaaatgaagggatttaggcttaatacattagctaaaaaattgaatataaaattagaacatcatcatcgagctatatatgatgctgaagctactggttttatatattatgctatgttaaaagatgctgaagagaaacaaatattatatcatgatgactttaataagcatgttggagaaaatgatgcgtataaacacgagcatccatcgcatgcaataattttagcaaaaacacaagaagggctaaaaaatctctttaaattaacttcagaatctatggttaagtatttctatagagttccaagagtaccacgttcaattttagaaaaatatcgtgaaggacttatagtagggtctgcttgtgctgatggagaagtatttacagcaatgatgcagaagggatatacaattgctaagcaaaaagcagaattttatgattatttagaagttcaaccaaagccgttgtatgaaccattattagaacaagaattagttaaagataatgataatcttgaagaaattattacaaatatggtcaaattagcccacgaactagataaaccaatagttgctactggagatgttcattttatgaataaagaggatgcaatttatcgaaagatattaatccattctcaagcaggagctaacccattaaatagattaaaaaaattaccagatgtacattttagaactacagatgaaatgttagaagaattcagctttttaggagaagatatagcaaaagaaattgtggtaaccaatcctaataagttagtagatgaaatttcagaaattactcctgttaaagataaactttatacacctaaaatggaaggtgcagagcaagacatacatgatcttactatgaatagagcacatgcctggtatggtgatactttaccagaaatagttcaaaagagattggataaggaattaaaatctgttattggtaatggattttcggtaatttatctaatttcacaaaaattagtgtataaatctaacaaagatggatatttagtaggttctcgaggatctgttgggtcaagtttagttgcaacaatgacaggtattacagaagttaatccattgccaccacattatcgatgcccaaaatgcaagtggacgcatttttatgaaaaaggtgagtatggttctggttacgacttaccggataaagactgtcctaattgtggtacagaattaataaaagatggacaagatataccttttgaaactttcttaggttttaagggaaataaagttccagatatagatttaaatttctctggtgactatcaacctattgcacataattatacgaaagtcttatttggtgagaataatgtttatcgtgctggaacaattggtacggtagctgataaaacggcttatggctatgttaaagcttatgagagagatactgaacaaaatttcagaggtgctgaaatagatagactagctaagggagctactggagtaaagcgaactacagggcaacatcctgcaggaattcttgttgttcctgattatatggatatttatgactttactccaatacaatatccagcagatgacctaacagctgcttggcgtacaactcactttgattttcattcgattcatgataacatcttgaaattagatattttaggtcatgatgatcctacgatgataaggatgttacaagatttatctggaatagatcctaaaactatccctacagatgaccctggagttatggctttgttctcaggaacagatattttgggtgtaactcctgaagagattcaatcttcgacagggacattgggtgttccggaatttggtactcgatttgttagaggaatgttagaagagacccatccaaaaacatttgcagagttattaaaaatttcaggattatcacatggtacagatgtttggttgggaaatgcagaagaattaataaaaaatgggactgtaacaatgccagacgttataggatgtcgtgatgatattatgatggatctaattcatatgggtgttgagtctgataaagcgttcaagattatggaacatgtacgaaaaggtagaggaataccagatgagtggcaagctgatatgagagcagcagatgttcctgagtggtatatcggagcatgcttaaaaattaagtatatgtttcctaaagcacatgctgctgcgtatgtcttgatggcactaagaattgcatattttaaagtttattatccccttgtttactatgcagcatatttctcagtacgtgcggatgattttgatttggtttcaatgtctagaggaaaagaagctgtaaaaaatgcgatggaactcataaattcaaaaggaaatgaagcaacaactaaagagaaaaatcttttaacagtattagaaattgctaacgaaatgttagaaagaggtttcgattttagtatggtagatattaataagtctgatgctcagaactggactattcaagaagacggaagaacattattggcacctttcacagcaatccctggtttaggactaaacgtagctaagcaaattgttgctgcaagagaggaacaagaatttatttcaaaagaagatctaagtaagaggggaaaagtatctcaatcattgattgattttatgacagaaaatcatgtattggatgatttaccagatgaaaatcaattaagcttattttaa

SEQ ID NO: 1081 - DNA, 1197 bp, Unknownn
  isolated from dental, unidentified
atgagaaaaattattgtaattaattctggaagttctagtttaaaattcaaattatttgaatccccatctaaaaatgttttggctagtggccttattgaacgaatagggttagatgattcgattattacaattaaatatggagataagaaaaaacatcgtgaggttcaagcaataaaagatcatactgttgcggttgatttattgctacaattattaaagaaactagatatagtaactgatcttaacgaaattagtgcggtaggtcatcgtgtagttgctggtggtgaatatttcaagaaatctgttcctgtagatggtaatgtaattaagaagattgaagatattattgaattagctccattacataatcctgctaacttggttggtattaaagtcttcaaaaagttacttccaaatgctttgagtgtagttgcttttgatacagcattccatcaaacattaccagaagaaaactttatgtatagtacaccatatgattggtataaagaatacggtgtaagacgttacggagcacatggtataagccatcgttatgtatctttacgtgctgcagaattaatgggtaaacctgttgaagatttgaagttagtaacttgccatttaggtgcaggtgcttcaattactgcggtaaagaatggaaaatcattcgatacttcaatgggctttactccattaactggtattcaaatggcaacacgttcaggtgacgtggacgtttctttagtagcatatatgatgaagaagttaaaagtgaaatctgtttctgaaattttgtatatgttgaacaaagagtcaggatttttaggtgtgtctggtgtatctttggatatgcgcgatgttgaagcagctgcagctaaaaacaataagagagcagaattagccattaagttattctacaatgatattgtcaaatatattggtcagtattacatggaaatgaagggaattgacggtatcgtctttacagctggtattggagaaaattctccagaaactcgagaagcaataatgaatgaactatctttcctaggagtaacgattgataaagaagaaaatgctaaacgcgggacagaaggtattgtttctggaaaagattcaagtattacagtaatgcgtattccaacagatgaagaatatatgatttgttgtgatgtagaagcattaatgaataaataa

SEQ ID NO: 1082 - DNA, 642 bp, Unknownn
  isolated from dental, unidentified
atgcgaaattttttatcattacttggtaagattttcttgtttattgtttttatcgtgttatcacagttgccattactacttattgagagtcattattcaatggggattatcgcgccacttgttatcctctgttatttaatattaattggaattctgttctatatcgttaaacgcataaaaggtgaatcaccgtttaaaaaaatcacaggaaaaaatgttagattcatccttgcggcttatgttgtcatgattctcgctaagggtattttgttgactttaatgacaaaagtttaccatcaaacaacaagcgctaatgataaagctctaaatgctttagttactgatagaactgctttattaatgactatattagttgttgttttggtccctattactgaagaactactttatcgtggtgtgtttacgagtttcttctttaaaaaccagccattttggcaagtagctatgagtggggttatctttggtttaatgcattctagtacaaatttcatctccgctttagtttacgttacaatgggatggattttagcttatgtctatgtacatactaaaaatctttctaacagtttaactcttcatattttaaataacgctccgtttattgcggtattattcaattaa

SEQ ID NO: 1083 - DNA, 1053 bp, Unknownn
  isolated from dental, unidentified
atggacatctcagcagaacgttttggtgaactgaacggtgaaaaggtaaacaaaattacattgacaaacgataatggagtagcaatctcatgtttgacaatgggagctttatggcacgaattcttagtaccagctgcagacggtacaaaacaaaacttgattttaaactacaacacagtagctgaatactacagcaatggtttatgtactaatcaagtaattggtcgtgttgcaggtcgaattaagaatggtaagtgcgaaattaatggggaacaagtaactttaccacaaaatgaaaacggtaatactttacacggtggtcctcatggatttaatacttataactggagctttacaacttcagctaaccgtaacagcattagtgtgattttccaaaaacaagttttaagtgcagttgatggattcccaggagatatcttggtaactgttatctatactttagacaatagtaataacgtaacaatttcctttaatgcacttggagacgataaggtagatacactatttaacccaactaaccacgtttactttaacttgagtaatcgttctgacttggctagtcatgagcttaaaatcaatagtgacggatatctagaattagatgagaacctaattccaacaggtcgaattcgtcatggcgaaggtacagcttatgattttactaaaggtgctaacttatacgaagctatccaacaaaatgaaaaaggtggctttgatgatgcatttgttgtaaatggaccaggtaaagctgtagaaccaatcgctgttttacgtgatactcaatctggaaatacagtaataattgattcagatcgtaacagtttaatcatgtatacaatgaatgatgatttgccagatgttcatttcaaacgtgataatggacgtcctgctaagaagcaagaaggggtagctttagaagctcaaactttaccagatgcaattaatcaagaaacatttggagatattgtattaccacgtggggcaaagcgttcctaccacattaagtacacatactccaacgataaaaattaa

SEQ ID NO: 1084 - DNA, 1902 bp, Unknownn
  isolated from dental, unidentified
atgttatacttgtatagaaaaaatttaagattagaaggtattactatgtcagtttcatttttaattgttacactggcggcttttatcacacctatggttttagcaagattcaaagtatcttttcttcctacttcggttgctgaaattattataggtattattattggtaaaagttgtttcaatttaattcatgctgatacgctcttgagttggtgttcaactttcggggttatactattaatgtttttaagtggtatggaaattgattttagcttatttaagaagaattcacacaccttatccccgttagaagcaaagatggcagctaatgagcctaaaacttcacctgttagagctgcaacttatgcatatgctttttctttagtcgcatcgctaattttagccttgttatttaaagttacaggcttattctcagatgttggtttagctactattttatttagtactgtttctttaggaatcatgacttcattattgaaagaaaatgagttactaagccgtccattcggccaaactattcttttattctctgtattaggtgaagttattcctatgattgctttaactgcctattcctctatctatgcaggaaaaggtgctagtttatggttgattacattgctatttatagctgcagcattcttattcaatcgtttcagacacttcttctcatcctttgataaaatcaataaagcaactacacaaattgatatgcgtcttgctttctttgttatcattgccttagttttagtagctgagacagttggagctgaaaatattctcggtgctttcgttgccggaattgttttgaaattattagaacctgctgaagaaacagaacatcgccttgatgcaattggatatggtttctttactcctttcttctttattttaacaggggtaaatttagatattccatcattgatgcgttcgcctaaaacattattattaattcctttattctttgtagcctttatcctcgcaaaacttccaggatattttggtttcaaaagacgttttagtaaaaagaactcctttgttggtgctgttgcaacaagtactactatcacattagtagtaacaaccttaaagattgctgaacacttacatgctataactccacaacaatctggtgcttttttacttgctggaattcttacttgtatcgtaggacctgttttctttaataaacaatataaacctgaaccagaagatcaaaagcaaacatcattgcatattattggtgtaaatttagttacagtatctgctgctcaacaactttctaaaggaatgtatgatgttcaaatgtatacagataattctaagaattttacaacctacaattctcaagctaatgtacatttcttagattctttagatcctgatgagttaattgctaatcatatttttgatactgatattctcgttttagggtatgctgattataatgttaattataaattatctcttgcagctaaaaagtatggtgtaaatcgtgtcattgttcgttttgaaaatcgtaatccacttaatgatatggaagatgaacttaaaaaagctggtattgaatacttcagttatttcgatatcaatgtaggtatgatgcgttcaatgattgatagtccatctatgctacaaattcttacaagttctgaatctcgtttatatgaagtggtagttaatgattcaatttttgttggagttgaagttaaagacttaccacatattgataagattacaatcagtagaatttatcgtaatggacatgctattgcacctcatggttatacgcaattacaattaggtgatcatattatcttctctgctagtgctgaagaaagtgcttatttcagacgtaaacttcaaagaaagaatgaatag

SEQ ID NO: 1085 - DNA, 1935 bp, Unknownn
  isolated from dental, unidentified
atggaaataagaaattcacaaagtaaaagtgagaagattacttctcgtattgcatatacctttggtgcctttggtaacgatgtgttttatgcagcgatgtctacatatttaattaatttcattacatctcatttgtttgatacaggggataaaacgttaaataaccatttagttagtgctgttacattgattatcatggttttacgtattgttgaattattaattgatccatttattggtaacgctatcgaccgtaccaagactcgctggggacactttcgtccttgggtagtaattggtggtactgtttcatcaattgctttattggcattattctcaaatatgggtggtttaactaaaacacatccatggttatatttagtaatttttgcatttctttatattgcaatggatatattctattcatttaaagacgttggtttttggtctatgttgccagcgctatcatttgattcaagagaacgtgaaaagacagctacctttgctcgtatcggttcttcaatcggtggttcattagttggtgttgttgttatgcctcttgtattattcttctcccttcaaagtaatggaggaacaggtgatgacagaggttggttctggtttggctttattgtagctgcagttgcttttgtaacagcgttagcagttggtattggaacacgtgaagttgacaataaattacgtgaaaacaaagaagatacagctggtgtaagtgcagttttcaaaatgttagttaagaatgaccaattaatgtgggtagctttggcttacttactatatggtgtaggaattaacttagtaaatgctctagagctttactacttccaatatattatgggggatccaaaaggtttcagtttactacaatttataaacatgtttgtaggtatttttgctgtaagtgcctttcctaaattagcagataaattaaatcgtaagccattatttatttggtgtttagtaactatgttaattggaatcggtttatttactgtcgctggcaagagcttattacttgtattgattgccgctgaattattctacattcctcaaccaattgttttcttagttgttttaatgattattactgactctgttgaatatggtcaatggaagttaggacatcgtgatgaatcacttgctttatcagttcgtcctttagttgataagttcggtggagctgtttctaacggtgttgtaggacaaattgctgttttagcaggaatgactactggtgcaactgctgcttctatcactatgcatcaacaaatggtcttcaaatttatgatgtttggtgttccagcaatcttcattttaattgggatgtttgttttctggaagaagattactttaactgaagaacgacatgcagaaatcgttgcagaacttgaaaagacttggggcgatcaatttgatcaatctaatgcagaaagcgataagttaattaagtctgacgaattaactgcaatggttccagtagcaggtaaagttattgctatgaaagatgtacctgatgaagtattttcaacaggtaagatgggacaaggtattgcaattaaacctacagatggtaaagtatatgccccatttgatgctgaagttaagacagtctttgcaactcgtcacgctattggtttggtttctgataacggaattccagttctaattcacgtaggtattggtactgtttctatgaagggtacaggttttgtaacatatgtcagagaaggacaacatgtcaagaaaggtcaacaaattcttgaattctgggatccagcaattaagaaagctggattagatgatacagtattaatgacctttacacattcagatttatttaaggaatttgatgtgaaagtaccagttggttcagaagttgttaatacaaatacagctattgaaataaagaaatag

SEQ ID NO: 1086 - DNA, 2493 bp, Unknownn
  isolated from dental, unidentified
atggctatggaagaaaggtatacaccaagtgctaaacaagtattagttcttgcacaacaacaagctaattacttcaagcatcaagcaataggaacagagcatttgcttttagcactaacaatggagaaaaatggcgtagctgctaaagtattacaaagttttgtagtaactgaagtagatgtgcgagaagaaattgaacatatcgtaggatacggtaatttacaacgtagaggcgctgatacttatttaccatattccccaaggactcgttatgtattagagcgtgctagagaacatgctaaactttttaatgttgaaaaggtaggaacagaacatattttgttagcattattagaagatgataaaactatttcttcacgtattctagcagctctgaatattgatttacgtaaggtgaaaaatattacctatcgtacaatgggtgtagatgcaacaacagctaatagaacacgtaagaaattagcgttatcagaaaagaaacaggataatggtacacctacgttagatgaattagcacgtgatttgacagaaatggtgcgtaaagatcaaattgatccagtagttggtagagataatgaaattaagcgtgttgttcaaattttaagtagaaggacaaagaataatccagttcttttgggagaaccaggtgtaggtaaaacagctgttgcagaaggattttcacaaaagattgtaaatggtgaagttcctgataatttgaagaataagcgtgtaatgatgcttgatatgggatctttggttgctggaacaaaatatcgtggtgaatttgaagatcgattaaagaagattattgaagaaattcgtgaagatggcaatgttattttattcattgatgaaatgcatactctaataggcgcgggtggtgctgaaggcgcaatagatgcttccaatattttaaaaccagcattagcgcgtggtgaagtacaagtaataggtgcaacaactttaaatgaatatcaaaaatatgttgaagctgatgcagctttggaaagacgctttgctagtgtgacaattaatgaaccaactccagaagtagcgttgacaattctaaaaggattacgtcctaaatatgaaaaacatcatcaacttcaaattacagatgaggcattagagagtgcagttaagttaagtaaaagatatattgcttcaagatttttacctgacaaggcaattgatttaatggatgaggctgctgctagagtaagaattaataattcacaaaaagtggacaaagtttctgcaataaagaagaaattatcagagctttcccaagagaagacagaagcgttgttaaaagaagattttgaaaaagctgcagaaatcagaaatgaagaattaaagattcaagaaaagcttgaaaagcaaatccaacgtgacaaagatgaagaggatagcaataactatcgtgtaaaagttacggctgaagatattgcagaagttgtttctgaatggactggtgttccagtaactcaaattaatcgttctgaaggagaccgactaattagattagaaaagatattgcataatcgagttataggacaagatgaagctgttaaagcagtaagtaaagcgataagaagagcaagaagtggtttgaaggatcctacaagaccaattggctcatttatgttcttaggtcctacaggtgtaggtaaaactgaattagctaaagctttagcagaagctatgtttggctcagaggattcaatgattagaattgatatgagtgaatatatggagaaatacacaactagtcgtttaattggatctcctcctggatacgtaggatatgatgaaggcggacaattaactgaaaaggttagaaataatccttattcagtagtattattagatgaagttgaaaaagctcataatgatgttttcaatatcttgttacaagtattggatgatggatttttaactgattctaaaggtagaaaggtagacttcagaaatacaattatcattatgacatctaacttaggtgctacagccttacgcgatgaaaaatcagtaggttttggtgcaaaagatgtcagcgatgattatgaagcaatggcagcaaaagttagagaaacattgaagaagacttttagaccagaattcttgaatcgtcttgacgaaactgttgtattccattcgcttaataaagaagaaattcatcaaattgttaaattgatggctaagaatattatagataggattaaagaacaaaatattaatctgaaaattacccctgcagcaatagatatagttgcagaagctggatttgatgctgaatatggtgctcgtcctattagacgtgtccttcaagataagatagaggacttactaagtgaagaattattagcaggtaatatcgaaactggagcaacagtaacaataggtgctaaaaaaggtgaaataacgataaaagttaagaatccagtagctgcagaaaaaataaatagttaa

SEQ ID NO: 1087 - DNA, 681 bp, Unknownn
  isolated from dental, unidentified
atgaacaataatgattcgattcgtataagtgttggtggagatacagtctttgttaataaggatgattttaaagtaggtaatagagaatcaaaaaataagcaaagaagacgaaaaagaggccctcgtaatccacaacctaaagaatggttagcaagtaatttaagtcaaatgaagattgcagattataaaccatttaattttgttgatggtgaaggaattagatgtagtctatatgtcagtgggtgtatgtttgcttgcccaggttgctataataaagctgctcagaattttaattatggaaccccatatacccaagaacttgaagatcgaattattaaagatttaggtgagagctactgccaaggattaactttattaggtggggaaccatttttaaatacgcaggtttgtttgaaattagttaaaagaataagaaaagaatacggtcacgaaaaagatatttggtcttggtctggttatacttgggatgagttaatgcaagaatccgaggataaattagaattgttatctaatttggatattttagttgacggtagatttgagcaagatttgatggatttaactttacaatttagaggaagttctaatcaaagaattattgatgtacaaagatcacttaaagaaggccaagttgtaatttgggataaattgacgaaataa

SEQ ID NO: 1088 - DNA, 1434 bp, Unknownn
  isolated from dental, unidentified
atgaattttgagacgactgtaggtttagaagtccatattgaaatgcaaacaaattctaaggcatattcaccttctcctgttcaatatggtgctgaacaaaatacaaataccaatgtcattgattggggttatccaggtgtcttacctgaaataaataagggtgctttagaatttggaatgcgtgctgcattagcatttcattgtgatatcacacaagatgttggttttgacagaaagaattacttctatcctgataaccctaaagcttaccaaattacacaagctcgtacaccaattggtactaatggttggttagaaatcgaacttgagaatggtaccaagaaaaagattggtatccgtgaaatgcacgttgaagaagacgctggtaaaaacacacacaatccagatggttactcttacgttgacttgaatcgtcagggtacacctttgattgaaattgttgcagaacctgatatttctagtgctgatgaagcttatgcatacttaacaaaattacgtcaagttatccaatttacaggtatttcagacgtaaaaatggaagaaggttccatgcgtgctgacgttaacgtttcaattgcaccaatcggatctgacaagcttggtgttcgtactgaaatgaagaaccttaactcatttgaacatgtacgcaaaggtattcaatatgaagttaagcgtcaagaacgtttattgatgtctggtggagaagtagaacaagaaacacgccgttttgatgaaccaagtggtgaaactattttaatgcgttctaaggaagaagctaacgactaccgttacttcccagaaccagatctaccaccaattcatattagtgatgattggattgaagaagttcgtgcatctattccagaaatgccagataagcgtcgtgaaagatatacacaagattggggtattccagcttatgacgcaggtgtccttactcaaactaaagaaatgtcagacttctatgacgcaactgtagctgcaggagcagatcctaaattagcagctaactggttgatgggtgaagttaatgcttacttgaattctaagcaagtagaattaagtgatactgctttaactccagaacatttggcaacaatgattaaattaattgaagatgaaacaatttcttctaagattgctaagaaagtattcaaagaaatcattacaaatgatactgaacctaaagcttgggttgaatccaaaggtatggttcaattatcagatccagctaagttacaacctatcattgatgaagttcttgataacaacgaacaatctatcgaagacttcaagaatggtaaggatcgtgctattggtttcttagtaggtcaaattatgaagaagactcgtggtatggctaaccctaagatggttaacaaattattaatggctagtttgaaggaaagataa

SEQ ID NO: 1089 - DNA, 933 bp, Unknownn
  isolated from dental, unidentified
ttgcaaacaagaacacatttaaaaggggttatttatgctagtttagctggtattttctggggaatggctggaattgcctctgagtatctatttcaggatcaacacgtttcagtttattggatgatgggtgtaaaaatgagcttgtcagcattaactttactgggattggcttactatcttgatggtaagaaaatttttctagtctttaaaagtttcaaggatattttgggaattgtcttattctccattttaggcttggcaggagtacaatttacttattcaatgactgttaattatagtaatgcaactgtcgcaaccatcattcaaactttagggattcttcctgttatcttttattcagctattatttttaaacaattacctggtagaaaacaatggattgcgactattactgcccttattggtgcttggttattggttaccaagggttcttttaatcaacttgcgatctcaaaagaggcaatcatttggggaatttttctgatgttaactcaggccggaaattctgtcttgccagttgatcttttacgtcgacataatcctactactatcagtgcttgggcgatgctagttggtggtattgtctttgaatttattcatccagtatggaagtctgttcctaaatttacgcctgcagttactttaaatatgcttttcttgatttttatcggaactactttatcttactacctttttgtaaaaagtctgcatctaattagtgctactgaagcaactttattagacactttcgagcctttaactgctgctttactagactttcttatctttaaaatgcagtttaactgggctgaaatcttgggtagcttgctagttattagtactgtcttcatcctggctgttggatcagaagaaaataaaaacagcgatcctcaaaaagaaccgctgaaataa

SEQ ID NO: 1090 - DNA, 834 bp, Unknownn
  isolated from dental, unidentified
gtggggatcaaaaaattcaaaccaaccactaacggtcgtcgtaatatgactggttctgattttgctgaaatcacaaaaacaaagcctgaaaaatctttgttagtttctaagagcaaaacagctggtcgtaacgcttatggccgtatcacagttcgtcaccgtggtggtggacacaaacgtaagtatcgtttgatcgatttcaaacgtgttaaagataatgtacctgcaactgttaaggcaatcgaatatgatccaaaccgttctgctaacattgctttgcttgtttatgctgatggtgttaaatcatacatccttgcacctaagggcttgaaagtaggccgagttgtagaatcaggtaaagatgttgatatcaaggtaggtaacacattaccacttgcaaacattcctgttggtacagttattcacaatatcgaattaaaaccaggtaaaggtggacaattagttcgttctgctggtacatcagctcaattacttggtaaagaaggtaagtatgctatcattcgtttaacttctggtgaagttcgtatgattcttgtaacttgccgtgcaacaattggtgctgttggtaatgaacaacacgaattaatcaaggttggtaaagctggtcgtgctcgttgggcaggcaagcgtccacaatctcgtggttctgtaatgaaccctaacgatcaccctcatggtggtggtgaaggtaaagctcctgttggtcgtccaagtcctatgtcaccatggggtaagaagactacaggtcttaagactcgttctaagaaagcaagatccaataagtttatcgtacgtagccgtaacaagaaataa

SEQ ID NO: 1091 - DNA, 987 bp, Unknownn
  isolated from dental, unidentified
atgttaattttaaaaaaagatgatataaaaaagtgttttacaatgagagatgcgattgaagcagataaagaagctttagagatatattctgaaggaaaagctaaggtgccattaagaactaatattgatatagatgaaaaaaatggacaaaatctttatatgccagcttatgttggaggaaaccaagctgctgctggattaaaaatcgtttctgtttatcctgataatatttctaagggtttaccaagtgtgccagcgacagtaataactttagatgctgatactggagaattaggtgcggtaattgaaggtacttatttgacacagttaagaacgggtgctgttcaaggtgcagccacagagttattagctagaaaagatgctaaagttggagctttgatagggactggtggacaagcagcaacacaactagaagcaatgatagaagttagagatttagaagaaattagaatttttgatatagattttagcagggctaaaaagtttgctgaattaatggcagataaattcaataaaaatatttatccatgtcaaactgctaaagaatgtgttgaaaatgccgatattattacaacagttactacttcaaaacgtgcaactttcaatgatgaatgggttaaaccaggagcacatattaatgggattggagcatatacgccagaaatgtgtgaaataccatgtgaaacaataaaaagagctaaaaccattgtttttgatacccttgatggagtttggcaagaagctggtgattttattcaaccattaaataaaggtgaaattagtaaagatatgattactggtgagttaggacaattagtggcaggaaaaataaaaggtagaactagtgatgatgaaataactatttttaaaacagttggaacagctgttttagatgtttatattgcagataagattgtaaaaaaagcacaagctaatggatatggacacgagtttgaattaaattaa

SEQ ID NO: 1092 - DNA, 1842 bp, Unknownn
  isolated from dental, unidentified
ttgaaaagacgtgaagatattcgtaacgttgcaattattgcccacgttgaccacggtaaaacaaccttagttaacgaattacttaagcaatcagatacattagatgaacatactgacattggcgatcgtgctttggattccaatgatcttgaaaaggaacgtggtattacaattctttccaagaatacagctgttaagtatggagataaacaaattaatattttagatacacctggacacgctgactttggtggagaagttgaacgtatcatgaaaatggttgatggtgtacttttaattgttgatgcatttgaaggtactatgccacaaactcgttttgtattgaagaaagctcttgaacaacatttaacaccaattgttattattaataaaattgaccgtccaggtgctcgtccagaagaagtagtagacgaagtattggatttattcattgaattaggagcagatgaagatcaattagatttcccagttatctacgcttctgcaatgaatggtacaacttctcttgattctgatcctgagacacaagaacatacaatgaatccaatttttgatacaattatcaatacgattcctgctcctgttgataactcagatgaaccacttcaattccaagtggcaatgcttgattataacgaatttgttggtcgtgtaggtattggtcgtgtattccgtggaaagatcaaagttggtgatcaagtaacagttatgaaacttgatggttctcaaaagaacttccgtgtaaccaagttatttggtttctttggtttgaaacgcttggaaattcaagaagctaaagctggcgatttaattgcagtttctggtatggaagatattttcgttggtgaaactgtatgtcctgttgatcatccagaagcattaccattgcttcgtattgatcctcctacattacaaatgacatttatgactaacacatctccatttgttggacgtgaaggtgataatgttactgcacgtaagctagaagatagattgaaagttcaacttcatactgatgtttcattaaaagttgaagatacagaatctccagatgcttggactgtatcaggtcgtggggaattacatttatctatcttaattgaaacattgcgtcgtgaaggattcgaattagctgtatctcgtcctaaggtaatctatcgagaaattgatggtaagctttctgaaccatttgaaagtgttgttattgatacacctgatgaatattctggtgcggttattgattctatggctcaacgtaaaggtgaaatgttgaacatggaaactggtaataatggtcaaacacgtttagaattctctacgccaacacgtggcttaattggatacgattcacaattcttgtcaatgactcgtggatacggtattttaaaccatacattctctgaatataaaccagttattagaggatgggaaccaggtcgtcgtaatggagcattagtatcaattaatcaaggaaaaacaacaacatatgcaattatgggtgttgaaggtcgtggaactatttttgtagatccaggtacagaagtttatgaaggtatgattataggtcaatcttcacgtgaacgtgatatttctgtcaacgttacaaagggtaagaacatgactaacgttcgttctgctacaaaagaccaaacagcaacaattaagaaaccaacacatttgacattggaagaatctctagaattcttgaatgaagatgaacttctagaaattacaccagaatccatacgtttacgtaaacgtattttggaaacaaatgcgcgtgaaaaggctgctaaaaaagctaagaaagcaacagaataa

SEQ ID NO: 1093 - DNA, 423 bp, Unknownn
  isolated from dental, unidentified
atgggcgtcagatacctctataccactctcaattcagaacgcattatcgccgacactgacacgttcctccacgaaggaagcaaggcatggccagactgtaaggccaagcttgtgggttccgacacccttaagaccgacgccgacattgtgcttaacccagatggagcgtccacggttatcagtcacttcaggcatggtcagctcatatctgtgagcggggcagactttgaggaggctgcagacattgccgtttgggcgcgatctcttaacccggaccccagtttggtgttatggttcactacgaacgtcttcgatgggcacaccgttctgactcctggcatcacaccccagcaggtcattgagcagtgggtggatcatcgtgagcatgacccctatgtggagtaccccgaatacttctcctga

SEQ ID NO: 1094 - DNA, 807 bp, Unknownn
  isolated from dental, unidentified
aagtatattaattattgtatatgggaaggaagtgtgggactaatggcaacaagagcagaactaaaaaatgaagtaaaagatgcttttcgtggaaattggaaaaaagcgataggattatcaataataccaattgtatttacagtgataacagtttttacagtttctatatttttacaagtattattgttagtgatacgaaacaatccagcaacatttagtgatgttcccaatgatgtagctgctaattcaactggaaatggtggaacttatagtaccaatattgtttcaagcattattggaattatgatttatctagggattcaatatacctttttagattggcttcgtggcaaaagcgtggaaagtatcaacaattttagaagcatgttccaagtgttttctaaaagatattttattccagtattagtgatgtatattatccaatgggtattacaattcctatggtcattacttttcattattcctgggattattaagggatattcatactcacaaacttactttatctacaaagatattgaagctagtggtgcaaaagccaattataaatatcctgattatgtaactttaagtagagaattgatgaatggacataaatgggaactattcctattggatttaagctttattggctggcatattgtgtcaattcttacatttggattaggttatatttggttaattccatatatgagcgcaacaaaagctgcattttatcgaaatttagctggagataaatttttgaaacaagatagagtttatgatgctgaatttaaggaaatgtaa

SEQ ID NO: 1095 - DNA, 954 bp, Unknownn
  isolated from dental, unidentified
atgaagggactaattgatatgcgtaaatacttattaaaacgtgttttgtatatgctattaacattgttcctggttgcgacaatcacattcttcttaatgaaattgatgcccggaacaccatatacgaaccaagctaaaatgacagcttcacaaattgaaataatgaacaaacaatatggtttggataaacctatttgggaacaatacttgatttacatttttggtatgttccatggtgattttggaacttctttccaatatagtaaccaaccagtagcatacttaatttctagtcgtttaggtgcttcaatgcaactaggtttacaagcaatgatcttcggggttttcttcggtgtaattctaggtgcagctgcagctatcaagcataatacatgggctgatacaggagcaacagtatttgcgattattggtaaatctgtaccaaacttcgtgttagctattttgttacaatactatatcgctttgaaattgggctggttcccaattgcaggttggggtcaattctccaatacgattttaccaacaattgctttaggggtaggaccattagctgaaacagctcgttttatccgtacaagtatggttgaagtattgaactctgattatattgaattggctaaagcaaagggcttaagtaaatttgaagtggtttatcaccatgcattaagaaacagtttgattccattagttacattattaggaccttatacagttgctttgatgacaggttctatggttatcgaaaatatctttaacattccaggaattggggaacaatttgttaagtcaatcatgactaatgattacccaactattatgggggtaacaatggtcttctcaatcggattggtagtagttattttaattactgacatcatctatggattgattgatccacgtattagacttgaaggaaatggagggaataagtaa

SEQ ID NO: 1096 - DNA, 696 bp, Unknownn
  isolated from dental, unidentified
atggatccgcaaatgtatagggattgggtatcttattttgatagatatgaatttgaaaaaaatagtaatattttagatttagcatgtggttctggaagatttgcagtggaaattgcaaagaagggctatgatgtaaccggatttgatttatctgaagaaatgttgtcattagcatatcagcattcatatgaagaaaacatagagttaacattagttgctggtgatatgcaagatttatcaggtctagaaaaatataatgttgtaacttgttttgctgattctttatgttatttacctaataaaagaatattaaagaatgcatttagagaagtgaaacaacatttaaaaaaagatggtgtttttttgtttgatgtaataacgccatataagactgataaaatatatccaggatatatgtataattacagtgatgatgagcaaacttttgtatggacaacatacttaggagaatatgaacatagtgttgaacatgatttaacttttttcatttttgatgaaagtattaatgcatataaaaaagttaatgaacttcataaagaaagaacttacgaattaagagattatattgaattgctgaaagaagctggctttaatcagatagaagtaagtgccaaatttggacgtaaagatatagaaaaacaaactgaacgttggttctttaaatgcagtatttaa

SEQ ID NO: 1097 - DNA, 1803 bp, Unknownn
  isolated from dental, unidentified
atggctttaccaaaaagaagtgaagttccagttaatgaaacatgggatttaaccgctatttatccagataaaaaagcttggaaagcagatatggtagcagttagagaattagttacacaatttcaaaataactatcgttctaaattaactgaggctaaaattattattgctgctttacatgatttagaaactatctatcaaaagcttagttggattgaacactatgctttcctacctcaaactacagatatgacaaatcctgaatacaatcagatgctagttgaaaatgataatttacaagctacaattacagctgatttgtcatttttcaagactgaagttctaactaatccagtgtctttacttgatcaagttgcagaaattgaacctcaatttgctcctgttgttcgtcattggaaagttgaaaaaccacatcaattatcaccagaagtagagaaaactttagcgacattaagtcctacacttaactcgtctgagcgtatctatactacagctcgtgctgctgattgggatatggaagattttgaagttgatggcaagacttatcctatgtcatttgtactttatgaaaatacttatcaatatcatccaaatcctgaagtgcgtcataaggcacaccaaattttctctgatactttgtgcaaacataaaaatacagttgccgctaattattacactcaagtaagcaaggaaaagaaacttgctgatttacgtggctatgattctgtttttgattacttgttatcagatcaagaagtttcacgtgaaacatttgaccgacaaattgatgttattatcgacgaacttggtcctgttatgcaaaaatacgttaaacttttacaaaaagaacatggcttagacaagatgctttactcagatttacaaatcgacttggatcctgaattcgcacctaaagctgatttagaatctgctactggctatattagcgaagctgtttccgtacttggtgaagattataaaaatgcgattttgaaagctttccctgaacgctgggtagatttccctgccaatgccggtaaagaatctggtggctttgaaacaactccatacggtcttcatccttacatcttgatgtcttggactggcgttttacctgatgtctatactttaattcatgaattaggacacgctggtaactttattaagattaacgaaaataattcaatcttaacaagtgaaccatcattatacttaatcgagtctccttctacttttaatgaattattattaactcattcattggaacaaaagagtgatgatcctcgcatgaaacgtttcgcatatactacgatgctaacaaatacttacttccataactttatcacccacttattggaagcagcttttcaacgtgaagtttatactttagttgaaaatggtcaaacttttgatggtgataaacttactcaaattaaaatggatgttcaaaaacgtttctggggcgatgctgtagatattgacgaaaatgctggtctaacttggatgcgtcaatcccactactacatgggattatattcttacacttattctgctggcttaacaattgctactcaagcttatctaaaagttttagaagaaggtcaacctgctgttgatcgttggttagaatatatctctctaggtgatcaaaaggcaccaatggatgcagctaaagttgctggagttgatgttactactgcagaatctttgcataatactatcaagttcttaaacgatacggtcgataaagttattgcattaactgaagaattaaatcaataa

SEQ ID NO: 1098 - DNA, 1011 bp, Unknownn
  isolated from dental, unidentified
atggatatcacattttcgtttataatacctacatataattcgaaaaagacaattattagggcaattgaaagtgttacgaaacagctagataaatcagaatacgaaatcatcatagtcgatgatggttctcaagatggaacggttgaattagtccatgattttatgaaagataatggtaatattcattttactagtacaatcggtggtgtatctttcgcaagaaataagggaattaatcaagcgcaaggtgaatatctcttatttttagattctgatgattattatgtagaaggatcattaaataatttaaaaaatatagttgcacaaagcaatagtgatttggtgatattcaactttgaacatggcaatgctccaatattactagcagaagtacctaatactagggttgaagctttatctgtaatgttgagtaatccaaccaaatatatgacggtttggggaaaagcctatcgaactgaaacagtacatgagaacaatgtaaggtttaatgaagatttgaaattatcagaagatagtgagtttttagtaagatatgtgcaaaaatgtaagaagataacctctgataatacaattttgtaccattattcaatcgataatgtttcagtaatgagagggaaaaacaaacaaagtaagattcctggatatttggagtctttagaggttgtacaaaaggatatcttcaataatattcccgaattgaaacaagcattttatcaatatacagtaattcaaatgaatatcatgatggttagagaaatatttaactatggtgataatagtaactatagttctaaagtacgtaaatctgacgaattattaaaaaataaaacaattaatgaagctattaagcaaatgaaattaagggattgtatgtcaccaagatttttaccagtatttttcattaaaatgggaatgctacctctggctagattgatgtttaggttgcgaagttggagtaattataggaaggaatcgagtaaagctaaatag

SEQ ID NO: 1099 - DNA, 627 bp, Unknownn
  isolated from dental, unidentified
atgtttgttccacaaaataagtatagaccttttatcgcatctatttacttagctttatttctaattttattaatcttagttaaaactaacagcacaatcgttacatcatttgataaatttgtacagaacttacttctacccattaccaatcctactaatacaagaattgttgaaaaaattacttatctaggtggccctagaattgccgcaattctttcaattatcgttagtctatatatgttcattagacataacttcaaggctggaatttggtcagccagcaccttggtaattggaaatcttatcaatgtactagctaaaaatttaatccaacgtccacgtcctagtgataaattagtcgcaattggtggctatagttttccaagtggacatacctttggaactgccttatttatctttttcgtagtatttttaattgttcctcaaattaaggatgttacgttaagacgaattctaaccttcctaggtttcctttggattcttattatcgccttaacgcgcgtatatttacatgtacattatcctactgatactattgccagtgttttattagtcctatttttatgggaaagttcacttataatctggcgtagaatcagtgattaa

SEQ ID NO: 1100 - DNA, 1263 bp, Unknownn
  isolated from dental, unidentified
atgacttatattaaaaatgtaaatagattgataaaaaaatcacaattaggtgggtggaaagtcatgaaaaaacaaaattatgctggcgtcgctgccagtgtttatatcaactttgctttagttggtatggcaacaatcatcatttcacaatacagttcttatttccaaaaagcgtggaatactgatgttaaaggtatctcaactgtactttcagttgttggtatcggccgtatcttaacaatcttatttgccggtgttatttcagataaaattggccgtaaaaaaaccatgattatcgcaatcacttccgatattattttcttattaggtgctgcatttgctcataatctctttatggcttgtgttgctgctttattctttggtgttactaactcctttggtgattcagcttgttacccagccttaacagatgctttcccagaaaaatcagctacaatgaattcattggttaaagctgctatgtcattgtgtcaattcttgttcccattctgggtagcttctgtttcaaatgctagattaactgcaattattttagctgtcgcattattcttagatattttacttgttatgtggacaccatttgctcctcatgatgaaagcaaaaagactgaaccaaaggctgaagttaagcaagaaacaacaactgtttcatcagctaaccaaccaaaaatggcaattgatggttccctaatcatcgctctaggttttacaatttgtttcactttctacgtattctcacaatatattccaaactttggaatcaacgtattaggtgttgcacctgcaactgctaaaactctattatcttggtacgcaatgtcatctatgatttctgtttttgtgactgctattgttgttacaaaagttaagcgtttaactttaatcttactttactcaacattatcagcacttggcttattattgatggtactttcaccatctctaatgactgcacgtatcggtagtatcgcagttggtttcttcggtgctggtggtatctggcaagttggtctatctgtattaacaagttactttcctactggtcatggtaagttgacaagttactatagtttcatggcttccttgacatacttcttaggacctttgttatccagtttcgtaattagtgacactgcagcaagtgtactaagtgtattctggattacagcagtcgatactatcatcactgttgttgtaacacttctacttattcaacgtagtcgtaaatttgatgttaaataa

SEQ ID NO: 1101 - DNA, 933 bp, Unknownn
  isolated from dental, unidentified
atgaatagtgtttcagtagctaacttggtagaagctattaacttaactgtttattctggagaagaatatctagaagaaaaaaagattactacaagtgatatctatcgtcctggtctagaacttacaggatattttgaatattatccagaagaacgtatccagttatttgggatgacagaagtctcatacgctcatcaattgactgaaaaagatttacaagatgttgcggaaaaattatgtgcttcaaagacaccttgtttagtaattgctagggatctaaaggtgccagcagaattagaaaaatcagcggaagccaataatattccgattttattatctagcttaccaacaacaagattgtcatcaaaaatgacggattatcttgaaggaaagttagctgagcgaagagcaatgcatggagtactagtagatatctatggcttaggtgtcctaattactggagattcaggtgtaggtaaatcagaaactgcacttgaattaataaaacgtgggcatcgtttaatagctgatgatagggtcgaagtatggcaacaagatgaacaaactgttgttggtgaagcaccacaaattttgcgtcatttattagaaattagaggaattggaatcattgatgtcatgaatttattcggtgctggtgctgttagacaagacacagatatatcattgattgttcatcttgaaaattggagtaaagataagcaatttgatcgtttaggttcaggagaacaaagtcagcaaatttttgatgtatcagttcctaaaattactattccagtaaaaattggacgaaatttagctattattattgaagccgcagcgatgaatttccgtgcaaaaacaatgggatatgatgcaactaaagcatttgagagaaatcttaacaatttaattaaagagaattcagaaaattag

SEQ ID NO: 1102 - DNA, 1290 bp, Unknownn
  isolated from dental, unidentified
atggcaacattaattaaaaatggaaatctttaccaagctggaagaatttatcaagctgatgtcttaattgaagatggaaaaattaaggcaattggtaagaatttatcagatgtagtaaaagaaaatttagtagaaattgacgcaactaataagctagttgcaccagggttagttgatgttcatgttcattacagagatccaggttttacatataaagaaactattcatactggaagtttagcagccgcacatggtggatatactacagtttgcgcaatgcctaatcttgatccagtacctgatacacctgaattggtagagaaaatgtgttcccgcaatcaagaagatggtgttgttaaagttaaacaatacggttcgataactcatggtctaaaaagtgaggaattagttgattttgatggaatgaaaaaagctggtgcatttgcttttagtaatgatggatctggtgttcaaactgctggaacaatgtatcaagcaatgaaatcagcagctgctttaaatatggcgattgtagcacatgtggaagataattcattattattcggtggtgttatgaatgcaggaaagagagctgaagaattaggattaccaggtatcctaggaattagcgaatcttcacaaattgctcgtgacttacttttagccaaagagactggagttcattaccatgtatgtcatgtatctactaaagaaagtgttgaattagttagattggctaaacaacataaaattaatgtaacatgtgaagtatcgccacatcatttactactagcagatgtcgatattcctggaaatgatccttattataagatgaatccaccattaagaggtgtagaagatagacaagctttaattgatggtttgttagacggaacaattgatatgattgctacagatcatgctccacatagcattgacgaaaaaactggtgatatgcgagaggcatcatttggtattactggtagtgaaacagcatttgcaatgttgtataccaaatttgtcaaaacaggaatcttcacactggaacaattattacaatggatgagtattaatcctgctgaaaaatttggaatggaagatgccggagaattattaccaggaaagagtgcagacttagcaatctttgatttaaataaagaatatgtcataaaagaggaagattatttatctaagggaataaatacaccttttacaggcgaaaaagtgtatggtcaaacagttttaactatggtagatgggcaaaaagtataccaaaaggaggaaaaataa

SEQ ID NO: 1103 - DNA, 471 bp, Unknownn
  isolated from dental, unidentified
atggacaaagaaaggagcaatgacgtgttttttcaaaatacagatggtaaaagagcgatggatgatatccaaattggaatcggagatatgagtaagtccaccggggtttcttcgcgtcaattaagatattgggaagaaaaaggatatattaaatcgatcaatgaaggcgatggaaacaaaagaaaatttacaattaatgaatattatcatattagattaattaaacatttcttagatgaaggctatactttgaacgcttcaattgaaaaagctgaggagcgcagacaacagttattagttttacgaagatttggtgttgaaattatcaaagacgttgaggtaacggataaagataaacattatggtaaaattgatttaggaaaagtatgtaacgatgaaaataaacatgcttatggaatagtaactgaggatggttgttcaatagaaattgaaaaagaaggcgaagaataa

SEQ ID NO: 1104 - DNA, 1392 bp, Unknownn
  isolated from dental, unidentified
gtgatttttattaagaagggaactaaatggctagctgcaggtttaggcgctgtggtccttatctgtggtggctcattcttctatcaaaagcaacatttcaatcgtaatattgaaattaatggtgttaaagttggaggaatgtcagttgctaaagctacgcaaaaacttaaaacaactaaattaaataacaatgtatatctaggggaaaaattacttgttaaaggtagtgactctaccaattcaactaatgctgtttctcaagaaaaggttcaagagatttttgacaagcaattcagccttttcccatctagtcgtagttacgactatcaggctaaaggcgatagtgattactcttatcgtaaaaatgaattgcgtgcagctgttaaaagagaactcgaacgtttaaacgttagtcgaacagctcctaaagatgcctatgcagagttaaagaatggttctgtccatgttattaacgctaaaaaaggtaatcaatacgatgttaataaaattatgcaagaatatgataagcaatttagcgataatcaaataaaacttactactgcctacactcaaccaattagtgctgatagcaagcaagttcaagctgataaagctaaattagaaaaattagctgatcaaaaagttaattacactgttcaaaataagacttatactttagctgctaaagatgttattaattccgctaaaattgtagatggaaaatatgaatatgatgctgctaatttaaagaagaaaattgatgatatcaacgacagtcaaagtacactcgataagaatctcaaattcaaaacaactggtggttctgaaattaccttagataagggtacctatggatgggctcttagtcctattaaggctacaagatctatcaccactgcttttgaaaaaggtgattctaaccttaatgccaaaagtgatatctatggtgaaggttataccgaaaatggtctaggatataatactacatccaacagtggtatcggcaattcttacgttgaagtttctatctcccaacaacacgtatgggtatataagaatggtactcaagtagcttcacttagtgtcgttactggtactaacgatggaaattacaacactcctactggcttgtactacatcatgtacaaacagactaatactacacttcgaggcaaaaacgccgacaacagtgcttatgcaagtcccgttagtcgttgggctccatttactttagatggatgtggattccacgatgctgattggcgtaaaaactggagtagtacagcttatctaactgatggatcacatggttgtgttaacgttcgacctgcacaaattagtcaaatttacgacaatgtcgaacaatatgaacctgttgttatttatagttaa

SEQ ID NO: 1105 - DNA, 963 bp, Shuttleworthia satelles
  isolated from dental, Shuttleworthia satelles
atgaataagaagttaattggtgttgatttaggcggtacaacaattaaatttgctatcttgacgctagatggtgaaattcaacaaaaatggagtgttgaaactaatattttagacgatggtaaacatattgttcctgatattgttgaatcaattaatcatcatttagatttatatgatatgaagccagaacaatttgttggaattggaatgggtacaccgggaacagtagatattgaaaatggtacagttgaagcagcatttaacttgaactggaaagaaaagcaaaatctaaaagaagaaattgaaaagggcactggtatgaagtttgctgtagataatgatgccaatgtagcagcattgggtgaacgctggaaaggtgccggagaaaatgatgatgaagtaacatttgttacattaggtacaggtgttggtggtggtgtcatcactaatggtgaaatggttcacggagctggagctggtggtgaaattggtcatataaatgtacaaccaaatggctatttgtgtacttgtggaaatcatggctgtttagaaacttatgcttctgcaacaggtgttgtacgtgttgcacgtgatatggctgaagaatttgctggaaaatctgatttaaagaaaatgttagatgatgggcaagatattagttctaagatagtatttgatttagcaaaagatggcgatgttttagctgaacgtgttgtggatcgtgtttgctactatttaggatttgcttgtgctaatattggtagtcttatcaatccatcatatattgtaattggtggtggcgtttctgcagcgggtaagttcttattagatcaggttgatagttactttaaggaatttgctttcccttcagttaaaaaatcaactactttaaaacttgctgaattaggaaatgaagctggagttataggtgcagcttcactagctttaaaatttaataagtag

SEQ ID NO: 1106 - DNA, 996 bp, Unknownn
  isolated from dental, unidentified
atgattcatttggaaaataaaaatacaacatttaaacaaactccacttcaaaaaacttattttgcactaggaactagaattaatctaactatctttggttgcgaaaatcctgttatcttagataaaacatatgacttaataaaatattacgaagatgtcctaactgttaaccgtgacgaatctgaagttatgtccattaatcatgctgctggcaaatatcctgttagagtaagcgaggcaacttataagcttattaaacgttctgttcaagttagtcaggaatatcttggcttcaactctttaattgggccacttgttaagctttggggaattggttttgataatgctaatgtacctgaagacgaggatattaagtcaactttaaatttaattgaccctcaaaaaattattctagatgataacgaaatgacggtattcctacaagatgatggaatggaactagatttaggtggaattgctaaaggatatattgctgatagaattaaaaacttttggcatgcctttgatattagttcaggtattatcgacttaggtggaaatctattaatggtcggccctcaacctaaacatgatgatgcactctggcgaattggtgtacaaaatccacatgatgctcgtggtagtgcaattggagtagttgtgacacccgaatgttctattgtaactagtgggatttatgaacgtcatttagaagttgatggtaaaagttatcatcatattttagactctaagactggatatcctaaacaaaataatctagcaagtgttacagtattctctaaatactcaattgatggagaaattgaaactactaatctcttctttgccggcaaaccagttaaagattggggaaaagataatccaaacttattaggagctgtatttgtaaccactgataataagatatatttaagtaagtttactcctaataatttccatttactctccgatgaattcgaagttattcaacattaa

SEQ ID NO: 1107 - DNA, 765 bp, Unknownn
  isolated from dental, unidentified
atgagccaagtagcgctagaattaaagaacattaatactactgtgaatattggaacacctgaagaaaaaagaattttgaaggatttgaacttaactttagaaaaaggtgatttcgtaacattactaggaacaaatggtgccggtaagtcaactttattgaatgtaatcaatggatcattgaatactacctctggtcaagtagtcctaaataatcatgatttgactaagttatcagaagtcaaacgtgctaaatatatcgctcaggtatttcaagatcctaagatgggaacagccccaagaatgacagttgctgaaaatttattattagctactaaacgtggccaaaaaagagggttaagacttagaggtctgaagaaacatttagcgaaatttaaagaagaaactgctcaattaccaaatggtttatcagatagattaaatacatttgctggtagcctttctggtggtcaaagacagacactaagcttcttaatggcaacaattcaaaagccagaattgttattattggatgaacatactgcagctttagatcctaatacgagtcaccaattgttagaattaacaaatgaagttgtagaaaaagaaaatttaacatgtatcatgattactcaccaaatgaaagatgcactaaagtatggtaatcgaactgtgattttaaatgatggtaaggttgttctagatgttaagggtgcagaaagagaaaagttaactgaagaagatgtattaaaatatttcgcaaactaa

SEQ ID NO: 1108 - DNA, 1383 bp, Unknownn
  isolated from dental, unidentified
atggcgattaaaaaaatgtggggtggacgtttccaagaaggttccagtaagttagttgatgaattcggtgcttcaatctcatttgataagcacatggcttatgaagatttagaaggctcattagcacacgtaaaaatgttgaaacatactaatattttatctgctgatgatgctgataaaatcatcgctggtttgcatattttacaagacaaattagctaatggagaattgactttttctactgaactagaagatattcatatgaatatggagtcccttctaactcaagaaattggcgatgttgctggaaaacttcatactgctagaagccgtaatgatcaggtagctactgacctacatttatatttgaaaaatcgtttagaaatcgtgatcgacgaaattaaaaatctccaaaaagttattgtaaagaaagccgaagaaaatgttgaaactgttatgcctggttatacacatttgcaacatgctcaacctatttcttatggtcattatctcatggcatattatcaaatgttccaaagagatattgaacgtttcgaattcaataaaaagcatactaacatctcgccattaggagccgcagcattagctggtacaactttccctattgatagagaatttaccgccaaagaattagacttcgataatatttatgctaattctttagatgctgtttccgaccgtgattttgtcctagaatttctaagtaacgcctcaattctcatgatgcatttatcacgtttttgtgaagaaattattctttggtgctcatacgaattcggctatattgaattatcagataaatattctactggttcttcaatcatgcctcaaaagaaaaatcctgatatggcagaacttattcgtggaaaatctggacgcgtttatggtcatctaactgctctactcgcaactatgaagagtctacctttagcctacaataaagacttgcaagaagataaagaaggtgtcttcgatgcagttaaaactgttattcctagtctaaagatttttgctggtatgttagatacactaactgttaataaagataagatgctacatgcaactgaacatgacttttctaatgctactgaattagccgattatcttgcaactaagggtattccatttagaaaagctcatgctattgtaggacaattagtatttgaaggaattgaaaatagtacaactttatcagatattcctcttgaaaaatataaagaaattaacagcgaaattggtgaggatatctaccaatttctacaatctaaagttgcagttcaacgtcgccattcacttggtggtactggtttcgatcaagtaaaactacaaattaaaaacgctaaaaaacaacttaatttataa

SEQ ID NO: 1109 - DNA, 780 bp, Unknownn
  isolated from dental, unidentified
atgtcagtattagaagttaaagatttacatgtaactgttgaaggaaagaaaatattgaaaggtgttaatttgaagatgtcaactggtgagattcatgcaatcatgggtccaaacggtaccgggaaatcaacactttcttcaactattatgggcgatcctgcttataagattactaaaggggatattttgttaaatggtaaaagcattattgatttaccggttgatgaacgtgctagaatgggactatttttagcaatgcaatatccacaagaaattccaggagtaactaatgcagaatttgttaagagtgcaattaatgctcgtcgtcctaaagatgatccaattcctttaatggacttcatcaaacgtttggatgaaactttagaaacattggatatgtctgaagaaatggctgacagatatttgaatgaaggcttttctggtggtgaaaagaaacgtaatgaaattatgcaaatgatgatgatcagacctgaattcgcaattttagatgaaatcgactctggactagatattgatgctcttaaggttgtttctcgtggggttaaccaaatgcgtggcgataattttggatccttgatcattactcactatcaaagacttttaaactatattattccagattatgtacatgttatgatggacggtcgtcttgttaaaactggtggtccagatttggcaatccgtttggaaaaagaaggatatgcaaaacttcgtgatgaacttggtttagatattaaattagttgatgaaaatgcttag

SEQ ID NO: 1110 - DNA, 1374 bp, Unknownn
  isolated from dental, unidentified
atggcatataagacaattaatccatatacaaatgaagtagaaaaagaatttcctaatgcaactgatgaagagttggaagctgttttagccaaagcacaccaattatatttagattggcgaaatgattctgaaagcttagaagatagaaaagctattttacatagggtagctgatattttacgtgaaagaagaacagaatatgcaacaactatgtctcatgatatgggaaaattaattggcgaagcagaaggagaagtagatctttgtgcagatatttgtgattactatgcagacaaggcggacgaattcttaaagcctcgtactttagaaacagatgctggaaaggcatattatattaagcaatcaactggagttttggtagcggttgaaccatggaatttcccattctaccaaattgcacgtgtatttgcaccaaactttattatcggtaatccaatgattttaaaggatgcctctaattgtcctgcttcagctcaagcttttgcagatgcagttttagaagcaggagctccagaaggcagtttgaataatatgtttattagctatgatcaagtagcaaaagcaattgcagataagcgtgttagcggtgtttgcttaactggttctgaacgtggtggaatgagtgtagctgctgaagctggtaagagtctaaagaaaactaccatggaattaggtggtaatgatgcatttatcattttagatgatgctgattgggagctagttagagaagtagcaccacaagctcgtttatacaatgctggtcaagtatgtacttcatctaagagatttattgtaatggctgataagtatgatgaattcttagaagtattgaaagatgccttttcagctgttcgcatgggagatcctactgatagaactacaacattggctccattaaattctaagagtgctaaagaaaaattagagaaacaggttgaactagcagttgaaaatggtgctaaagtttactatggaaatgaaaaagttgatttaccaggtcaattctttatgccaactatcttaactgatattactcctgataatcctatttttgatcaagaaatgtttggaccagttgcatctgtttataaagtaaactctgaagaagaagcaattgcattagcaaataactcaagctatggtttaggaaatacagttttcggtgaaccagaacacgctgctcgagtagctgctaagattgaaacaggaatgtcttggattaattcaggctgggcatcacttccagaattaccatttggtggagttaagaattcaggatatggtagagaattaagtgaattaggattcaatgcttttgtaaatgaacacttagtatttgaaccaaagagataa

SEQ ID NO: 1111 - DNA, 768 bp, Unknownn
  isolated from dental, unidentified
atggctttgacccctttagatattcataataaagaatttcatgtaaaattacgtggctatgatcaagatgaagttaatgatttcttagatcaaattattaaagactatgaaaatactttaaaagaaaatgacagattagcagatagtttgcaacaaaataaagaaaaattgaaatacttcaatgatttaaaagattcattgaatcaatcaattattgtggctcaagaagctgctgataaagttaaggcaaactcacaaaaagaagctgaaatcattaatcatgaagcacaaaagcaaggtcaagatattattgatcaagctaatgctaaggcaaaacacatcattgatgaagcttctagaaaagctaagaagattgcaattgaaactgatgatttgagaaaacaagctcgtatcttccgccaaagacttcaagtaatgatggaatcacaacttgaagtaattaagggtagtgactgggatgaaattctcaagcaaggcgatgtaagtagttttgaagaaattcaagatgcaattcgtcatgatgattcacttgacaattttggtcaaaatgaagtacaatcagacgcaagtagtgatggagcagaggtaattgttccaggccaaattgatgcaccaactgatgttgttactcaagatgtcccagaacaacctcaagaagaatcagtttctcaacaaacgaatgaaactgttgttattttccctgatgatgatcaacctcaaggaaagcactttgctcctgaagattaa

SEQ ID NO: 1112 - DNA, 588 bp, Unknownn
  isolated from dental, unidentified
gtgtacaaattgaaagttacgcatgtattgaaagttaagactaattttttttgggatagtttaaatgttataagggctagtattttaggggccaatgatgggattatttcagtatctggaatcgtgttaggtgctgcaggggctaatcttgatagtaagacccttttaatcagtggtttgtctggcatgctagctggagcttgttcaatggctggtggagaatggatatctgtaagtactcaaagagatattcaagaaaaaacaatggaaagacagttggaaaatgaagactgtgaaaattgtccgataaaattgcaaaagaacgatatcttaatgccatttcatgctgcagccagttctttctgttcatttataattggggcaatgattccattattgacgatgatcctagcaaggccagaacatcgcgtggtatttacattaattgcgatgattgcctcattatcaattaatgcgatagtttgtacacacaactccgaagtttcaactagcaaaacaattttacgaaatgttataactggattgttaacgacgttagttacctttattttaggggcatcagtataa

SEQ ID NO: 1113 - DNA, 660 bp, Unknownn
  isolated from dental, unidentified
atgaatgtgttacaacactcaattcatgaaggaataggtttaattggtgaatgggcagaaaataatggatatgaagtaaatgtatatcaagctgctaataacaatgtgaagttaccagaagttattgatactgatatgttggtagtattaggtggaccaatgagtgtcaatgacgacgaagaatggattgttaaggaacgagaattaattagaggaatgttgatggcacataaatcgtacttaggaatttgttttggagcgcaacaactttcaaaaactttgggcggggatgtgagttcttgtcctaaagaagtaggttggggagaagtgaaacgcctgagcaatataattccaggagttccagaaaaattggatgtgctacattggcatggtgaacagtttagattaccaacagaagcaactccacttttctcgagtccacttgttgaaaatcaaggatttattattaatgaaaatgcaattggtctacaatttcatttagaaatgaatgaagcaggtgtgcgtgaagtagtagaaaatgatagtaaattcataaaaggaaataagttaaagcaaagtgctgctgatattttgaaacataagattcctgaaatgaataagcaagcattatttgcaatgctagactatattaaagactaa

SEQ ID NO: 1114 - DNA, 891 bp, Unknownn
  isolated from dental, unidentified
ttggaatggaacgagttaagtgtaaccacaactaatgaagcaattgacgcagtagttaacatattaatggaaaatggtgctggtggcgttcaaattgatgatagtgaaggcttagaaaaagtaaaggtaattacttattttcctagtaaattaggcttagttgaattaattccagaattagaagaaaagataaagaaattaaataactttggtctgaatccaggagaagctaaagtatcattgactaatttacaagatgatgcttgggtagatttatggaagaaatactatcatccggttagattgactaagtatctaacaattgtaccaagctgggaagaatatcaaaaagaacaagaagatgagattttaataagattagatccaggtagagcatttggaacaggtacacatcctaccactcaactggctttacaggcattggaaacatctgtacgaggtaatgagagtatgattgatgtaggaacaagatctggtgtcttaagtatagcagcaagacattttggtgttgataaggtatatgcttatgatattgatgataatgctgttacagctgctaaagaaaattttgcgctaaatccaattagcaataatatcgaagttaaacctaacaatttattagaaggtatacataagaatgtagatataatagtagctaatattctagcagaaattatagttccattaattcctcaagctaagtcaaatcttaaagatggtggtatcttcattacatctggtattataaatgataagaaagaattaatcttaacagaattagaacaaaatggttttgttgtagatgaaattttgaataaaaaagattggtactcaattattgcacataaaccagctaaggaggacatttaa

SEQ ID NO: 1115 - DNA, 1113 bp, Unknownn
  isolated from dental, unidentified
atgaaagtaatagcattttatttaccacaatatcatgagataaaagaaaataatgagtggtggggtaaaggttttaccgaatggacgaatgtaagaaattctaagccttattttaaaggtcataatatgccacgacgcccgttaaatgacaattactatgatttaacagatgtaaaaacgatgttgtggcaaaaagatctagccaaaaaatatggtatttatggatttgcatattatcattactggtttgaaggagaaatgttattggaaaaaccagccgagataatgttacagcatccagaagtagatatgccgttctgcttttcctgggcaaatcatacttggtcgcgagtttgggcagataagacaaataatatattaaaacttcaaaaatatggcgatgaaaaagattggaaatgtcattttgattacttattacctttcttcaaagataaacgctatattaaagaaaatggccgaccagtaatgataatttataatcctttaggtgtaaaagaatttcctgagatgatgaaaatgtggcaacaatgggctaaagagtccggtttaccaggaatttttttcctacatcaacaaaatgaatttaatcataataaggaatttggtggtaattcatttgaaggtggaattgagtttcagcctaatcgagctgtagtggaatacatacgtaaaagtttaacttttaaattggaagctttaggtagcagaatagcagataaaattcctgtattagtcaataaatatactatgaaacattatagttatgatgatatttggaaaattattttgaaacaacaacctaaaggtaatgattggtatccaggtgcttttgcagattgggacaatactccacgtagaaagaataagggtgtattttgcgatggaacgagtccagaaaaatttgaatattatttaacacaacagataaagagagccagggatatttatcataaggattacttgtttatgtttgcctggaatgagtggggagagtctggttatttagagccagatacgaagaatggttataagatgctagaagcggtgcgtaaagcattgatagctaataatgaattcccaaattttgattag

SEQ ID NO: 1116 - DNA, 1110 bp, Unknownn
  isolated from dental, unidentified
atgttaggtgaatttagtgttttatttgaagctcccttagagaaagttaaaattgttacagatgatagtggaggcttacgacttagacctcaagaaaatgaagaaacaaaacaaatagttataataaagaaaaatggaaaagttagagttaagagatatagctatagattagaaattaatggtgatcgaaaattttttgatcggacatttaaatttgatgaagaaatcactcaaaagattttagcaagtataagggattgtttcaataatagagaaggtaacattataggtttagatgctagaccttggactttggatgtaactgatgaaaatggtagaaagaaccaattagtaggtatagtaaatggagacaaatctgttagcaagatttcaagttatattcgagaagagttagacttggattatttatggttatttgatggtaaagatattagggatgaaataaaaaaagttattttagaaactagacataatttaagcgatacgatcaagatagaaaaattaattataactgctaaagaagataaaattgaatacagtcaaaaagatgacaaaggaatgaaaagcgctaagacgtatgtaattcctaataaggtgaaagaacttttagaaaattattcttttactaattcatttaatagaatcttaggcaatcctaaagatgttattgagccagaagaaaagcgggattaccaattaataattgaaaatagtcaaaatgatcgaaagatttatgtgggaacttatgataaatattctcttccaacagattggggagattttattaaagatataacaaatataatttcacaagaagatgaaacagagatttttaaatcaagtgtttataataggagattacgcagaaaaggcgaatatattatttgtggtgtattctttgaaggtggatataaagaatataattatttgactgatgatgagagtattcaagttggcgatgaggttgaaatcccagttggtgttgataatcatgtagtaaaagctaaaatagctgatgtaaattattattataaggaagaagcaccatatccaattgaaaagacaaaaaagattctaagaaaagtttga

SEQ ID NO: 1117 - DNA, 1005 bp, Unknownn; identical to SEQ ID NO: 101
  isolated from dental, unidentified

SEQ ID NO: 1118 - DNA, 1623 bp, Unknownn
  isolated from dental, unidentified
ttgattactgtaagtgatttaagtttaaacttttctggacgtttactctatgatgatgttaatttgaaattcactccaggaaactgctacggtattattggtgctaatggtgctggaaagtctactttcttaaagttacttgaaggaaagttagaaccaacaactggaaatatttcaattggtagtaatgaacgtatttcaagcttgaaccaagaccactttggttttgaagaattcacagtaatggaaactgtcattcaaggccataaaaagctctatcaaattatgaaagagaaagatgcgatttatgctaagcctgacttctctgaagaagatgggattaaggctgcagaacttgaagctgaatttgcagagatggatggttggaatgcagaagcagaagcatcacaacttctacaatctttaggcataccagaatccttgcatgatgctaagatgagcgaattacctgaaagtgataaggttaaagttttattagcacaggctttatttggtgaacctgatattttattattagacgaaccaacaaacggtttagatgtacatacaatttcatggttagaagactttttggcagattatcaaaatatcgtaattgtagtatctcatgaccgtcatttcttgaaccaagtatgtacacatatgtgtgatgtggactatggcaagattaagttatatgttggtaactatgatttctggttagaatctagtcagttagctgctaaacttcaagcaaatgcaaatgctaagaaagaagaaaaaatcaaggaattgcaagaatttattgcacgtttctctgctaatgcttctaaatctaaacaagctacatcacgtaagaaacaacttgaaaaaattacattggatgacattaagccatcatcaagaaagtatccatttatcaaatttgaaatggaacgtgaattaggaaatgacttagttaaggttgaaaatgttagccatactattgatggtgagaagattcttgataacgtaagttttattattcgtcctggcgaaaaagtagctttattatcacgtaatgacttagcaaccacaactttaatgcaaatcttagctggtgaaattgaatccgatgaaggtactgtaacttggggacaaacaacaagccaaagctacatgtcaaaggacttaaatgctagttttgataatgatgaattaagcattttagattggttacgtcaatttgctactaaagaacaaaatgataatactttcttacgtggtttcttaggtaagatgttgttctcaggtgatgacattgataagcaaattaaagtattatctggtggcgaaaaggttcgttgtattctagctaaaatgatgttagagcgtgctaatgtgttattgatggatgatccaactaaccatttagacctagagtcaattacttcgcttaatgattcaatgattgattttaaaggttcaattatctttacatctcatgaccatgagtacattcaaacaatcgcaaatcatattattgaagtaggtcctaaaggaattgttgatcgttttgacactacttacgatgaattcttggcattagattcagttcaagaacaagttgaaaaattatattaa

SEQ ID NO: 1119 - DNA, 801 bp, Unknownn
  isolated from dental, unidentified
atgaaaaaattatttttaatagtatttacagctttttttgtcgtgctttcatttttaaatattccagtagtatctgctagttcttcccatcatcgcaaagcacatattcattggaaaaaagtaacagctcctgttagttttccaatcttgatgtatcatagcatcgcaaatatcccgggaaatagtttatgcctacctcccggacaatttgaacatcagatggaattattacataaggaaggatattacacccttactcctaatgaagcatatcgtgttctaacaaggcaagaggtaccagttggtaaagaaaataaaattgtttttattacttttgatgatggttatgaaaataattattcttcggcttatcctattctaaagaagctttctttacatgcaacaattggtatgattaccgacaagattaatacacctgatatgctttcaactaatgaattaaagaaattacgtaaagaaaaattggtcagtattgctagtcacaccgtttcacatactgaactcaatactttaaatactgagcaacaattagtagaaatggctaactctcgtgggctactcaatcgttctctaaaacaaaataccattttacttatatatcctgttggtagatatactccagcctcacctttcatcgctcaacgtgctggatataaatttgcacttactactaaacctggattagcaaatgctagtcaaggtttatacgaacttcatcgtcaacgtgtcattcctaatatgtctgatgaaagttttaaccaattattatcaggaaattaa

SEQ ID NO: 1120 - DNA, 2616 bp, Unknownn; identical to SEQ ID NO: 442
  isolated from dental, unidentified

SEQ ID NO: 1121 - DNA, 1113 bp, Unknownn
  isolated from dental, unidentified
atgcgaaaaagaatcataggattaatattagctattttaggtgtaggtgcaggatatacatttctaccagagctatggagcttgataggacttggaagtaatcgctggttaactaacgggttggttaatgctattattggtttgattattatggaaatactagcgattttcttaatagatgctattgagcgagtaatcataaaaatagagaaaaatttgattagacaaaagccggaagtaattatttctacgagcttgtcaatcacagtaggattaattgtagcagctttaatttcaacgatatttaatagatcacatgtatttttcatcaatactattttgccgattgtattaatgattttattagggtacttgggatatgttgttggaaaagaaggctttggaaatttaaagagattatttaatctacgacaaagaaaagtggaagatgataaagctcagattttagaaagaaaagttggcgaaaatttccataaatataagttgttagatactaacattttgatagatggtagaatttatgatctagcaaaaacaggtttcattgaaggtacattagtagttcccaattttgtattgtatgaacttcaatatattgctgactcaggggatagtatcaaacgagttagaggacgtagaggtttggatattttaaataaattacgttcagaaaaaattgttcctgtaaaaatgtacgagggagattttgaagatataaaagaagttgacagtaagcttataaaattagcaaaggttttagatgcagttatagtaacaaatgattacaatctaaataaagttagtgaatttcaaaatgtacaagttttaactgtaaatgctttggctaagtcattaaaaccacgtgttattccaggtgaaaaattaaccgttacagttataaaaaatggtacagaaagacaacaaggtgttgcgtacttagatgatggaacaatgatagtggttgaagatggacgttattacctcaataaacctattgaggtagaagtaactagtgcattgcagacggacgctggaagaatgatttttgcaaagccaacacattctaaaagagaactacgtgagaaaaactaa

SEQ ID NO: 1122 - DNA, 606 bp, Unknownn
  isolated from dental, unidentified
gtggaggcttttttattttcaataaatttagaaaggaatggaaaaatggcacatacagtagaatcagttgaaaagaaatggtatgttttacatacttatgcaggatacgaaaacaaggttaaagaaaatttagaatcaagagcaacttcaatggggatggaagattacatttttagagtagtcgttcccgaagaagaaaagcatgaaactactaaaacagggaaagaaaaagtagaaaaattaaaaacattcccaggatatgtattagtagaaatggtaatgactgatcaatcatggtatgttgttagaaatactcctggtgtaactggatttgtaggttcacatgggtcaggaagtaagccagcaccattattagatgaagaaattaatcatattcttcatgaattaggaattagttcacgtcattctaactttgatgctgaagtaggggatgcagttactattattgacggtgcattttctggtttagttggtaagattacagaaattgatactgaaaagatgaaattaaaagttgatattgatatgtttggccgcgaaacagcagctgaattgaattatgatcaagtagataaattagtataa

SEQ ID NO: 1123 - DNA, 2802 bp, Unknownn
  isolated from dental, unidentified
atggcaacctttattgtaggaaatactaggaaagtatttaattttggtacaagtaaagtttgggacttttctgaagcgtataggaatgcaagcaatggcgatgtaattcaattccaagcaggaactataataaatttaggacaaaatagatttacaattgagaaaaatctcagctttgttggtgatatgaaagatgacggaagtttaactacatctatcaatgggactatcttagttactaaaggatatcaagtttcgtttgaaaaaatgattttgaatgacaatattgatagaactgtagttactgttaatggtgcaaatgtcgttttaaatcaatgtattatgcgcaattttagtaatactaataagaaagttttattgtatgctaacgataatgcacaagtgaaaattatgaactccatagtagatacatctgatcaaaaaagatgggatacaattaagacttatcaagcaaatttggtaattgaaaatacaacacttgataaagtttcgatttggacatctgaaaatagtaattgtaaattaactagggttgaaagtagtagaattcgcagtacaaatgcagtatatgcaattagatctaatgtagagattgaagactcaaaaataattaacgatggcatagatggagaaaataagtatccaaccgtctttttaaatcaatctagtttaaaatcacataattcaattttagataatcaagatgaggtagaaagtgttcatttagaaaaacattctgtatttgaatcaaataatgattacatatataaattagcagcatatagcagtcaagtatttttaagtaatgcgacaatacagttaattttcttgttgaccaatcgttcttcaggttatgcaaatagtgtacattttaatgaacattcagaaagtataattaacattctaagtacagatgaatctgtgttatacataaaaaatgcagtatttgaggagataattgatcctaatgtcagagtagataatgaagcttttgctgctattgataaaattgattttgtaaatggtaatccagatgatattttaatggaagctaaaaatggcggtaagttaatttatgatggacaacatgatcaaaaatcaacatcagaaaatgaagaatcagtaggagatacaactaataaaactcaaagtgaagattcaaatgtagcattagaaaaattaaatagcttgattggcttagataaggttaagaaacaagttaaagagtttattaacttgaatattattaaccagaaacgtaaagaacaaggacttcaagtagttaatactagcatgcattcattgtttttaggtaatccaggtacaggcaaaacgactgtagcacgaattataggagatgttctttatcaaaaacaagtaatcagtcgaccagatgtgattgaagtttcacgtgcagatttagtagctgaatatgttggccagactgcatcaaaaactagagaagtattaaaatcggctttaggtggaattctctttatagatgaagcatatactttaagcaatggtggagagaatgattttggacgtgaagctattgatgaaattttgaaatttatggaagataatcgcgatgatattatgattatttttgcaggttatccaaaagaaatgagaaagtttctcaagatgaattcaggtttgaagagccgtattccaaacgtctttgattttgaagattatactgctgatgaaattgtaagaattggtttatttgacctaaagaaacgaaattacactgttgatgaattgtattacgaaaaggaacttaaagattactatgacaaagaaaatgatcatagtaatgggcgttggatccgcaatgtcaacgaaaaaattatgaaagcccaggcattgcgcttggcagagagcgataatataagcgtagatttacttcaagaaataacgcaagatgacattaaccaagttgtaaataaagatttagaaataaattcagccgacgacgcttatgctaagcttaactcattgataggtctagaaaaggttaaacaacaagtttctaaatttattaatatgagtgttattaataataagcgtaaagagcaagggttagcaacttctgcggtaagtttacattcgctatttttaggtaatccaggtacaggtaagacaacagttgctcgaattatgggacaaattttgttccaaaagggtgttattcgtaaacctgaattagttgaagtttccagaacggatttggtagcagaatatgttggtcaaacggcccctaagactagagatgtgctagaatctgccttaggaggagtcttatttatagacgaagcatacactttaagttcaggtggaggtaatgattttggacgtgaagttattgatgaaattctgaaattcatggaagatcatcgcgacgacatcgtaattatctttgcaggttacaccaaagaaatggagcaattcctcaagatgaactcaggtttgaagagccgtattcccaatgtctttgattttgaagactatactgctgatgaagttgtgcaaattggcttatttgacctatcaaagagacaatatattttagaaaatgaagacacgtattcagaggtagtaaaagatagttacgaaaatactaatgatcatagcaatggacgttggatccgcaatgttaacgaaaaattaattgcgatccaggctgaaagattagcaagtagcccaaatgatatgaatgatatagatgtgttgaagacaattactgaagaggatttacttaagtttaaaggatag

SEQ ID NO: 1124 - DNA, 2646 bp, Unknownn
  isolated from dental, unidentified
atgtggattaaaatgaaatcttttataaataataaatatccatttttacttagcttttttggccctattgtcataatgttagcctattttattgctcgtcatatgtatccatttggttcgagcacaattctaactgttgacctaggacagcaatatgtagacttctttgctttttttagagaaaccttacttcatcatcctgggagtttcttctactctttctcaaaagctattggtggtgaaatgattggagaatgggcttattacctacttagtccatttaatttattattcatcttcttccccggtaaatcgattgccgctggagttttagtcgttactctcttgaaatatggtttttgtggcctatcttttgcgtatcttttatctaaaagaaaattacaaaaaggttggatgatacctacattctcaattagttatgctttaatggcgtggaatgttgttaatcaacttaatttattatggatggatgcggctattttacttcctctaattattgctagtttctatgatttaatggaaaaacgtaagatgaagacctaccctcttttacttgcattgatgcttatagataattattacatggcatatatggtgtgtatcttcctagttctattctttatttggtaccagataacatatactaccaaattcaaggaatttctatctagaacttggttatttgcaagtcgatcaattctagcagggggcattgctgctgttattttaattcctactgcgataacccttactagcagtaaaggccaatacacagaaagctcgattcaagctaaattagaatataatccacttaaaatgttatcaaaattaacgattggttcatttaattttgatcaaatgccatctgggtttcctaatatttttattggtagtcttgcattatttgcctttattttgtacttctttaatcgtcaaaatacaatcaaatccagaataagtgcatttttaatcagtattttctttacagtttcaatgtgctttgaaccactagatttattttggcatggaatgcaatttccggtttggtatccatatagatttacctttattgtaagtttttggatgcttttcttgggaagtcaaggtatcactaatttcattgttaacgttaagccatggaaaattttccttttattcttcatagaagtcggtattatttcctatgtatggattaatgttaaaaaattcaactatgctactactgagactttaattttttctgctacctttgcatttttagttttactacttttaagtattaatagtactaatgacagaagcatcattaagtttctgttacttttcctagtagccgtatctgaaatgtctgccaatatgattttttctctgaataatattagctatttatccaaacgcgaatttgcagatccaacaactgcacttactgctgatagttcttggctacatcgccatgattctagcttttatagaactgctcaaatttattctagaactaaaaatgatggtataacacataatcttaatgctggtgcatatttcagttctgctctagaaaagaatattccagatttttatggtatgattggtcaaccggatggtgataactatgttacttattctaatggtagtctgataactgatggtttacttgacatgaaatatgctattgctcctaaaaataataatgaagttactgaaggcagcagtcatggttatcctttaatccaaacttcagagcgtagtgatttaagctcataccaactactaaaaaataatcctcgtacttcaatttatcaaaatccatatgctacaagtattggttatagtgcaggatctactatttcaaagatgcaacgtttgtttgacaatcccgttatttatcaatctaattggctcaacgctgcatctagttcaatgcctggaacgacttattttacagctatgaacttcaataaagttatttttactaataccgcagaaaaaacaactttaaccaactcagattttaagaaaattgataaaagtaaggatgcaagtattacttttgaattcattccgacaaccaataattcttattatcttacattaggcacttcacttgataatgacaatgtcgagtttctaattaatgatcgcgtacttcataattactctacttttagacatacaactcttgtgaatgttgcaaataacgataaaggtaaaaaaatctctattactgctaaatttaaaaaagataatctttggttgaataattttgttctatatcaactagataataatttagtaaagcaaaagttaactcaaattaaaaaatattcttggaagatacaagattattcgtcaacttcattaagtggaactattaatattgctaagtcaaatcaatggtttgcaactactatcccttataatgatggatggaaagcttatattgatggaaaagaagtccctacttataagatccaacaaacatttattggattccctatttctaagggcaagcatcaagtaaaattaacctttactcccccatatctttatcaaggacttgtggtatcagttatttcattgatgttgctatttattcctggaatggtaaaaagaaaagttcataaataa

SEQ ID NO: 1125 - DNA, 1833 bp, Unknownn
  isolated from dental, unidentified
atgaaaaacatggcacatattctttataatgcctgggattctttatacaaagaaccttttggagctgtaaaaatagggcacgaagttgtatggcgtctacaagttttttcagatgagaatgaagaaattcattatgttaatttaattcttaccaaggatggagaagaagatgtaccttatgctttagaaaatttaaatcatgatgggttatatcaagtaaagctccaaattggaacagctggattatatttctatcattttgaaattgaaactagccatggtagatcatacttggaaaaacgtcaaggtggtatggctcaacaagtaagtagtcaatcagatttgttgagatttcagttaacatgttttgacgaagaagttccaagtcctaaatggtatcgtcaaggtgtagtttatcaaattttccctgatagatttgctaatggattgcctaatggtgaggttcaaggaagaaagccaaatagttttatttatggtactactgctgataaaccttattacattcgtgataaaaataatgagattgtacgttgggatttttatggtggcaacttaagaggaattttaaagaaattaccatatctagaagaattgggtgtgactacaatttacctgaaccctatcttcttatctcgaagcaatcatcattatgatactgcggatttcttaaagattgatccaatgataggaaacgaagatgatctgaaagaattaatcactgagatgcataagaaaaatatgcacttgattttagatggagttttcaaccatgtgggcaaagagagtatctactttaatgccagtgggtcgtatgggaaaaatgttggagctgcccaaagtaaagaaagtccttattattcgtggtttgactttattcattatcctgatgattataaatcttggtggggtatcaaagatttaccagtgatagataaagataatcctgaatatcagaagtttatttatggtgatagtaatagaagtgtactatccaagtggaataattttggtgttgatggttggcgcttagatgttgctgacgagttaccaatgaatttccttagaggaattagaaagaacttggactcacatcataagcaagtaatgataggtgaagtctgggaagatgcttcgaataagatagcatatgatgaacgccgtcaatatacagttggagataatttaacaggtgttatgggttatccgactagaatctttgtaatggatttattagagtctgtaaagagttcacaagatattaagaaatattgtaatgaatatttacagctacaagaaaattatccaagagatttttggcttaatactttaaataatatcggaacacatgatacccaaagaattaagacagttttgcataatgacgataataaagtaattcaagctttcagaatactatttaatttaccgggtgtcccatgtatttattatggagatgaagtaggtgttgaaggtgatgctgatccagataaccgtagattcttcccatggggacaggaaaaaaatagtagaattattcaagaagtaaaacaacttgttgataaaagaaagaaaaatactttattacaagaaggtcgtctaggctttgtaattgcaagaggatcacactgtcctgctttggcaatagttagatatgatgatcaaggaaattctgtgtataattggttgaatttaactcaatataaacaaatcatttcaccagagaactgtgaatacctttgtctaccacaaaatattcaacaaaaattccaacatgagttaactttggactcgtgggaatataaagttatataa

SEQ ID NO: 1126 - DNA, 1155 bp, Lachnospiraceae bacterium
  isolated from dental, Lachnospiraceae bacterium
ttggaaattggagagaaaaaaatgaatccatatgatgttttaggagtttctaaagatgcttctgatcaagaaataaaacgtgcatatcgtaagctatcaaaaaaatatcatccagatttaaatcatgaacctggtgctgaagaaaaattcaaagaagtaaatgaagcatatgaaattttaagtgatcctcaaaaaaaggcacaatatgatcaatttggtacgacaggtggacaacaaggctttggtggtggccaaggtttcggtggctttgattttggtggatctggagcaggtggcttcgaagatatattcagttcattctttggtggtggtcaaagcagaaataataatggccctcgtcaagggagagatcttcaatatgaaatgcatctaacttttgaagaagcaatctttggaaagaagacagaaattaaatataccagagaagaaaattgtaaaacttgtagtgggacaggtgctaagccaggaacatcgccagtaacatgttctaaatgtcatggtagaggatttattcaggttcaacgacaaacacctttgggtagaatgatgtctcaacaagaatgtgatgtgtgccacggtactggtaaagaaataaaagaaaaatgctccacttgtcacggaagtggacatgtaaatgaacaacatgctattgaagttacagtacctgcaggtgttgaagatggtaatcaaatgcgtttgagtggtcaaggtgaggccggagtaaatggtggaccatatggcgatttatatatttacttctctgttgcacctagtgataagtttaaacgtgatggggcagatatatacttgagtttgcctattagttttgtccaagctgcacttggtgatgaagttgaagtggatacagttcatggtaaggttaaaatgaaaattccagctggaactcaaacaggaacaacatttagacttcgtgggaaaggagcacctcatttaagagctggtggaaatggtgatcaacgtgttacagtcaaaatagaaacacctaagaatttaaataagaaacaaagagaggcattaaaggcttttgctgactctatgggtgaagaccctagtggtgatgacagtttctttgaacgttggtctaagagtaagaaaactaaacgaaaaaaataa

SEQ ID NO: 1127 - DNA, 963 bp, Unknownn
  isolated from dental, unidentified
atgaaacgcattggtattttaactagtggtggcgatgcagctggtatgaatgcagctgtacgtgcgattgctcgttctgcaatgaatgcaggtcttgaagcttacggtatcaactacggatataaaggacttgtagaaggtaacatctttaagatggaatctacaaaacttgatgaaattatcaatcgtggtggtactatcttatattctgcacgtttcccagaatttgcagaaacagaaacacaattgaaaggtatcgaacaattaaagaaatttggtattgaagcattggttgttatcggtggcgatggttcataccatggcgcagaaaaattaactatgcacggatacaattcaattggtgtaccaggaactattgataatgatattccaggtacagactttacaattggtttcgatactgctgctaatgttgcaatggaagcattagatcgtatcaacgatactgcaacttcacaccaacgtgtattcgttgttgaagttatgggtcgtggcgcaggtgatattgcattatggtctggtattgctactggtgcagatgcaattgttattcctgaacgtgaatacgatattgaagctatcgcaaataaaatttccgaaaaccgtaaaaacggtaaagatcatggcttaattgttttagcagaaggcgtaatgggcgctgctgaattcaaagaaaagcttgatcaatacggtgattttgatagtcgtgctattactttgggacatatccaacgtggtggtaacccaactgttaaagatcgtgttttagctacaagacttggtgattatgctattcgcttattacttgaaggtaagggtggtttagctattggtattcatgataatcaattggttgcaactgatatcattgatacacttgaaaatcacaaacatcaaacagatgtatcattacaagatttgaatgatcgtgttcgtttctaa

SEQ ID NO: 1128 - DNA, 903 bp, Unknownn
  isolated from dental, unidentified
atgcaaaataattttcattctggctttgtagcaattttaggtagacctaatgttggtaaatctacctttttaaatcgagtagttgggcaaaaaattgcaattatgagtgataaagctcaaacaactagaaataaaattcaaggaatctatacagaagacgatgcacaaattgttttcattgatacacctggtattcataagccacacagtcgtttaggtgatttcatggtagaatctgcattatccactttaaatgaagttgatgcggtattattcatggtaaatgcaactcaaaaacgtggtcgtggtgatgatttcatcattgaacgtttgaaaaatgttaaaaaacctatttacttagtaataaataagattgatcaaattcatccagataagttattacaaataatggatgattatcgcaatactttggactatgcagaagtatttcctatttctgctttggaagggaataattgtccagaattaattgaatctttggtaaatactttgcctgaaggtccacagtactatcctgctgatcaaattactgatcatcctgaaagatttatcgctggtgaattgattcgtgaaaaagtcttagaattgacacgtgaagaagtacctcactcagtagctgttgttgtagatagaatccatcgcgaagatgctgagaaagttttagttcaagctacaattgtagtagaaagaaacagtcaaaagggtattatcatcggaaaaggtggcaagatgcttaaacaaattggtgttaaagcacgtaaagatattgaattaatgcttggtgataaagtctatttagaattatgggttaaagtacaacccaactggaaagatagacaagtagatttacaagcacttggctataaacaagatgattattaa

SEQ ID NO: 1129 - DNA, 1914 bp, Unknownn
  isolated from dental, unidentified
atgaaaggtggtcaaataatgggacaagtatcacatttatatgatttattccaaccaaaacattatcaaatttatttagatattaatcgtgaaaagaaaacattcactggagttacaaaaatttctgggaatgcttctcaaaaagaaattgctttacatcaaaaatttcttaacattcttgaagtaaaggttaatggtaattctaccgattttaaattcgatgataattctgaaactgtctcttttaatgttcctaatactggagatcttaatttagaagtatcatattccgctaagcttactgattctatgatggggatctatccttcttactatgaagttgatggtgtaaaaaaacaacttatcggtacgcaatttgaaactacatttgcgcgtcaagcatttccttctattgacgaaccagttgctaaagctactttcgatcttgctataaagtttgacgagcatgaaggtgaaactgtccttagcaacatgccagaagttaagacagaaaatggtgttcattactttgacactactgtgagaatgtcaacttaccttgtagcctttgcctttggtgaactacaaagcaaacttactgaaactaaatctggtgttaaaatcggtgtattttcaactaaaactcatgccaaaaaagaactagattttgctttagatattgctaaacgttcaattgaattttacgaagattattatcaaactccatatccactccctcactcctggcaactagccttacctgacttttcagccggagccatggaaaattggggcttggtaacttatcgtgaagcttatctattattaaatcctgataacacatctttagatacaaagcgtattgttgcaactgttattgctcatgaacttgctcatcaatggttcggtgatttagtaactatgaaatggtgggacgatctatggttaaatgaaagtttcgccaatatgatggaatatgttgctatcgatgcactacaacctgactggaatatctgggaattattccaaacatctgaagcacctcaagctctacaacgcgatgcaactgatggcgttcaatccgttcacgttgaagttaaggatcctgctgaaatcgattctctatttgatccagctattgtttatgcaaaaggttctcgtttattagtaatggttcgtgctttaattggcgatgaagctttacgttctggactaaaagcttactttaagtcacataaatacaataatgcagttggttctgacttatggaaagcacttggtgaagcttcaaatcttgatattggctctattatgaactcatggctagaacaacctggttatccagtccttaatgtcaatgttaaaaatggtcatttagtagttgaacaaaatcaattcttcattggtgaaggtaaagaagtagatcgtttatggcaagttcctctacatgcagactttgctcaagctcctaagttacttacacagaaagaattagacttaggtgactatcaagaattgagaaaagcagctgacaaacctctacgctttaatgtgggaaatacttctcatgttgtagttaattactctcctgaactattagaagatattttagttaactcgcaaaatctaacacatattgataaattacaattattgcaagatttacgtctccttgctgatagtggtttaacttcttattccaaggttattccattattaaaagaattttcaaatagtgattcagctattgttaatgaaactttatatagcattgttaataatttgaaattctttgttactccatattccactgatgaaacaaacttaaagaaatttgttaatactttaagtgctgaccaagttcaacgattatcttggttaccaaaggatactgatagcaatgacgatcaacta

SEQ ID NO: 1130 - DNA, 957 bp, Unknownn
  isolated from dental, unidentified
atgagacaaattgctttaggtaatggtgaaattactgcttcccaagttgcacttggaattatgcgtatgggtaagaagagtgtagaagatgctacaactgttctaaaaactgtctatgaccaaggagtaaatttctttgattctgctgatatatatacagatggtgaatcagaattagtttttggtaaagctttaaaaaatgcaggtataccacgtgataaagtctatattcaatctaaagctggaattgtattagatcatgcacgaacaactgctaatggattggtatttggacaaagatatgatttttctaaagaacatttattacaagctgtagatggaattttagaaagaattggtgtagattatttggatacattcttgttacatcgtcctgatccattaatggaaccagatgaagtagcgaaagtatttaatactttattgagaaacggaaaagttagaaattttggtgtatctaattttaacgctagtcaaatagatgtgttacaacaagctgttggacaaaaattaatcatcaatcaagttcaattaagtttgaagcatacacctttaattgatagtggaatttttgtaaatagacttgaagatgaagctgttgatagagaaagtggaatgcttgaatattctagaaaaaataatattactctgcaagcatggtccccatatcaatatggaatgtttgaaggtgtatttattgataatcctaagttcccagaattaaatgcaatgatggatgaaattgctaagaagtatggggttactaaaaatgcgattgcgacagcttggattactagattgccacataatgttcaagttattttaggttcaatgaatccacaacatttagaagaaagtattgctggtgctgatattcgtctaacacgacaagaatggtatgatttatatcttgcagcaggacacaaattaccttaa

SEQ ID NO: 1131 - DNA, 438 bp, Unknownn
  isolated from dental, unidentified
atggaattaaagaacggaacacctattgttgtaaaagtggaaacaattcgtaaacaagatggtgaagtatccaagtatactgagacttttaatggacaatatgtaaaaatgggatcaaatatttatttgcgctatcaagaaaaacatgatcaacatgaggatgcaacagtaacctttaagatcactgatgatggtgaagttcaattaaatcgtcaacaaggcgagatgaagatgcgcttgtattttgctagtcaaaagagagtatcaaccacatataaaacaccatatggggtaatcccaattgaaactttgaccaataaaatcaatatttccaagaaagatatgccaatttctgctaaagtagaagtagattatttactatattcccaagaaaaaattgttggggaatacaaaattagattgcaatttactgcttaa

SEQ ID NO: 1132 - DNA, 813 bp, Unknownn
  isolated from dental, unidentified
atgactaaagttatagatattgtaaataaatttgaagaatttgcgcctaaaagaattgctgaagatggcgatccaattggtttgcaattaggttctttacataatgatgtacataaaatgatggtggctttagatgtaagacctgaaactgtcgatgaagctattgaaaataatgtggattttatttttgcacatcatcctgcaatgttcgttccagttaagaaatttgatttagatgttccacaaaatgcgatgtatgctaagttaatcaaacatgatattacagtgtatggtgcgcatacaaacttggataatgctaatggtggaatgaatgattggttagctgaacaattaggattagaaaatacagaattcttactacctactaaggtagatcctgtttcaaacgaaaaatactctatgggtcgcgtgggagagttaaaagatagcttaacagctgtggaatttgcagaatattgtaagaaagtattaaatttacgtggtttacgtttaatagcagcagacaaccaaaagccagttaaacgtgtagcagtccttggtggtagtggtggtcgtttctttaacgctgctttactacataaggtagatgcatacgtcacaggtgatatctcatatcataccggtcatgatatgattgctgcaggcttaacagtggttgatgcaggacatcacattgaatctatttgcaaaccaaagttgacagataaattcaaaaagtggaataatgagaatgattggaaaatcgatatttatcaatccaaattaaatactgatccatttcagttcatttaa

SEQ ID NO: 1133 - DNA, 1128 bp, Unknownn
  isolated from dental, unidentified
ttgttaattttaaaacttataggtagttacttattaacacctgttctatggttaggaatattgtacgtaattattagttataatcagagaattaataaagaaagaaaacaatttagagttgcgataaataaggatttttatgagggacgaaatttcataaaatatggtctgttcttttttgtgatgggaagtttaatttccatgatattaggactaaccttgcctacaaatagtgtatacatatatcaaattttagtagtactagcgtttttaataaacggattttcaacaacaagcatgttattagttatgactgcagcaggtatattagagttagttgtcccaagattcattatattttttggagatgtatttccagaaatatcagggcctagttggctattgttaatatttatttcaatattagccgattattatctaaagagaaatatgaagaagcatccattaagtccaaggataaaaagtggaaaacgtggtagaaatattgccacatatttagggagagaaacgattgtgtttccactgttggtattaattcctagtggtactctctctagcactttgaatttttggccagtttttaatattggtaatcaaaaattttcgttaattttatttccaatttttataagtactagcgttaaagttataaaaagagctaaggaacgagtaattcaagataaattaaagaatactgaattacttttaggcctaacttttattttaatagtattaactaaatttatgtcaagactatttttgatcagtttgataattttgacagtagtatcgatatttttggaaattaaacttagaaagaaagagaaagatgctaattcttggtatgtggaaacagatgaaggaattagaattatttcggttcagccagaaacacctgcagcaaaaatgaagttgcagccgggagatgttattttgacatgcaataatagagtggtaaattctgaggaagaattttatcaagcattacaactaaactctgcatattgccatgttaaagtgagaacttatgagggagatttacgaattgctgaaagtgccatttttatggattctcctcatgaaatcggcttaattttattccactag

SEQ ID NO: 1134 - DNA, 1230 bp, Unknownn
  isolated from dental, unidentified
atgatgaagaaaactagtgatttaagaaaagattttcctcttttagaaactaaaatgaacgatcagcctttaacttacttagatagtgcagctacttcgcaaaagcctaagcaagtaattgacgaaattgcagactactataataaatacaatagtaatattcatcgcggtgtctacaatttagcagtcgaaacaactgataaatatgaaaatgtaagacataaagtggcaaattttattaatgcttatcgcgatgaagaagtactttttactaaaggaacaactcaaagcttaaattggatagcacaaggttatgttagatataacttgcatgaaggcgatgaaattgttaccacctatatggagcatcacagtaatattgttccatggcaagcaattgcacaagaaaagaatctaaaggtaaagtatgtaactttaactgaagaaggtaaacttgatttagatgatttaaagcaaaagattactgataaaacaaagattgtagcagttactcatgtttctaacgttttaggaacaattaatccaattaaagaaattgcagctattgttcatcaaagtaatgcaattttagtagttgatggtgctcaatctgtgccacatttaccagtagatatgcaagatttagaagcagacttttatgtattttctggccataagatgctaggacctactggaattggtgttctctggggaaagtatgaactcttagaaaaaatgcatcctttagaatatggtggagaaatgattgacagtgtaacaactgaaaaatcaacattcaaagagattccttggaattttgaaggtggaacacaaaatattgaaggcgtactaggtcttggtgctgcgattgattatttagaagaaatcggaatggaaaatgtggctcgaaacgatgaggacttacaaaagtatgcactcgaaaagttagctaatatcaagtctattgaattttatggtcctaaagatcctaatcaaagatgtggagtagtatcctttaatttgaaaggtattcatcctcatgatgtagcaacctttttggatgctgatggaattgcagttagagctggtcaccattgtgcacaaccacttatggattggttaggtgttagtgctactttgagagcaagtttctatttttataatacttatgaagaaatcgacaaattagtagattctctaaagaaagtagaggaatttttccaaatatga

SEQ ID NO: 1135 - DNA, 2214 bp, Unknownn
  isolated from dental, unidentified
atggtaaaaaaacgtatttataaattggctaaagagttaggtataagtagtgagagagtaataaaaattgctaaaaaatatgattttaaagttacaaaccatatgtcagcattagatgaaaatgaacagaataaaattcgtggaagtataagtctaaaagcaaagaaaaaagagcacatacaacataataaaaataaagataattttcattccaaaaaggtacaaaaaagtagtacagggagtaaagacgaaaataatcataagaatgtgcataaaaataatagaaagcggtctggtagtagtatgaaagaaaataataatgcaaagaacggacaacgtaataatagaaataatcgttctaataataaatttaaaaataaacgtaataacaataataaacgtaataataattttaagaagggaaatcctgttccaccaagaaaaaataagccattgccagaaacattggtttatactgtagggatgaatgtagctgatattgctaaaaaaattcatagagaacctgcagaaattattaagaagctatttatgatgggggtaatggtaaaccagaaccaatccctagataaagatacaattgaacttttagctgctgattatggtattaatgcagaagaaaaagttgaagtggatgtgtctgatattgataagttctttgaagaagaacaaaacaacactgagcatttagaaaaacgtcctccagtagttactattatgggacatgttgaccatggtaagacaactttacttgataaattacgtcatacgcatgttaccgaaggcgaagctggtggtattacacaacatattggtgcttatcaagtaagacatgatgataagattataactttcttagatacaccaggacatgctgcatttactaacatgcgtgctagaggtgctgatattacagatattactgttttagttgtagctgctgatgatggtgttatgcctcaaactattgaagctattaatcatgctaaagctgcaggtgtacctataattgtagctgttaacaagattgataaaccaggtgcaaatcctaaccatgtaatggaacaactgacggaatatgaattaattcctgaaagctggggtggagacacaatttttgtagagatatctgcaaaatttggtaagaacttagatgaattattagatatgattcttttagaagcagaaatgttagaattacatgctaatccaaaccaaagaggggcaggttctgttattgaagcccgtttggataaaggaaaaggttcagtagcttcattgttagttcaacaaggtacgttacatgttggtgatccaattgttgtgggtaatacatttggacgtgtacgtacaatggtggatgctcgtggacatgatattaaaaaagctacaccagcgacacctgtagaaattacagggttgaatgaagtaccggattctggtgatagatttattacatttgaggatgaaaagactgctagagctgcaggtgaaaagcgtgccgaaagagctttattgaaagaacgtagtcaaacaaatcatgttactctagataacttatttgatactcttaaagaaggagaattaaaagaagttggagttattataaaagctgatgttcaaggatctgttgaagctttagcacaaagttttaagaagattgatgttgaaggtgtacgtgtaaatattattcaccaagcagtaggtgccataaatgaaagtgatgttacattagcagaagcatctaacgctatcattgttggttttaatgtacgtcctacaccattagctaaacaacaagcagaatcagataatgttgatatacgtttacaccgagttatttataaagctattgatgaaattgaaacagctatgaagggtatgttagaacctgaatatcaagaaaagattacaggacaagtagagatacgccaaacatacaaagtttcaaaattaggtacaattggtggtggatatgttattgatgggtatattcgccgcgatagtggtgtacgtgtaattcgtgatggaattgttatttatgaaggtaaattagcttctttgaaacgcttcaaggatgacgttaaagaagttaaacaaggatatgaatgtggattgatgattgaaaaatataatgacataaaagttggagatcaaattgaagcatacattatggaagaagttccagttgattaa

SEQ ID NO: 1136 - DNA, 540 bp, Unknownn
  isolated from dental, unidentified
atgaacaacgacatcaaagaagttttatacagtaaagaacaaatcgctgaagttactaaaaaactaggaaagcaaattactaaggattttgaaggtaaaaatccattagtagtttgtgttcttaagggtgctgttatgttcacaactgatattattcgtgaaatcgatacatatttagaattagattttatggacgtttctagttatggagaaggaacagaatcatctggtgaagttaaaattattaaagacttagatacatctgtaactggaagagatgttttaatcgttgaagacattatcgatacaggtcgtacattacaacgtttagttgaactatttaagcatcgtaatgcaaaatctgttaagatttgtactttacttgataaacctgaacgtcgtgttgaaggagttaaacctgactatgtaggttttgaagttcctaatgaatttgtagtaggttacggtttagactttgcaggtcgctatcgtaacttaggatatgttggaattttgaagcctgaagtttacgaaggttaa

SEQ ID NO: 1137 - DNA, 1791 bp, Unknownn
  isolated from dental, unidentified
gtgatatcattgagtgatactagaaaatcgttaagatactttattaagtatttaagaccttactggaaaggaattacgctggtagtgctatttacaatcatttttacgtgggcgcaagttgaagctccacattacttaggtttggcacttacagcattaacaaaatatgtagaacagtatttcaatccagctactagggcaacagcatcaatggatgatttctaccaagctttgaaattaatgctgattttctttattttaaacgcgattatcatgctatttacatgggttattacctcaagatttaatgctcattcaactaataatatgcgtgaaaacttatttagtaagttgcagaagatgacaattaagtattttgatacgcatcaagatggaaagatattgtcattgtttaactcagatttggataatatctttaatgcgatgaacaatgcggtatttgaagttatttcgcaaacagcactgtttattggaacgatatggatgatgttcagaattgatgttagattagctttagtaacagtggcctcaactccatttgttgtagttttgagttggataattatgagaaaggcacgcaagtatttagatgctcaacaagatgaaattagtaatctaaatggctacattaatgaacaaattaatggtcagaaagtaattatcacaaatgggttacaagaagaatcagttgaaggatttaaagtttacaataaaaaagttcgcgatgcgatgtttaaaggacaattctattccggaattcttttcccaatgatgcaaggtctatcagtattgaacctatctattgtgattgcgatgggttcattatgggtggttgacggaacttatagtagagcagttggtttagggttaattgtgactttcgtacagtattcacagacttatttccaacctttaactcagttaacttctatttattccatgatccaattagcactgacaggtggtagacgtctagcaacaattgaagaacaagctgaagaaaatcaagttccaacaggacaagaacttaagtcacttgaaaaaggagttaagttagaagatgttcactttggatacaatgaaaacaaggaaattttgcatggaattaatatttctgtgaataaaggtgagtcagtggcattagttggtccaactggttctgggaaaactaccgtaatgaacctattgaaccgtttctatgatgttacaggtggaaaagtaacttttgatgatgtagatgtcagagatttaactttagaatcacttcgtaataatgtaggaattgttttacaggattcaattctcttttcaggaactgtggcagataatattaagtatggcaaaccaaatgccagccaaaaagaaatagaagaagcggctaaacaagctaatattcatgattttattatgactctaccacaaggatataatactgaaattaacgatgaaaattccgtcttttcaactggtcagaagcagttaatttcaatcgcaagaacaatattaactaatccaccattcttgattttggatgaggcaacctcaaacgttgatactgtaactgaagaaaagatccaaaaggcgatggatgcagtgattgctggtagaacaagttttgtgattgcgcatagattaaagactattattaattctgataagattgtggtattgaaggatggtaaagtcttagaagaaggcaatcatgaagaattattgaaagaaaaaggtttctactataatctatacacaaaccagatggcatttgaataa

SEQ ID NO: 1138 - DNA, 954 bp, Unknownn
  isolated from dental, unidentified
atggaattagaatttttaggaacaggtgctggatcaccttctaagagtaggaatgtatcagcagttgcattaaagttattggatgagattaaaaagatttggttgtttgatgtaggtgaaggaacacaacatcaaattttaaacacaacaattcgtccacgtaagattgataaaatatttataactcatatgcatggtgatcatatttttggattacctggctttttgagtagtcgttcattccaaggcggcgaaaaaatgggaccattaacaatttatggacctaaaggaatttctgattttgttaatattagtttaaaagttagtcaaacaaaattatcatatgaattaaatttcgtagaacttgaagaagaaggtttacttttagaaaatgatcgatttaaagtttatgcttataaattagatcatcgtattgaatgttggggctacagaattgaagaaaaggattatccaggtgaattacaagttgaaaaacttagagaagccaaagttccatctggaccaatctatggtcgccttaaagctggagaagtagtcacacttgaagatggtagaactatagatggtaaggactttataggtaaagctaagaaaggccgaattgtaacaattttaggtgacacaagacagacacctaacttgaaattacttgctaaagatgcagatgtgttagttcatgaaagtacttttggtaagggtgaagggaaattagcacgtaattatcatcactcaacttgtgttcaagctgctactttagctaaagaagtaggggtaaaacaattactgttaactcatatttcagctcgttatgtgggcaagatggtgaaagttttagaaaaagaagctaagaaagtattcccaaatactaaggttgttaaagattttgatacctttaatattccttttcctgaaagaaaggacgatgagcaatga

SEQ ID NO: 1139 - DNA, 792 bp, Unknownn
  isolated from dental, unidentified
atgattactttaaaatcaccacgtgaaattaaagaaatgcaaaaatcaggtcaaattttagctggaatgcatattggcttgagagatattatcaaacccggaatttctagttgggaaattgaaaaatttgctagaaaatattttaaagaacacgatgccattgcagaacaaattggttttgaaggttataagtacgctacatgtgtaagtgttaatgatgaaatttgccatggttttccacgaaagaacttaatattaaaggatggagatttggttaaggtagatacagttgttaactatcacggagctatgagtgactcttgctggagttatgtggtaggtaagtctactcctgaaattgacagactaatggaagttacaaagaatgctttgtatttagggattgaacaagcacaagttggaaatagaattggtgacatcggtgctgctatccaacattatgtagaagatgaaaatggatatggcgatgtacgtgaatttataggacatggtattggacccacaatgcatgaaagtcctaatgtccctcattatggcgaagctggacaaggtgttcgcttaaaagaaggtatgacaattacaatcgaaccaatggtaaatattggtggttgggaagcagaaatggatgatcctaacggttggacagcacgtacagcagatggtagtttatcttgccaatatgaacatactattgcaatcactaaggatggtcctaagattttgacttctcaagatcctgaaagagataaaaaatacctattagacgattag

SEQ ID NO: 1140 - DNA, 1338 bp, Unknownn
  isolated from dental, unidentified
atggattttaatgaaatggctggtcgtttagtagtagtcgataaatcggaagaaaaaataatgtcatctgataatattgaagtttatcaagcaattaagatttttaaaaataagataaagtgtaatcgttgtgggaaagtaacaactaaggaaagagctaaactaccctatgacaattactattgcccgaaatgtattgttttaggaagagttagtacattgaataatttagttcatgttattgaggataatcattttaataatgttgatgaaattttaacgtgggatggggaattgtctaaatttcaagaggtatgttctaatgaattaattaatataattggaaaaaatacggagcatttattatgggctgttacgggggctgggaaaacggaaatgctatttaaaccaatagctgaagccttaagaaaaaattttcgtgtagcgattgcttctcctagagtggatgtatgtaatgaattatatccacgtttagataaagctttcaaagagattgataaagttcttttgcatggaagaagtgaagaaacatatagatatactcaattggtagtatgtacaacacaccaattattaaaatttaaagaagcttttgatgtactgataattgatgaagtcgatgcttttccatacgttaataataaagaattattatttgcaactaaacaagctattaagaaaacaggaactcttatttacctaactgctacacctagtaatgagttggcaaaaaagataaaaagaggaaatatatctataagttatttaccaatgagatttcatcaaaatgccttgcccactataaaagtagaatttacaaataattggtgggaacttattttacaaggaaaattagatacaaagattaaaaagtatctaaaaaaatggcagcaaaatggaaagcagttcttaatatttgtaccccatgttgctatgttaaataaagtaagagacgtaattaaaggagtcttagctagtaaaataaaaggtgatacagttcatgcagctgatgaatatcgaattgaaaaagtacaaaaaatgagaaacaaagaatatacgtatttaataactacgacaattttagaaagaggagtcacttttccggaaatagatttactagtgttaggtgctgataatagtgtgttttcaacgtctgctttagttcaaattgctgggagggttgggcgtagtgttagtagaccagatggtgatgtaatatttatctgtgatagatatacaagaaaggtaaaagacgcacaaaaacaaatagaatttttaaataaaaaagcaaaaaaattgagagaaggtatctcatga

SEQ ID NO: 1141 - DNA, 750 bp, Unknownn
  isolated from dental, unidentified
ttgaaaaattatattaagaaaatacaaggtcatgcctttctgttggaagtgcatggcttttttcttataattaagtttgaggtgattaatatgaaaattacttggcatggacatgcttttattgaaattcaagttgccggaaagcaaattctaattgatccttttattactggaaatccatttactaagaccaaaccagaagattttaatccagattatattctattaactcattcacatcatgatcatgtgggagatacggaagaattagctaaaaaatcaggtgcgacaatcgtaacagaaatggatatggctaatgattacgcccaaaaaggtttcaaagttgaaggtcccaattatggtggaacagtgcattttgattggggtgatgttaagattatcccagcttggcatactactgctaatgtgcctttaggtatggcaacaggcttagctttaacaattgaaggaaaattaatttatatcgctggagatactggtttattcagtgatatgaagctagttggacgtaagcaacaaattgacttggcattcttaccaattggcgattattatacaatgggacctgacgatgctgcctatgctgcttcattaattgatgctaaaaaagttattccatatcacttcaatacgtttccaccaattaagcaagatgtaaatgacttttggaaggacgttcctgaaaatatgaaatttacagctgaaattgacaaaccttttgaattataa

SEQ ID NO: 1142 - DNA, 1689 bp, Unknownn
  isolated from dental, unidentified
ttgacttttgatggtttattcactcatgcaatgattcatgaattaaataaaactttacaaaatggtagagttactaaaatatctcaaccttatccaaatgaggtaattttaacaattagagctaataggactaattatcctgtgctactatctgctaatcctcgttatgctagatttcaaattacacaaattccttatactaatccagcagttccaactaattttactatgatgttaagaaaatacttggaaggtgcaaaattactagaaattaagcaattagataatgatagagttgtatattttgaatttttaactcgtaatgaattaggagataaacttcctttactattaagtgctgaaattatgggaagatatagcaatgtcattttaatcaatcaatcaacaaacaagattattgatactatcaaacatgttggaatggatcaaaatagatatcgaactttattaccaggtgctacttatcgtcagccgcctacccaatataaagagaatccttttgaacaagaatcaaatacatttgaagaactcatacaaaaataccctaatcgtgaagttttagctgacagcttattaaaacaatatcaaggtatttctagagataatgcacttgctttagcagataaattgcattcttcaaataattatgtccaagctttcaatgattttcttgcaatgacagaaaatcctattcctacaatgaatagtaataacttctcaattttcactgataatcctaacgataaaaaattttctactttaagtgaaatgttggatgttttctatcatactaaagctaatagagatagagtacagcaacaaggtggacaattactacacgttattagaaaaaatctgcagcgaaacaagaaaaagttaaagaaactctctaatgaattaaaagctacagaaaacgctgatgagtatcgtattaaaggagaagttttaacaacgtatctgtatcaaattaaacgtggtatgactaaaataactcttcctaatttttatgataataataaagaaattacaatctcgttatctaaccaactgtccccttctcaaaatgcacaaaagtacttcaaaaaatatcaaaaacttaaaaatgctgttacttttgttaatgagcaaatagagcttactaaaaaagaagttgcttatctagaagaaatacaaactcaaattgaattagcaacccctgctgatttagatgatattaaaacagagttacaacaagaatgttatattaagaaaaagcaacaaaaaagtaagcgtagtagtagagtaaaaattaataagcctgaaacttttatagcaagcgatggaactgagattctagttggtaaaaataatttacaaaatgaaaaactcaccttgcatactgctaagaagactgatatttggttacatgcaaaaaatattcctggctctcatgttattataaaatctaataatcctagcgatgaaactttatttgaggcagcgatgttagcagcgtacttttctaaatttagaagttctgctaatgttcctatcgactatgttcaagttaaaaatattcgcaagcctaatggaagtaaacctgggttcgttatttatgaaggtcaaaaaacattgactgttacgccaaccgaagactttgtattggaacttagacaaaataaaaagtag

SEQ ID NO: 1143 - DNA, 1104 bp, Unknownn
  isolated from dental, unidentified
atgaaacatattgaagaagtacaagaatggttagctaataacaatttagatattgcttatataagtgatttccataacatacgttattacacaggttttgatagtgatcctatcgaacgaattttagctttattcatttttccagataaagatccttttatctttgccccagcacttgaagttggttctgtaaaggaaagtggatgggaatatcctgtttttggctatttagatcatgaagatgcattcgcacttattaaatcacacattaatgcattagctggaaaccctaaaaaatgggctgttgaaaaagataatttaacagtagcaaaatcagaagctatactaagaaattttccagaagctaaatttgttgaaaatatttctccttttatcaacaaacaacgatcaattaaaaatgaagatgaaatcaacctacttctcgaagcgggaaaatgggctgattatgcctttaaagttgggtttgatgcattaagcactaataaaactgaacaagctgtagctgctgaaattgagtatgaattaaagaaaaaaggcgttatacatatgagctttgatacaattattcaaagcggtgctaatgcagctgatcctcatggtgctccaaaagaagatactattaagcctaatgaactaactctctttgatttaggtactgtatataaaggatatatttcagatgcttcacgaactgtagcatttggcgaaattgatgacaaactaaaagatatctataatgtttgtttagaagctcaattaactgcacaaaatgctgcaaaacctggtatgacagctgaagaattagataagattgctagagatgttattacaaaagctggttacggtgaatatttcatccatcgtcttggacatggtatgggacaaagtgaacatgaatttccatctattatggaaggaaataaaatggaattagttccaggtatgtgtttctctattgaaccaggtatttatattcctaattatgctggagttagaattgaagattgtgtttacgttacagataatggtgttaaaccattcactcacactagcaaagaacttcaaataattcctttatcataa

SEQ ID NO: 1144 - DNA, 984 bp, Unknownn
  isolated from dental, unidentified
atgaaaaaatctgttgaaattttgttgcaagaagctatatcactaaaagcaagcgatatatttttctttccaaaaaatgataggtaccaaattaaggtgaatgttttaggaacgaatcgcataataaaggaatgcagtaaagaatttggaggacagttgattaattatttgaaatttcaatctaatatggcggttagtgaaaaaagacgtccgcaacttggatcatggatatatagcgatgaaaaaaatgaagtcttttgtagactatcaagtgtaggagattttttagggaatgaatccttggttgtaagactgatatttcctagtactttttttgaagaaaactatttttttgaagagcagatttatactttacaaaaagcttgtatcaaaaatggattaattgttttttcagggccaatgggttcaggtaagacaacgactatgtacaatttagctagaaagttagctaatgaaaaacatgttatgagtatcgaagatccaattgaaatatatgaacctaattttttacaattacaagttaacaataaagctcagatgtcatattctgagttactgaaagtagcattaaggcatcatccagatgtatttttaattggagaaattagagataatatgactgctaaagtagcaataaatgcagctctgagtggtcatctaattttaacaacagttcatgctcgtaatgtatatggtgtttatcaaaggctgaaaaacttaggtattagtgatgaagaacttcaacaaacgatgcaggtaatctcatatcagaggttgattccaacaatagatggaagagctaaagtactgtttgatcaaatagaaggaaaagatttagataaagatatcattcaaggaaatattcaaagtagaatgactaaagactggagagaaaaacttgagtattgttaccttaataactggattaataaagaaagttttgaaacatttattgaaggataa

SEQ ID NO: 1145 - DNA, 471 bp, Unknownn
  isolated from dental, unidentified
atggctaaggtagaaagttttacattagatcatacagctgttaaggctccatatgtacgtttaattactgttgaaacaggtgcaaaaggagataagatttcaaattttgacttaagatttgttcaaccaaatgaaaatgcaattccaacagctggattgcatacaattgaacatatgttggcaggatatttgcgtgatcatatggatggagttattgattgctcaccttttggatgtcgtacaggtttccatttaattatgtggggtgaacatgatactactgaagttgcaacagctttaaaggcatctttaaacgatattattaatgctagttgggaagatgttcaaggaacagatattaagagttgtggtaattatagagaccattctctattttctgctcaagaatggtgtaagaagattttggctgatggcatttcaactgatccatttgaaagaaaagttatttaa

SEQ ID NO: 1146 - DNA, 1485 bp, Unknownn
  isolated from dental, unidentified
atgtccaaatgggatactaaatttgttaaaaaaggatatacattcgatgacgtactattaattccggctgaaagccatgtcttacctaatgaagttgatttaagtgttcaacttgcgaaaaacatcaaattaaatatccctatcattagtgcgggaatggatacagttacagaatctgcaatggcaatcgcaatggctcgccaaggtggattaggtgttattcataagaatatgacaattgaacgtcaagctgatgaagttcgtaaagtaaaacgttctgaatcaggtgttattattgatccattcttcttgactcctgataacaaagtttttgaagcagaagcacttatgcacaaatatcgtattagtggtgttccaatcgttgaaaatgctgaaaaccgtaaattctgtggtatcattacaaaccgtgatttacgttttgttactgatagcaaagttaaaatcgacgatgtaatgactaaggaaaacttaattactgctccagaaggtacatctttagaaaaagcagaagaaattttacaacaatataagattgaaaaattaccaatggttaatgaagaaggtcaattaactggattaattacaatcaaagatattgaaaaggtagtagaatttccacatgctgctaaagatgaacacggacgtttgttagtagctgcagctgttggggttacaagtgatacttttgaacgtgcagaagctcttttaaatgcaggtgcagacgcattagttattgatacagctcatggacattcagctggtgtattacgtaagattaaagaaattcgtgaacatttcccagaagcaactttgattgctggtaatgttgcaactgcagaagcaacaaaggcattatatgatgctggtgttgatgtagttaaagtaggtattggaccaggttctatttgtacaacacgtgttgtagctggtgtaggtgttcctcaaattactgcaatttatgatgctgcaggtgttgctcgtgaatacggtaagacaatcatcgctgatggtggtattaagtactctggtgacattgtaaaggcaattgctgctggtggtaatgctgtaatgttaggttcaatgttagccggtacagacgaagcacctggtgaaacagaaatttaccaaggacgtcgctttaagacatatcgtggaatgggtagcttgggtgctatggactctacacatggttcttctgaccgctacttccaaagtggtgttaacgaagctaacaagcttgttccagaaggtattgaaggacgtgttgcatataaaggtagcgtagcagatattgtataccaaatggacggtggacttcgtgcaggtatgggttattgtggtgctcctgatttagcaacacttacaaatgaagctcaatttgtacaaattacaggtgctggtttagttgaatcacatccacatgatgtacaaattactaaagaagctcctaactattctaaataa

SEQ ID NO: 1147 - DNA, 1371 bp, Unknownn
  isolated from dental, unidentified
atgaaaatgcaattagccgaagtagcacgagcactcaatatcgaagctaaagaagaatgggaagatatttcaattacaagtgtttgcttcgatagccgtaaaatcgagtctggtgctttgtttattcctttggtggctgaaaatgatggtcataagtatgtagaagctgcaatcaatggtggagcagttgctacactatggcaagaagatcattctgaaaatatcccagatagtattgcagtattacctgtttctgatactttagttgctctacaacaattaggtaagcattatttaatgaaaattaatcctaaagtagtagctattacaggaagtaacggaaaaactacaacaaaagatatgacagcagcagtgttggctacacagttcaatgttcataagacttttgctaatttcaataatgaaattggagtacctatgacaatcttaagtatggaacctaatacagaagttctagtagtagaaatgggtatggatcgttatggtcaattggattttttgagtaaattagctgaacctgatgttgcagtaattactatgattggtgaagcgcatatagaattctttggaacaagagatcatattgctgacgctaagatggaaattacacatggtttaaaagaagatggagaattggtaattaatggtgacgaaccattattgactacaaaagctaaagaagttagtcaagaagtactaacctttggtagccttgataataatgatatgcgtgcaatggatattgttagtgatgctactaagacaagttttaaagtagcaacttggcctgaagtagatttcacgatcaatatgattggtgcatataatgttttcaatgctttagcagctttaagtgtgggtaatatttatcatataccagtagataagatgcaaaaagctttagcatcatttgatttaacagccaatcgaacagaatggttagaagctaaaaatggtgcaaagattttgagcgatgtatataattcaaatccaacagcagttaaagaagttttatacgcttttgaacaagttccaactgaaggaaagagaattattgttctaggcgatatgcttgaattaggtgagaaagctgctgaaatgcacagtgatttagcccaagctattaatcctgatagaataggcagtgtctatctatgtggagaacttatggggtatttagctgaaaaattaagagagaaatttgatgaaactcaaattcatcactatcaaaaagatgatttactaactttaacttctgatttaaaaaatgaattaatgcctgatgatattgttttattaaaagctagtcacggaattcatttggaaaacgttgtaagtgaattaatttaa

SEQ ID NO: 1148 - DNA, 699 bp, Unknownn
  isolated from dental, unidentified
atgattgaaggattacaagaaatgttaaaaagagattttaacatcacttttaaagatgtagacttattggatgcggcatttactcatgcatcgtatgtaaatgaaactccagaaagaaagaaaaagttaaaatattatgaaagaatagaatttttgggtgatgctgtaatgcagttatgcgtgtccgaatatatttatgaacattatccagaaatgcctgaaggaaaaatgtcaagactaagggcggctatggtaagagctgatagttttagtaaatttgctattgaatgccatttcaatgagtatattagattaggtaaaggtgaagaaaaaggaaatgctcgtcagcgtccaagtttgttatgtgatatttttgaatcatttataggtgccttatatttagatcaaggaaaagatgaagttgtaagatttatttctaaggttatttttccaaaattagaattaggttggtttgatcatatgatggataataagactgaattacaggaagtcttgcaacaaaacggagaatgtaaaattaaatataatgaagttaatgttacaggtccggataatgaacgtgtctatacaatgaatgtagttgttaataatgaagtcatgggcgaaggtactggacgtactaaaaaggctgctgaacagatggcagcatatcaagctttaaagaaactcagaaagtag

SEQ ID NO: 1149 - DNA, 2193 bp, Unknownn
  isolated from dental, unidentified
atgttatgtcaaaattgtcataaaaatcctgcgacaattcacttaacgactaatttaaacggtcgccaaacctctattgatctttgtcaaaattgttaccaagaaatcaaaaatgaagctaacggctttaataatattggacaagatccatttggttttggtagtttagatgatattttcaaagctatatccaatcctaatttttctaaccaacaaagcatgtctcaagaaccacctacacaaaatggtcgcataggtggaaataacggtaatcgcaacggtgattcatctattttgggacaatatggattagatttaacagaagaagcaaaaaatggtcaaatcgatccagttattggacgtgataaagaaatagccagagtaattgaaattctaaatagacgtactaaaaataatcctgttttaattggtgaagctggtgttggtaaaactgctgttgttgaagggctcgcccaaaaaattgttaatggcgatgttcctcaaaaactaatcgggaaaaaagttattcgtctagatgttgtttctttagtacaaggaactggtatccgtggacaatttgaacaaagaatgcaacaactaatgaaagaattgaaacaacaaaaagatgtaatcttatttattgatgaaattcacgaaattgttggtgctggtaatgctgaagggggaatggatgctggtaatgtgctcaagccatctcttgctcgtggagaattccaattagtaggtgctactaccctaaatgaattcagaacaattgaaaaagatgccgcacttgctcgtcgtcttcaaccagttcaagttgatgaacctagtgtagaagaaactattaaaattctaaatggtattcgtaataaatatgaagcttatcatcatgtaaaatatactgatgaagctttaaaggctgctgtaactttatctaatagatatattcaagatagattcttaccggataaagcaattgatttattagatgaatctggatctcgtaagaatttaacgattcatgcaactgatccaaaaattattgaagaacgtattaagaatgccgaaaatcaaaaacaagctgcactaaaagaagaaaattatgaaaaagcagcttactatcgtgaccaagtatcacgtttcgaaaaaatgaaggacaatgcttcagatgaagatactccagttgttactgaaaaagatatggaacatatcatagaagaaaaaactaacattcctgttggtgagttaaaagctaaagaaaaggaacaacttcgtgatttaggctcttcacttgaaaaacatgttattggtcaagatgaagctgtagataaggttgctcgttcaattcgaagaaatcgtataggtttcaataaatcaggacgtccaattggttcattcttattcgttggtcctactggtgtaggtaaaactgaaacagctaagcaattagcccgcgagttatttggtactgaagactcaatgattcgatttgacatgagtgaatacatggagaaattctcagtttctaaattaattggttctcctcctggatatgtcggctatgaagaagctggtcaattaactgaacaagttcgccgtcatccttatagcttaattttgcttgatgaagttgaaaaagctcatcctgatgtaatgcatatgttcttacaaattcttgatgatggtcgtctaactgattctcaaggaagaactgtttcatttaaagatactatcatcattatgacaagtaatgctggtagtggtgattctgtagtatcagttggttttggagctgaagcaaatggttcatctcattcagttattgataaattaaccaaatactttaagcctgaattcttaaatcgttttgatgatatcattgaatttaatccattgtctaaagataatttagtcaaaattgttcgattaatgctagatgacgttaataaaatgatggctgatcaaaatatgcacattgatgttagtgataaggttgtagataaacttgcagaattaggttatgatcctaagatgggtgctagaccacttcgtcgtgtaattcaagaacaaattgaagataaaattgctgatttttatcttgataatccaaatgttcaaaattttgttgctgatttagatgagaatgatgatatcgtaattaaatctaagtctgaaaaaaatgaagactaa

SEQ ID NO: 1150 - DNA, 1350 bp, Unknownn
  isolated from dental, unidentified
atgagtttgaaaagttcagttgccattacggcaggaaaaacttcacattggtttttacacaaatttacaaacggtggtacttctttacctggaaagattactttagctattgatcctgatgttttaaaaagtctggcaaaagattatgaaatagttatcatcacaggtactaatggcaaaactttaactactgctttaactgttaaagttttaggtgaaaaatactccaacattttaactaaccctagtggatctaatatgaaacaaggtattgtatctgcctttttaaccgctcaaaaaacaaagagtgggaaaaaacttgcagtattagaaactgatgaagccaatgttccaattatatctcaatatatatccccttctatctatgtcatgacaaacttattccgtgatcaaatggatagatatggtgaaatatatactacttacgataaaatattaaagggtattaatatgcatcccgatgcactcgttattgctaacggtgacgctcctatcttcaatagtagggaattaaaaaacaaagttatttattacggatttgatgataaagcagatagagaacaaatggcaccagctaacacagacagtttgttatgtcctaaatgccagcatattctacattataagaatagaagttacagtaatttaggaaaatattattgtcctaactgcgatttcaaacgcccaaaactctcttatcgaatgaatcgtattctaagtcaaagccctcaaagctcgacttttgaaatcgacaatactaccatctcacttcatataggtggaacatataatatttataatgctttagcagcatatgctgtcggaaatgaattaggcgtttcacctcaacagatagcacatgctttaagcagtaacgatgaaaaagtctttggaagacaagaagttatcaagataggtgataaagaactaacattggtcttgattaaaaacccagttggtctagatcaagtgcttgacatgataaaaaccgatacagaaccattttctttagcagtgttattaaatgctaactatgctgacggtatcgatactagctggatttgggatggaagttttgaatctcttccatttgataagataccagctattttaactggtggtgaaagatatcgcgatattacttttagattgagagtcgctggtgtacctgaagaaaatttctctcaagaagaaaaacttcctgacgtgcttgaaaatattaaaaaaatgccaactaagcatatttatgttttagcaacttatactgctgtgttacagttacgtaaattattatctgaacaaggttatattaaaggaggcatggattaa

SEQ ID NO: 1151 - DNA, 459 bp, Unknownn
  isolated from dental, unidentified
atggaggaaataaacgtgcgtacaacatatattgcaaaaccaggcgaagtagaacgtaaatggtatgtagttgatgcaacagatgttcctttgggacgtttatcatcagctgtagcatctattttacgtggtaagaataaaccaacatttacaccaaacgtagatacaggtgactatgtaattgttatcaatgctgaaaaggttgctttaacaggtcgtaaggcttctgataaagtttactaccaccactcaaatcatccaggtggtttgaaagctcgtacagctggtgattaccgtgaaaaggatcctgaaaagttattagcattatctgttaaaggtatgcttccaaagggtactcttggtcgtcaacaagctaagaagttacatgtataccgtggtgcagatcacaagcatgaagcacaacaaccagaagtattggatattaacaaattaatctag

SEQ ID NO: 1152 - DNA, 567 bp, Unknownn
  isolated from dental, unidentified
atgacacaaaaaagaaatttatcaaccaaaaaaataatagaagcagctaaagagattataaataaagaaggggctgagaaattaagtttcagtaaggttgctggtgtattaggggtacattctcaggcgatgtatccatattttgccgataaagaagaactaaaaattgcagtaattaatgattttttagatagtttaactgaacaaataaaagaagaattgcaaggaatttctggaaaagaagctctacgtatatatggtcgtaaactacatgaattattattgatccagccacgattaacacgtttggcttttggtggaattgattatagtcaaaaagaagaagcaagaaatcattttaaagatttagtagagttgttagaaagtttgattgaaccatttgctaaaaatgatgttgatgttataaacagagcacgattatatcgagctgtgatatttgggtatgctcaaaatgaactgtggggcttattcaaattagcactagttccagcacaaacgagctttgaatttactttagaagaagcaatagcgacaattactgcgtag

SEQ ID NO: 1153 - DNA, 1725 bp, Unknownn
  isolated from dental, unidentified
atgtttgataagggtttattaaccctgacagacattaaaaaaactatgagagggcttgtaggactttatatcctacaagcttttcttatagttggtcaagctgtcagtctagggttagtgattacacatttatggaatggaaaaccacttaaggaacaatttatttatattattggttttataatttcttttgctggaagagaagggctacaatggtggagcaatcgctggttagacgattatgcacgtgtagaagcaaagaaattacgtaaaactttattagaaaaagtcttcattttaggtccagaattggtacagaaacaaggaactggacacatggtcactttgactttagatggtatttctgaagttgaagattatattcaactaacacttagcaaaatgattagtatgatgattgtgccaattgtagttttagcgatggccttttatctggattgggtatcaggagtaatcttattcttcatctatcctttaattgtattgtttatgattattttaggatatgcagctaaggctaaggcagataaacaatttgtttcttttcaacgtttatccaatcactttattgattctttacgaggaattgatacattaaaatactttggtttaagtaaacgatacgccaacagtatttataagacaagtgaacgctttagaaagactacaatgagtgtattacgcgttgcaattctttcaacatttgcgttagacttttttacaactttatcaatcgcggtagtagctgtatttttaggattacgtttgatcaatggtgaaattacattatttccagctttaacagtattgattttatcgccggaatacttcttaccaattagagcattcgctaatgattatcatgcaactttaaatgggaaaaattccttccactcaattcaagaaattatcaatagtgctgaagttaaagaaagtaagttagagcttcatcaatggcaacctacagatagtttgaaactagataatattgagtttgcttatgatgataatgcagaaccagttaagtttaatacagagtttacaggctatcaaaaagttggaattattggaatgagtggggctggtaagacaactctaattaatttgttaagcggctttttacctttgaaaaatggaaaatttgaaattcaaggtaaagaaactactgatttaaatgaagatgcatggcgaaatcaaattatctatattccacaaagtccatatatctttgataatactttgcgttacaatattgctttctatacacctgatgctagcgatgaagaaattattgaagcaattaaagcagtaggattggaagatttattagaagaacttccagataaacttgatacattaattggtaatggtcaaagaaccttaagtggtggacaagctcaacgaattgctttggctagagcatttttagataagcaaagaaaagtattgatttttgatgaaccaacagctcacttagatattgagactgaattggaattaaaggaaagaatgttacctttaatgaaggatagattggtaatttttgctacacatcgtctacattggatgaaagatatggataaaatcgtcgtcttaaaggatggaaaaattgccgaagaaggacaatatgatgaattgttagctcatcaagcatatttctatgaattattaaatcgagcaaaaggtggtgaaaagaatgtttaa

SEQ ID NO: 1154 - DNA, 1407 bp, Oribacterium sp.
  isolated from dental, Oribacterium sp.
atgagttctggtaaagtagttcaagttatcggacccgttgttgatgttcaatttcctctaagtgaatcattaccagatattgacgatgctttgaaagtgaaacgtgaagacggtacagaattagttatcgaagttgcacttgagcttggtgacggtattatgcgtactgttgctatggactccactgatggtttaaagcgtggagctgaagttgaaggtacaggggcatctattagtgttcctgttggtaaagatacacttggacgtgtatttaacgttttaggaaataccattgataatgggcctgaatttgatgaggatcatccacgtaatcctattcatcgtgatgctcctaaatatgatcaattgagtacagggattgaaatccttgaaacaggtataaaagttattgaccttttagcaccttatattaaaggtggtaaaattggtttgttcggtggtgccggtgttggtaagactgttttgattcaagagttaattcataatattgctcaagaacataacggtatttcagtatttactggtgttggtgaacgtactcgtgaaggtaacgatttatactttgaaatgaaagaatctggcgttttggaaaaaacagccatggtattcggacaaatgaatgagccacctggagcccgtatgcgtgtggctcttacagggttaacattagctgaatatttccgtgatgttgaaggtcaagatgtgttattatttattgataacattttccgcttcacacaagctggttctgaagtttcagctttgttgggacgtataccttctgccgttggttatcaaccaacacttgcaactgaaatgggtcaattacaagaacgtattacttctactaagaaaggttctgtaacttctattcaagctgtttatgttccagctgatgactatactgaccctgcacctgcaacaacatttgctcacttggatgctacaactaacttggaacgttctttaacacaacaaggtatttatccagctgtggatccattagcatctacttcaagtgctttaacacctgaaattgttggtgaagaacattatgaggttgctacagaagtgcaacatgtattacaacgttatcgtgaattacaagatatcatttctattttaggtatggatgaattatctgatgaagaaaagattattgttgcacgtgcacgtcgtatacaattcttcttatcacaaaatttccatgttgctgaacaatttacaggtaaccctggttcttatgttcctgttgaagaaacagtaaaaggatttaaagaaattttagaaggtaagtatgataatcttcctgaagaagccttcagattagttggtggaatcgaagatgtagttgaaaaagctaagaaacttgctggcaataattaa

SEQ ID NO: 1155 - DNA, 1140 bp, Unknownn
  isolated from dental, unidentified
atgtatcttgaaaaattggaacttaaacattttcgaaattatgaagatgttaatgttgctttttctcctcaagttaacgttttgattggaaaaaacgctcagggaaaaactaatttgttggaatctatatatgttttagcaatggcacgtagtcatagaacgagcaatgatagggaaatggtaacttttaaaaaagatgccgcattaattagaggagaagttcatcagcgtttaggtaacacgaagttagaacttctgataagtcgtaaaggtaaaaaagcaaaagtaaatcatttggaaaaagcaagattgtcacagtatattggacaattgaatgttattttgtttgcaccggaagacctagcgctagttaagggggctccatcagttcgtcgaaggttcatagatatggagtttggacaaatagatgctctttatttacataccttgactgaatatcgtgcggttttacgccaacgaaataagtatcttaaagaactacaaacaaaaaaagcaacggataaagtatatttagaaatattatcagagcaactttcagaaagtggttcgcaaataatttttaaaagattagagtttttgcaagaattagaaaaatatgctgataagttacataatcagatcactcaaggcaaagagcacttacaatttcagtatgaaagtacattgaaagaataccaaggaaagagtgtgttggaattaaagcaatccttgattgaacagtataaaactatgatggataaagaaatttttcaagggacaacattgctcggcccgcatagagatgatgttcgttttatgttgaatgacaaaaatgtccaagtgtatggatcgcaaggccagcaaagaacagcagcgttgtctgtgaaattagctgaaatagatttgatgaaagaaaaaacacatgaatatccaatcctgttgttagatgatgtgttgagtgagttagatggtgctcgacaaactcatttattgaaaactattcaaaataaagtacaaacattcctgactacaccaggattatcagatgttgcgcaacaattaattaataaacccaaaatctttagaatagataacggaaaaattacagaagaaaattcatttacgattgaggaggaatag

SEQ ID NO: 1156 - DNA, 789 bp, Unknownn; identical to SEQ ID NO: 548
  isolated from dental, unidentified

SEQ ID NO: 1157 - DNA, 1830 bp, Unknownn
  isolated from dental, unidentified
atgacattttcaattaaaacacgtaaaaacacagttgataaattaaagaatgaagaattagatttgttagtaattggtgggggaattacaggtgcaggtgttgccctccaagctacagcttccggtttgaagactggtttagttgaaatgcaagactttgctgaaggaacaagttctcgttctacaaaattagttcatggtggtatcagatacctaaagacatttgatgtaggtgttgttgcagatactgtacaagaacgtgcagttgttcaaggaattgctccacatattccaagacctttcccaatgttattacctatttatgacgatccaagttcaacattcgacatgttcagtgttaagattgcgatggacttatatgaccgcttagctggagtaacaggcacacaatatgctaactacacaatttctcgtgaagaagtattacaacgcgaaccaaacttgaagagcgataagttattaggtgcaggtgtttaccttgattatgtaaataatgatgctcgtctagttattgaaaacattaaagaagctgatgaattaggtggcttaatggctagtcacgttaaggttgtaggtgttcttcatgatgataatggtcgcatcaatggcgtaaaagctaaagatttattaacagacgaagaatttgaaatcaaagctaagatggtaattaatactacaggtccatgggtaactaagacattaggcttagatgacaagaatggcgaaggtgaagtaattcgtccaactaaaggtgtgcatttagttgtagatagctcacgtctaagagttcctcaaccaacatactttgattccggaattggtgacggtcgtatgattttcgttgttccacgtgaaaacaagacatactttggtacaacagatacagactacactggtgactacaagcatccaagagttgaacaagctgatgtagattacttattgaaagctatcaacaacagatacccagaagctgaaattacaattaacgatatcgaagcaagctgggcaggcttaagaccacttctatctggtaacggaagttcagactacaatggtggtggatctaacactggtaaagtatcagatgaaagtttcgaaaacttaattaagacagctgtagcatacagtaaagatgaagcaagtcgtggcgaagttgaaaaatcaatcagtagcttgaagacagcttcagcagaaaagactctaagcccatcacaagtatctcgtggttcttcacttaaagtaggtgatgatggtttaatcacactttctggtggtaagattactgactatcgtaagatggcagctggagcaatggaattaatccgtaagttattcaaagaactatttaataaagatgtacgcgaagttgattccaagaaattacaagtttcaggtggacactttgatcctacaaacgttgatgaaacaatgaaattctaccaaaagattgcgatggataaaggtatgccagctgcagatgctgctgacttagcaaatcgctttggttcaaacacaagtcgtgtaatttcttacacagacgatgtagaagcagctccaggtttaactttagctgacacattgagcttacactactctgtaaatgaagaaatgaccttgaatttagtagacttcttattacgtcgtacaaactatgttctcttccataaagatgaattaatgatgaagaaagatgcttttgttgatgaaatggcacgcatcatggaatggaatgaagaagaaaaagcagctgcagctaagcaattagatgaaactattgcagaatcaagcttagaatatttgaagtaa

SEQ ID NO: 1158 - DNA, 1908 bp, Oribacterium sinus
  isolated from dental, Oribacterium sinus
gtgagtagtttgcaaactttacgtgtagaaagtttaaccaagacatatggcgaaaaaacgctattcaaggatttaaactttttaataaatgaacatgatagaattggtttaattggaacgaatggttctggaaaaacaacactattgaatgttttaactggaattgattcagcagattctggaaatttaataaaaccaaatgattatcgtataagttacttaaaacaagcacctgaatttccacaaaacagtacaattatggaagctatttttactggagctgctcctgtatttcaaacaattagagattatgaagaagctctaactgaatatggtgcacatccagatgataaaaaagccgaacaacgttacatcaaagctgaagaaaaaatgaatcaagaagatgcatggacagccgatagcgatgttaagacaattctaactcaattacacatagaggatttaacgcaaaaaatagaagagttatcaggtggacaaaggaaacgtgtaggcttagctcaagtattgattcaagcgcctgatttgttgatactagacgaaccaactaatcatttggattttgattctattgaatggttagaacaatatcttgctaactataaaggagcattattagtagttacacatgatagatatttcttagatcagatagctactgaaataatggaattgtcatttggtagtttatattcgtatactggaaactatcaagattttgttagacaaaaagctgaacgagttgaaagagaacttgttcaagaacataaacaacagcaattatataaaaaagaattagcttggatgagaacaggtgctaaagcacgtactactaagcaacaagctagaattaataaatttaatgaattaaaaagcaatttaaataaagtccaagttgacgaaaatgttgatattaatttaggacaacaaagattgggaaagaaagtattagaattaaaagatgcaagtttaacaattggaaatcataaaataattgaagatttcaatttgctaatccaagctggagacagaatcggtattacaggcgttaatggtgccgggaaatctagttttttaaatgctttatcaggtgaattgccattagattcaggtattttgacaatcggtgaaactgtaaagatggcttattatcgacaacagacggaagagattcctgaagataaaagaattattagttatttaaacgaagttggtcaaaatattgtaaataaagatggtgagcgaattagcacaactcaattattggaacaatttctatttccaagatttatgcatggaacattgattcgcaaactctctggcggtgaaaaaagacgcttgtatcttttgaaattattaatgtctcaacctaatgttttattattggatgaaccaactaacgatttagatataggaacattaacagttttggaagattatttagataactttaacggaactgttattaccgtatcacatgacagatattttcttgataaggtagctgattcattatatatctttgaaggaaatgcaaaaatcaagcattatgtcggaatgtttacagattatctgaagaatgctgagaatgaagcagttaagactaaaaaacaagtatctgcaacaaaagtagaaaagacagatagtgcagaagacaaagttaaaaagaaaaccaagttaacttacgctgaaaagatggaatatgaaaaattagaatcagaaatcgataagcttgaaaatgataaagcaagtttagaagaagaaatgcaacatgttgatggggctgattatactaaattagcaagtttacagcaacaaattgatgaattagatgaagatattatggaaaaagttcaacgttgggacgaacttagtcagtatgttgattaa

SEQ ID NO: 1159 - DNA, 846 bp, Unknownn
  isolated from dental, unidentified
atggaaaacaaacagcttctcgtagcagaagatctgtctgctgtaggggatctttctctaacagttgccacccctatacttcaatgtcagaacattcccgtagcggtgctacctacaagtgttttatcaactcaatctgaaggatttggcactcccgctattttaccaacagagaattggattaaatctactttcgatcattggtcaaaagaacaacttgatttttctgggatattaattggttattttaataatcaagttgttgggcaagaattacttcattttattgaaaatcattcacttgatttagtagttatcgatcctgcatttgctgatgatggtgccttttatcccggtttagatgataatcaccttactacaataagggaattgttacaacatgcgactgttaccacacctaatttaaccgaagccaaattcttaacagggttaaccgaacttgataactcctatgagagtttgtccaaattactgttggcaatgaaaaaactaattcatcctaacggaaatgtggtaatcactgatattgtttttgaaaataagcacggctgtgtttatgagcaagatggagaagtaacgttttgttcatatcctcaattgcctggtcatttttatggaagtggcgatgttttttcagccttactaacaagctttctatggcatggaaaagatttccatcaagctgtcaaaaagactactaaattaacttttaatgctttaatggaaacagctacatcgcatcgcgaacgtcgctatggaatcaatctatctcgtttattacaactattaattcttgaaaacgaaggtgaaaattatgaaaactaa

SEQ ID NO: 1160 - DNA, 1116 bp, Unknownn
  isolated from dental, unidentified
ttgaaattatcaaagtactttaatacaaaatttttctaccgaattgttgctctaatttttgctctttttctttttttctatgttaatgcagatcagttaacatcaggacagtctacaggacatacattaacaacaagtacaaatgagaagtcaattgttattgagatgccattaaaagttaagggagcaaaagatactgaatttgtggcaggattaccagataaggtaaaggttagaataattgggccaagcgcaattgtcacagctattaacaatacacgtaattttgaggtgtatgccgatttaactggtaaagggtatggtaaacatacaataactttatctcaatctgggctgagcaaagaagtgtcagctaagatagatccacaaactgttaaggttaaaattagtaagaaagctacaaaaactttcccagttcaagcacgctataattcaagtaatgtagcaagtggatatgcaactggtagtgtaactatgaataatcaaacggttcgagttacaggtgctaaaaatgatgtaaaaaatgtcgaaattgttgtagcaaatgttaatatcccaagtggaactaagaatgatgtagtacgatctgttctactacaagctttggataaaaagggtaaaagcttagatgtagtttttgatcctgaaacagttcgtgtaacgattccggtttttgaagctagttcaagtaaaaaagtgagcttgaatttagttcaaagcgatggagacaaaaatcgaagttactcgatatcaacagatacaaaaacagttgtgttacatggaacaaaacaagctttgagcaaggtttcaacattaacggtgcctgtgtcagtagaaggtgtaaccagttctgtaacaagaacaattcaattacaatcaacaattagtggaattgcaagtatttctccagctacaatttcggtaactattactgcaagtggagataataatgaaagttctgcagatgtatcgcagactaataaaatagataatagtttgaataatgataaaactgaagatgatagcagtaaaactagctcaaatataagtgtaagtagctcgaatagtgagaaatcatctgaaagtaataattaa

SEQ ID NO: 1161 - DNA, 1425 bp, Unknownn
  isolated from dental, unidentified
gtgaaaattcaaaaaaaattatctgcttgtactagcattttagttgggaaaaaagcaatggccgacaattcaactatcatcgctcgtaatgaagatgctaaaactgcttggcctaaacatcttactgttcatgagcataaagaattcgaagaagagcaagtttttgtatcaaacgataacaagtttacaatgccacttcctaaggttagatttagatactctgctactcctgaatggactgataagtttggtttattcgaagaagatggaattaatgaatatggtgtagcaatgagtgctactgaaagtgcctactccaatccacgtgtacttggtgctgatccactcgttgaaaatggtattagtgaagaagcaatggtgaccgttgttcttccatatattaagtctgcacgtgaaggtgttgcacgtctaggaagcattattgaaaaatatggtactagtgaaacaaacggtgtcctcttctctgatgaagatgaagtttggtactttgaaagtggtagtggtcatcattgggttgcacaacgtattccagatgattgctatgcagtagtagctaatcaattagctatccaaaaagtcgatcttgacgatcctgataatttcatgtactccaagggtattgtacaatttgtataccaaaatcattttgaagttgattttgataattttaacttccgtaatgtctttggtacacatgaatatagcgatgaaatttatagcactcctcgtgtatggtacggtcaaaaatacctttctggtgataatgatcaagatccaatgagtgaagaattacctttcatccgtaaagctaatcgtttactccatttagatgatattgcctatatattaggttctcactaccaaaatacaccatatgatccattaaacaataataatgctgatggtcataagttccgtcctattagtttggctgccactcaagaatcacatattctacaaatcagaagtggtatgcctgttgatgtacgtggtattcaatggttagcaatgggtgtaactgctcaaagttcttatattccattctatcctgcagctactgatgtccaccctgcatacaaagttggtagtgaaacttatgatgacaaatctgcttattgggtatacaaattagctggcgtcctagttgatgcacattacaaagaatttggcaaaatgctaaaagatactcaaaaagaagttacaatcttacttaacaataaagttcatgaaattgacgctaaagctcttacgctttctggtcaagaactaagagattatctaacaacagaaagtattgcttgccaacaaattggtcttgataaatataatgagttgatagctaaactaattacagcttcaaccgccctatctccattatcatttaaagttgatgtcaatctttaa

SEQ ID NO: 1162 - DNA, 1074 bp, Unknownn
  isolated from dental, unidentified
atggagagaaaaattttgcatattgatatggatgcattttatgcttctattgaaatgagagataatccagagtacttaaataagccattagtgattgctagaaatcctaaacatactgctggaaagggagttgtagcaaccgctaattatgttgctagaaagtatggaattcattctgcaatgagtgctcaaaaagcattagataagtgtcctcatgcaatttttaaaactcctgattttgctaaatatcgccgagtatccagtcaaattcatacaatatttcatgagtacactgataaaattgaaaatgtagcactagatgaagcatatcttgacattacagaaaataagttaggtataaaatcagcagtagaagttgcctgtagaattcaaagagaaatttatttaaaaactaaattaacttgttctacaggagtttcgtataataaatttctagctaaattagcatctgattactctaaaccatttggaataacagttgtgacaccagatgatgtacaagattttttatttaatatgccaattaagaaatttagaggcgtaggtaaaaaaacattacctaaaatgtatgaggaagggatatactatggtattgatttatacaataagaaagaaatagacttaattaataaatttggtaaaattggacatatattatatcagcgtgtacgtggtatagatatgaggccagttgaatggaaaagagaacgaaaatctgttggcaaggagcggacatttgatcaacctttaaaaacagttgaagaggttgatagtcaattaagattgatagctacaaaacttgtaggtataacgacaagtagacaaattaggggaaaaactttagttattaaagttagaaataatgattttgaaacggtaacaaagagaactacccttcaagattatcttcctaatgatgtagaaaatatagttttttatggaaaacaattatttgaagaagtacaagacatagatatagatgttaggctattgggcttgactttgacaaatttagatactgtaaattttgaaaatatgagcttacctatttaa

SEQ ID NO: 1163 - DNA, 1659 bp, Unknownn
  isolated from dental, unidentified
atgaatgattggaaaaagaaaggtgtagtatatgaaatctatgttcaaagtttcaatgatactaatgatgatggtataggagatatacagggaataattcaaaaattagattacttaaaagaattaggagtaaatattttatggctaactccaatttttgaatcaccattagttgataatggatacgatatttcaaactatcaaagtataaataatatctacggaacaatggacgatgtggaggagctaataaaaaaatcacatgactataatataaaaattgtgatggatttagtagtaaatcatacttctgatcagcacaaatggtttcaagaatcaaagaaaagtaaagataataaatatagtgaatactatatttggcgtgatcctagacctgatggttcagcaccaacaaatcatggttccgcatttgggggatcagcatgggagtatgttccagaaagagatcagtactatttacacttatttgctaaagaacaaccagacttaaattgggataacaaagaattaagaaatgaaatttataatatgatgtctttttgggcagaaaagggtattgatgggtttagaatggattctattagctttatatctaaacctcagaaatttacaaatgcaccagtggtagataataaagaatatggcgcatattattatggaatagccaatggaaataatattcacagatatttaaaagaaatgaatgaaagagtattaagtaaatatgatcttataacaattggggaaactcctcatacaaatacggaagaaggatctaaatttttagattcaagtgaattagatatgatctttcaatttgagcatatgcatgtagactatggtaagtatggtagatattctgatgtatcatttaagatgagtgatttaagagaaagtataaaccattggcaagaaaatcttacatggaattctaattatttaggaaatcatgatcaacctagaatagtttcaagatttggaaatgacaaaaaatatagagagaagtcagcaaaaatgttagcaatgctaaccttatttcaacgtgggacaccatttatttatcaaggtgaagagataggtatgactaatgtgggttttcagtctatagatgatatgaaagatttagaagcacacaatacatatgattttttgacaagagtgggtatatcaagcgaaaaagccttagacatggttaataggaagacaagagacaatagtagaacacctatgcaatggaatactagcaaaaatgcggggttcactgatggacaaccatggatacgaatcaatgataattataaaaatattaatgtggaaaaagatttattaaataaagattccatttacaaattttaccaaaagttaatttcattaagaaagagtaacgatattttgataaatggcgattgcaaattgctagatttaacagattctgatattataacctttactagaaataataatggggagaaaatcttggtgatttgttcattttcggataaaagaattaaattcgatattccaaaagagtataaagcaacgaaattattaataagtaactatgatagcgctgactttgaaggggatgtgacaacttacctggagccttatgaagggagagcttatataattggttaa

SEQ ID NO: 1164 - DNA, 1008 bp, Unknownn
  isolated from dental, unidentified
atggaaaaacaaacaattacaatttatgatgttgctagagaagcagatgtttctatggctacagtttctagggtagtaaatggtaatcctaatgtaaaacctgctactagaaaaaaagttttagaagttattgatagacttgactatcgtcctaatgcagttgctagaggattagcaagtaagaaaacaacaactgttggagttattattccagacgttactaacgtctatttctcttctcttgctagaggtattgatgatgtagcttccatgtataaatacaacataattttggctaattcagatgctaatgaacaaaaagaattgcaagtgttaaatactttattagccaaacaagttgacggtattattttcatgggaaataagattactgatgaacttcgtaagcaaattgataaaaccaagacacctgtagtattggctggttctttagatgataaagaagaatttgaaagtgttcatattaattatgtagatgctgtagaagaagcagtttccgatttaattaatcatggtaatgataaaattgctttcatttctggaccattgtcagaaccaattaatagtaaatatagattacaaggttataagaatgctttatctaagaatggaattgcctatgatgaagaattagtttttgaaacagattatagttaccattcaggtgaaattttatggccagctttacaatcagttggggcaactgcagcttatgtaggtgatgatgaattagctgttggtgtattaaatggtgcgcaagatgcaggtgctaaggttccaactgactttgaaattgtaacaagtaataattctaaattaactgaactagtaagacctaagttatcatctattactcaaccattgtatgatatcggtgcggtatccatgcgtttcttaactaagatgatgaacaaagaagaaacatcagctgatgaaaaaactattgaactaccttatggttatatcaagcgtggatcaacaaaatag

SEQ ID NO: 1165 - DNA, 894 bp, Unknownn
  isolated from dental, unidentified
atgaataatttgccgagaggagtttcaactatggcaaacattaaaattttaacagactcttctgttcaacttacaccagaagaaattgaaaaatataatattacaattgtacccctttctgttgaagtggatggtaaaaattatgttgatggtgaagatatttctcgtgaagaattagtccaagctttaaaagatggcaatattcctaaaacaagtcaaccacctatcggcagatttatagatgcttataatgaactaggtaaagatggcagcgaagtattagctattgtactttcagatgttctttctggaacttacgaaactgcaagtagcgctgctgatatggtagatactaaagtaactgttattaacagtaaatcaactgacagaggattggccttccaagttcttgctgctgctaaagatttagaggcaggtaaaagtattgatgaaattaaagatcaccttaaagacatctatcatcgcacaactattgatgttttgattgataaccttgactgtttagttgctggtggtcgtgtaagtcgtttagctggtgctttaactaaacttatcaatcttaaacttattattcgcttgaacgaggaaagtttggatgttattgtcaagggtcgtagcaagaagacctttatcaagcattgcaagactttagctgaagaatatttacaaaatcacaaccctattcaagcactatccttatcaaatgttggtacagatgatagtctacttcaaaaaatcaaggatactttattagagaataactctatccaagaaatcccttatatcgctcgtttaactagtcctattattatgactcacactggtttaaacgctgttggagttattacacttaacgaaaaacctacacattga

SEQ ID NO: 1166 - DNA, 1332 bp, Unknownn
  isolated from dental, unidentified
atgttacctatggagaaagttcttcgtgacccaatccataattacatttacattcaacaccaagttattttagatttaattaatactagagaatttcaacgtttacgccgcattcgacaattaggagtcgcaaactatgtatttcatggtgctgaacattctcgttttacccattctgtcggtgtttacgaaattactcgcaaaatttgtgatttatttcaacgtaactacccttcaaaagaaaaaggtgatggactttgggatgatgatgaaagattagtcgccttatgtgcagcacttttacatgatgttggtcatggtgcttattcacatacttttgaacatatttttcataccaatcatgaaaaaatgacgactgaaattattacttcatctcactctgaagttaatgctgttttacgcaaagtagctcctgatttcccagaaaaagttgcgagcgttattgaaaaaagctaccctaatcctcaagtcgttcaaatgatttctagtcaaattgatgctgatcgaatggactaccttttaagagattcttatttcactggtacaaattacggaacttttgatctaactagaattttaagggttatgaaaccatactctgatggaattagctttgatatgagtggtatgcacgctgttgaagattacatcgttagtcgtttccaaatgtatcaacaagtgtatttccaccctgtatcacgctcaattgaagttattctgagtcacttattaaaacgtgccaaatatctttataaaaatggtaaaacaaattgtctcggtccaactaatctactctttccattttttgaaggtgattttagtttatcagactacttgaaacttgatgatggtgttttaaattcttacttttccctttggcaagatagtgatgataaaattttgagtgatctggcagatcgattcttaaatcgcaaacctttcaaatctgtaagagtaagcgaagatactcgttacttactccctactcttcgaaaattagtggctgatgccggatttgatagtgaatattatacagctaccaatgatagttttgacttgccttacgacacttattcaccatcgcaaaataagcatcgcactcaaatagaacttatgcaaaaagatggcttattggttgaattgtcgcaagtaagtaatttagtagccgctatttctggtaaagtctctggcgatgaacgtttcttctttccaaaagaaatgaaatcatctgaacagcaattggaattattcggtccaatatattctgagtttcagagttatctaaaaaatgacacattaatcaaaaaataa

SEQ ID NO: 1167 - DNA, 1761 bp, Unknownn
  isolated from dental, unidentified
atgaaaaagaccaagatcgtaagtacccttggaccagctagttctgacctagatacaattgttaagttaatcgaagcaggtgcaaatgttttccgttttaatttctcacacggtgaccatgaagaacatttaggccgcatgaatttagttcatgaagctgaaaaaattactggtaaaacagtaggtttcttattagatacaaagggtgcagaaatccgtacaactgttcaaaaagaaggtaagattcattttgtaatcggtgatgaagtacgtatttctatggacgattctattgaaggtacaaaagaaaaaatcgctgtaacataccctggtttatacgatgacgttcacgaaggtggacatgtattgtttgacgacggtttgattgatatgcaaatcgaaaagaaagacgatgcaaacaaagaacttgtatgtaaagtattaaacgaaggtacacttggttctcgtaaaggtgttaatgctcctggtgtttctatcaacttacctggtattacagaaaaagactctgatgatatccgctttggtttagaccaagacattaactacattgctgcttccttcgtacgtaagccacaagatatcttggatatccgtgaattacttgaagaaaagcacatggaacatgtacaaatcttccctaagattgaatctcaagaaggtatcaacaactttgatgaaatcttgaaagtttctgatggtttaatgattgctcgtggtgacatgggtgttgaaatcccagctgaaaatgttccattggtacaaaaatcattgatcaagaagtgtaacttagctggtaagccagttatcacagctacacaaatgcttgattctatgcaagaaaacccacgtcctacacgtgctgaagcttctgacgttgctaacgctgtatttgatggtacagatgcaacaatgctttctggtgaatctgcaaatggtgactaccctgtagaatctgttgctacaatggcacgtatcgacatcaagtctgaaaatgcattacgtcaacacaaagcattgacattagatgcatttgataagacagatgttacagaagcaattggtcgttcagttgctgaaacagcagaaaacttgaacattaagacaattgttgctgctacaaaatctggtcatacagcacgtatgatttctaagtaccgtccaaatgctgacattttagctgttacatttgatgaccgtacacgtcgtggtttaacagttaactggggtgtacaacctgtattggctgatgctccttcatcaactgatgaaatgttccaattagctacagaagaagctaagaaggctggtttagctaaggaaggcgacttgatcttaatcgttgctggtgttcctgtaggtgaaaaaggtactacaaacatcatgaagatccaattaattggttctaagttagtttcaggtcaaggtgttggtgatgaaactgttatcggtaagacagttgttgcaacatctgctgatgaagcaaataagaacgctgttgaaggtggaattcttgtaacaaagacaactgacaaagattacttaccagctattgaaaaatcatctgctttaatcgttgaaaacggtggtttaacatctcatgcagctgtagtaggtatctctatgggtattcctgtagttgttggtgctaaggatgcaacatcattgatcaagagcggtgaagttgtaacagttgatagccgtcgtggtattgtataccatggtgcatcaaacgctctttaa

SEQ ID NO: 1168 - DNA, 1056 bp, Unknownn
  isolated from dental, unidentified
gtgctaaagatttggaaaagaagtctactgatactgatatgcctcttagctactaattttccaaatttagttaaggcagatacagttacttctagtgatgcactggttcatttcatagataataagctaacaggaaaatatggaatatatactaattatttagcaaaaacaggcaatgatgatactttagcaacaggtcatcaatatttaagtgaatcatctggatattatctgcaatatttagctgaaacaaagcaaaataaaaagtttagagcattttatgcgttaacgaagaaaactttttatcgtcaaggagtattcttatatcgttttgatgccaaacatccagataaatatcaagttaatgcaacagtggatgatttgcgtattatatccgcattaatgacttatgataaagttaatcacacaaaaaagtaccagtctgaagttaaagatctatacaagaaattaagtataagagtgaaacaagcaggcttattgactgatatgtatagtcttgatagtaagacacataatcagttggttactttgtgctaccaagatttatctgttttgaagaaattagattcaaggagttatcacaaagctttacgagtagtggaagagggtaaaattagtcatgaagtgccattatattatcaaagttataacttaaaggataaaaaatatgctaaagataagttggtaactcctcagcttttaataacatttttacatttagctgaggtagataagttacctaaagatagtttgaattgggtaaaacaaaaagtagacacacaaactttatacaatgcttattctgttacaggaaaggcagaagataagtctacttcagcagctaattatgcaattgcgatgatgatagggaatgcagttcatgatgaccaattgtatgatgctgcaaaaaaagttttactatcgatgcaagttacagataagaaatctgaaatttacggaagttttggagatagtaagactaaacaggtatattcatttaatgaattaaatgctttagtagcattaaatcaatag

SEQ ID NO: 1169 - DNA, 1230 bp, Unknownn
  isolated from dental, unidentified
atgaaaagaggaatttacatggaaaaagaaaaagttgttttagcatattctggcggtttagatacatcagttgaaattgcttggttaaagaataaaggttatgacgttattgcatgttgtattgatgttggcgaaggaaaagatttagaagctattaaggaaaaaggcttaaaagtcggtgcagttgaatcaatcgttattgatgctaaacatgaatttgcagaagaatacgttcttccagcattacaaggtcatgcttactatgaaaacaaatatcctttagtatctgctttatctcgtcctttaattgtaaagaaacttgttgaagttgctaaagaacatggtgcaacagctattgcacatggatgtactggtaaaggaaatgaccaagttcgttttgaagttggaatccatgcattagtacctgaaatgaaaattgaagatcctatcagagatttacattggtctagagaagaggaaattgaatacgctaaagaaaatggcattcctgttcctatctctaagaagagtccatactctatcgacgaaaacctttggggtagagcaaatgaatgtggtatcttagaagatccatggcaatccgcacctgctgatgcttatgacagaacagtcgctctagaagatactcctgacacacctgatgttattgaaattacttttgacaaaggtgttccaactaagctagatggtgaagaattaccacttgaagaacttatcatgaaacttgataaattagctggtaaacatggcattggtagaattgaccatgttgaaaatagacttgttggtattaaatcaagagaagtttatgaatgtccagcagcaactgtacttttagctgcacataaggatatggaagatttaactcatgaaagagatttagctcatttcaaaccaattatcgaacaaaaattaagtgaattaatttacaacggtctttggttctcacctttaatggacgctattcaagcattcttagcagaaactcaaaaagttgttaatggtgtagttagagttaaattattcaaaggtaacgttatttgcgaaggtagaaaatcccctaactctctatattctgaagaattggctacttatacttctgctgatcaattcgaccaaaaagctgcagctggttttatcaaattatggggattaccaacacaagtttatgctgaagttatgcaacaaaatgagaaaaacaataagtaa

SEQ ID NO: 1170 - DNA, 564 bp, Unknownn
  isolated from dental, unidentified
ttgatcaaatttggtgttatacttagattgaaagagtttgatagaaggttggaaggaagtaatactatgctaaaaaatttaaatttaacttttggacctgaaaaacaactacaagaaattattgaaaacaataaagatcgtcaaatggtactattagaatctgtaactgattcagaaaagtttgcactattagatatttcaaatgaagaaagtatttttcatagtcaattagattatcgaatttatcacacaattaatcttaaagaatggaatggctttttcgaatttaggtacgtaactttagatacagaacaacaaaaaatttttaatgctcacttaggtaaatgggatgatccattcaatcgtcctgttggcttgaaatctacacttgttggtcatgatgagagaaaagactatgaattcttgatgattaatatctgggaagatcaagaagattatgtcgaatgggaaaatgaaagtgacaatgagttcagagaattcggccatggcggaaatgccaaagcattagttgcacaatataaattggtaaaaaataaagaatag

SEQ ID NO: 1171 - DNA, 2196 bp, Unknownn
  isolated from dental, unidentified
atggtagatttaattacagtagataaagaaaatcgagtttttcatttgcataatgagcaactttcatatattttttcaattgaagatggcgatacgattagtcatttgtattttggtaaaagggtaaaaagttatcatggacaattacgttatccacgagtagatagaggattttctggtaatttaccaggtagtttagatagaaccttttctaaggatactttgccacaagaatatagtagtgccggtgagatggattatcgagttccagcaacagtagtgcgtcaaaaagatggctcaaatggattaatgctaaaatataagacttacaaagttgaagaaggaaaacctgaattgacaggacttccagcagcttatgtagagtcagaatcggaagctaatactttgatcgttacgcttgaagacgagaaaagtggagttttatttgacttactatatacaatatatcgtgattatccaattattacacgttcagttaaggttaagaatctaggacaagaaaatgtaaacttggaaaaagttgcatctatgcaaatagatttttctcaacgagactttgatgtaattagtttaccaggagcacatgtaaatgaacgtcatttggaaagacaaaaattaggatatggaatccaaacatttggtagcattcgtggtacttctagtcatcaaatgaatccatttgttgccttggttgatagtaatactgatgaattcaatggtgctgcatatggttttgcgttagtttactcaggaaaccatgcttttgaaattgaaaaagatcaacttgatcaagttcgattattagtaggaattaatagttataatttcaattggcaattaccagcaggggaaagtttccaaactccagaagtattaatgacatatactgataatggattgaatgctatgagtaaggcatttcatagtattatcagagatagaattacacgttccaaatataaatataaggaacgcccaattctagttaataattgggaagctacatattttgactttgatgaagataaattaaagccaatcgtagacgaagccaaggaactggggatagagatgtttgtattagatgatggatggtttggtcatcgcgatgacgataattcatcattaggtgattggaatgtatacgagaaaaaattccctcaaggcttaaaacattttgcagattacgtacacagcaaagatttgaaatttggtatttggtttgaaccagaaatgatttcaatggattcggaattatatagaagccatcctgaatatttgatgcaagttccaggaagacaaccaagtccatcacgtaatcaatatattttagatatgacaagaaaagatgtcagagatgacatagttgatcaggtttcaactattattgctgataatgacattgattatgttaagtgggatatgaatcgtaatttatctgatatctattcacaaaatctacctgcagatagacagggtgaagtttatcatcgctatgttttaggggtttatgatattttagaaagaataactagcaagttcccagatgttttatttgaaggttgctctggcggtggtggacgatttgatgcaggttttgtttactacatgccacaaagctggactagtgataatacggacgcgattgccagattaactattcaatatggtacaagtttagtatatccaccatcaatgatgacagctcatgtatctgcagttccaaatcatcaaactggtagagtgacaccaatcgatactagaggtgcagttgctatgagtgcagtctttggttacgagttagacttgacaatattaacagacgaagaaaaagaaattgttaaaaaacaagtaaatcaatacaagggcattagaaaattagtccaatacggagatttctatcgtttacaatcttctaaagatggtaataaaacagcttggatgtttgtaagccctcaaaaagatgaagcagtagtaatggtatgtaaagttttaacagaagctcaacctgtattaacgaaaactaaattatatggcttggataccaatagggactaccgtgatgttgaaactaataaggtttatggtggcgatgaattaatggaattaggattctatgatcctattatccgtaatgactatgctgctacaatgtatcattttaaagctgaataa

SEQ ID NO: 1172 - DNA, 624 bp, Unknownn
  isolated from dental, unidentified
atgaccactaaaggaatcttaggaaaaaaagtaggtatgactcaagtcttcactgaaaatggtgaattagttcctgtaacagttgttaaagttgattctaacgttgtattacaagttaagacaatggaaaacgacggttacgaagctatccaattaggttttgatgacttgcgcgaagttttaacaaacaaacctgctaaaggtcatgcggcaaaagcaaatactactcctaagcgcttcgttcgtgaaattcgcgatgttgagcttggagaatataaagttggagacgaagttaaggcagatattttcgaagctggagacttcgtggatgtaacaggtacgtctaaaggacatggtttccaaggatctatcaaacgtaatggtcaacatcgtggacctatggctcacggttctcgttaccatcgtcgtccaggttctatgggtgttattatcaaccgtgttatgaagggtaaattactcccaggacgtatgggtggcaacagagttacgatccaaaacttggaaatcgttaaagctgatacagaaaatggcgtacttttgatcaagggtaatgtgccaggcgcaaacaaatccttagtaacaatcaaaagtacagtaaaataa

SEQ ID NO: 1173 - DNA, 948 bp, Unknownn
  isolated from dental, unidentified
atgccagaaagaaaaaaattgttacaagttaagcatttaaaacaatactttacttccggtaagtccactgttaaggctgttgatgatgttacttttgacatttacgaaggtgaaacatttggacttgtaggagaatcaggttcaggtaaaacaacaacaggacgtagtattattcgtttatatgatccaactgatgggaaaattattttcgatggaaaagatgtcagcaagttaaaatcacgtgctgataagcgtgaattcaatcgtaaaatgcaaatgatcttccaagatccatatgcttccctaaatccaagaatgacagttgaagatattatcgctgaaggtattgatattcatggtttggccaagagtaagaaagaacgttcagaaatggttgaaaatctacttgaaacagttggtttgaatcgagatcatgctagtcgttatccacatgaattctctggtggtcaacgtcaacgtatagggattgctcgtgcattagccgtacaacctaagtttatcattgctgacgaacctatttcagctttggacgtttctattcaagctcaggtagttaacttattgaaagatcttcaagaagaaaagggattaacttatctttttattgctcatgatttgtcgatggttaagtttatctccgatagaattggggttatgcattacggaaggttgttagaagtaggtccagctgatgatgtttatgataagcctttgcatgactatactaagagtttgatttctgcagttccaattccagatcctgaaattgaacgtcaacgtcatagaattgactatgatccttctattgaagatgacgatggcgataaggttcgttctttacatgaaattacaccaggtcattttgtaagatgtacggatgatgaagtggaaatgtataagaaaaaagctgctgaatacgaaaaataa

SEQ ID NO: 1174 - DNA, 780 bp, Unknownn
  isolated from dental, unidentified
gtggaaaaaacagaagcacgttgggtagaagtattcaaggtgtctctaccattatgcctaagttatgtgccaatcggtttggcgtgcggaattttattacatgctgccggttttaacccgctattaactttattggtatccgtattagtattttcaggtggagctcagttcttgatagcttctatgttaactacgaataccccaatgcaaacgatagttattatgctatttttcctagagttacgttatgcgttgttgggttcaagtttgtcacaatacattaaaggaacaagcaagaagtttttatatttctttgccgtttcattgaatgatgaaaattatgctgtaaactacttaaaattcgcaactgataagagctggacgcctaaagatgccttagctgtagaacactggtccttactattttggtctgtagctaattttattgggagtttagttggtaatttattaccaatggagaattatctagatattgtcgactttgctctaactgcaatgtttatttatatgattgttatgcaaattcgcaacaaactaacaattttagttagttttatttcaggggtaattgcaattgttgcgttagttactttgaagagtacaatgggactaatagtagctacattgttagcttcctttatcggttttatgattgaacataatatcgttaaaaaaggtgaagccaagggcaatttctggttgaagaagatcaagccaaaggcaagtcggaaagttattagtaagtcaggagaaaaatga

SEQ ID NO: 1175 - DNA, 837 bp, Oribacterium sp.
  isolated from dental, Oribacterium sp.
atgaagaagattaattggaaaaatgtgtatctatgggtaatgtttatcttcttatatgcaccaatcttttacttgatattttatgcctttaatagcggtgaaacgatgaatagatttgaaggttttagttgggttcattttcaagaattatttgctgatacgcgattattgataattttgttagaaactttcattttagctttcttatcggcattgattgcgaccatgataggaacttttggtgcaatttcaatttatcgttatcaaaaacgcagaacaaggctggctttattatcgttaaataatattttgattgtatcgccagatgttattataggtgctagtttcttaattctatttacactattaggttcctggatacatagtttatcattaggatttgctagtgtactgttatcccacatagctttcagtattccaattgtagttttgatggtattacctaaattacaagaaatgcaagattctttgacgatggcagcttatgatctaggtgcaaatcactggcaagttttaacaaatgttgtactcccttacctaacaccaggaataattgcaggatactttatggcattcacatattcattggatgattttgcagttacattctttgttacagggaatggctttacaactttgtcagttgaaatttactcacgtgctagacgaggagttagtttggagattaatgctttgagtgcattagtattcttgttctctttagttttagtaataggttattactttattagtcgtgataatagcgccaatcatcgccgccaaggcaagcaagttagaaaaggggtgctacgctga

SEQ ID NO: 1176 - DNA, 507 bp, Unknownn
  isolated from dental, unidentified
ttgaggcgttatttttttaaactcaaaaaagaaactcctggatgtgtgtacttaattaatattcttaaaataaggaaggaggaagctttagagatgcctacaattaaccaattaattcgtaaaggtcgtaaatctaaaggttcaaaatctaattccccagctttaaactttgggtacaatagttataagaaagtacaaacaaacaactcagctccacaaaaacgtggtgttgcaactcgtgttggtacaatgacacctaagaagcctaactcagctttacgtaagtatgctcgtgttcgtttatctaacttaattgaagttacagcttatattccgggtatcggacacaacttacaagaacatagtgttgttcttattcgtggtggtcgtgtaaaagacttacctggtgttcgttaccatatcgttcgtggtgctttagatacagcaggtgttgaaggccgtatgcaaagccgttctaagtacggtgctaagaagcctaaaaaataa

SEQ ID NO: 1177 - DNA, 852 bp, Unknownn
  isolated from dental, unidentified
gtggtagtttggtataatcctgctgatgatgttttgaataatatcaattcttatattactgaaattgagaaattatatatcattgataactcaaaagataatcacaacaacttattagctgattacaaatatcagaataaatgtgagtacatttctttacataaaaatctaggtttgacatatgctttaaatgtaggttgcaaaaaagcaattaaagatagctttgactatgttctaacaatggatcaggattcaatatttgaaccaacagctgttagtaaattaaaggtagcggctcaaaaagataaacgatatggtatcatttgtccaaatgttaagtctatttatcatgatgagaaaactaatctagacaaagtagcatatctaaaatggaaaaaggaagaatttaaagaaattccctggacaatgacttctggaagtttaacctcacttaaagcttatactgatgttggtggctttgatgatgatttatttatagcccatattgatatagatttttgcattagactaaaacaagataactggaaaattttaatggtaggaccagcagttattaagcagcgttttggaaattctaaaccagtgcgaattttatggaaaaaagttcacccatcatttgctagtcctgtgcgaacatattatttattcagaaatcagaaatatctagaaatgaaatatggaaaagagattcataaatttataggggtagatttatggaaattctttgtaaaaattactttgtttgagaaacaaagactaaagaaatacttgatgatgtttcaaggatacagggatgctaaagcaaatcgaatgggaaaatatagagattaa

SEQ ID NO: 1178 - DNA, 1590 bp, Unknownn
  isolated from dental, unidentified
atgatagatagtttggagataataattttattatttgaattggtattttttgctgttatcagcattataattgctgagatgtttgttaaagtatcaatgaattacgttagtctaattatgggagcggttttaggattacttcctgtaacgacttatgacatccgttcatttaatccggaagtttttatgcttttaatcgtagcaccgctattattctttgaagggcaagctactttccttaatgtagttggtaaaagggtaaaacagattttccaagttacagttatcatggtcttactttgtgcaatcgtagccggatttagtagctatgcaattggtaagattggcttgccattggcttttatcttagctgcaatcagtacaccaactgatgcaacagccactcaatcagtaactgaaggactaaaaattccacgtcgcgaaggattctttttaaaaatggaatcattatttaatgatgcttcaggaattattttattaaacatggccgttttatggtatatcaatggaagaataaactatcgtgaaacattgacagattttattttatctgctgggggtgggattgtaattggttttataatcgcatggattattgttttattcaggcaagtactccttagaagttcgtataattctgtaaatgcacaggtgattatttatttaatgacaccatttattatctattatctggcggaagagtttcatgtttctgggattattgcagtagtttgtgcaggattggtgcataatgctgaaactcaacgtagtcgactagcgaatgctcaaatggtgtatatgggtacaaatttagtttcaatcattacggaacttttcaacagcatcgtttttgtaattttaggaatgatgttggttaatatcattaaagatgagagtatcacttataattcgtggatctggataactttaggtgcaattttgtatctatccaatgtaattgtacggtatatatatggcagaattaaatttaaaatggataatcgtgcaggttggatcttttctttaggtggtgtgcatggagctgtaacgttatccctagcatttacagtagctaagactagtgttaatagtcaggattttagcctagtagtgatgtctgaaagtgtactgattattttgagtatgatagttcctactattatttttaggtttattttagaaaaagatgtttctgatgaagacggtgaaaaggaattagatgaattaagagaagaaatgattcaacaagcaatcgccactgtgcagaaaatgtacttagcgaaaaatgtaaaacaatctgtaatttttgatttgaagtctcaaaatcaaaatacaagaacaagggattttgtcaaagaatggcgtaatgcagtacgtcatccacaatatacagaagcggaaaaagaaatggaaagacgtgcatttattaatgcattctatcaagaacgacaatatttagatatgatttctcaaaaagaagcacggtatgaaaaatatgtgtatcacttatatagtgaaattcttttagctgaatcgatagttctcaattcggaatttgttgaagaatag

SEQ ID NO: 1179 - DNA, 978 bp, Unknownn
  isolated from dental, unidentified
atggatttatttgataacttaaagcaaaaagttgcaggagcaaacaaaacaatagtattcccagaaggacaagaaccacgcatttttcgtgcagctattcgattgaagaatgacggtttagtagttcctattttgttaggaaaagttgatgaaattaagcaaaatgcggaaaatgaaggggtagatttaggagatattgaattaattgatccaaatacttatcctgaagataaatttgctgaaatggtagaagcttttgttgaacgcagaaaaggcaaaaatactaaagaacaagcagaaacaatgctacgtgatgtaaattattttggaacaatgttagtttacatggataaagctgatggcttagtttcaggtgctattcattcaacaggggatacagtacgcccagcattacaaataattaaaacaaagccaggcgtaagtagaacaagtggtgcttttgtaatggttaaaggcgatgaaagatatttatttgcagattgcgctattaatattaatccaggtgcacaagaattagctgaaattgctgtggaaagtgcaaacactgctaaaatttttgatattgatccacaagttgcaatgctaagtttctctacaatgggttcagctaaatcagatgaagtaacaaaagttcaagaagcagtaaaattagctaaagaattagcacctaatgaaaagattgatggagaactacaatttgatgcagcttttgtaccagttgttgctaaacaaaaggcaccagaatcagaagttgcaggacatgctaatgtctttgtattcccagaattacaatctggaaatattggatataaaattgcacaaagattaggaggattcgaagcaattggacctgttcttcaagggttaaataaacctgtatcagatttatcaagaggttctgttgaagaagatgtctacaaggttgcaattattacagcagctcaagctttgatgtaa

SEQ ID NO: 1180 - DNA, 2859 bp, Unknownn
  isolated from dental, unidentified
gtgaatttctcatttgaaaaaaaagatttcaaaaaattatttatttggtattcaatttcatttgcgatagtcgctttttttgtttatggctcctattatttttcaggccattcattaatttggcaaatagatggttctcaacaacatttacctctattaattaattatcgcagagctttaattgaatttttacaccatcctttttctggtataacgacttggtcttggaaatacggattaggtgctgatacttttcaaatttattcttattatacagttggagatatctttgcttacctaaccttactatttcctgcaagtaaaataatttttgcttaccagttaatgattattttacgattatattttgctggattagcttttacatattttgctaatcatttcgacttgaaaaagtcagtcattattccaggagcaatggtttatatttttaatgcgtatcttttatacgccaacgttgcacaaccttttttcacaactgcattcataatttttccactaattatcttaggtttagaaaaagttttgcaagaaaaatccgcttggatgttgacatttgcattcacttggatgttaatcaataacttttattttgcctttattttaggcattggagctatgatttatttagtaattcgagtctttttcacttatcgtaagactttaaattacttcttaatatttcggaagctcgcaggttctactattttaagtttgttactgagctctgtacttttaatccctgaattacttgcagtacaaaactctactcgagctggtagtactttcgccaatgggttaaaattttatccactctactattacttagccttaccatcgcagctaattaatggtggaaaccgtgatttttacttttggagtgctttaggtttttctagcatcgcctttttcggagtaatttatgtccttgctaagtatcgaaaatatccagttatgactgctattttcatccttagtgggattatgcttttattccccgcttttggtgcagcattcaatggtttaatgtctccttcaaatcgttggactctaatgctttgcttaccagtttcattatctgtatgtattttactagaacatgttaagaaactatctccaaaaatgttaaagtacattacaattactaccgctatttatatcagtattgtaggtattaattattatttccaaaatagtgaaaaattatttattcctatcatcttcttatttgtatttttaggtttgattttttggttacgtttcattgattataaacacgcttatcgatgggcaaatattttagtattgttaaatgttattttaaatgctatttattttgaaacaccttataatggaggttttgctaatgaaatgttaccagctggtgcttatgataaattgcaaaatcaacgttatgctggtttagattcagatattgataatgataatacttttaaagtttctactattagtaataactattacttaggtgaagactttaaaatgtataacactcttaacgaaaaattgcatggacttagttcatattattccttacaaaacaaatatataggtcagtttgctttaaatatgcaaaatgtccaatatgaaactaatgtgcctctgcaacagtttgatgaccgctcagtgatcttaaactttttaggagttaaatatttatttactcagttgaatcaagaaaatgatactaaaattccatatggttatcatctcgataaaactactcgtttaatctatgatgtaaaccaaaattctagtaaaaaccaacaaacacgtagatatgctactaaaaataattttcctttgctttattggcaagacactgctatcactcctaaaaattacgataaactcagtgtctctcaaaaggaacgcttattaagtaaggcagtctttacatctagtaataatgccaaaggattgaaaaaagctaaaatttccaatactgatgtaattgacattccttatgtattggtttctagtcgtggaaatgttattgatactaataacttagaaaaacttgatgctaatgaaacttacaaacttgttttacaattagataaattgaaggaaaagaataatcttcctcaaaatgtagaattacatgttgaaataaatgatatcaagtacactccattttctttcaagaaacaaattgcactggaagaaaaaaatcaaacagatgatctaactaatggtcttctagctgctaatgaaaaattggcctactataaatactttagatatcatgttttgaagggatcacctgatatgagttatgctttaaatatcagctctaatcttggaactgaaacaattgctcaacctcgtcaaagcaaaacttcattctttaaaatcgtaaacagtggaaccatgaatatgggatatttcaagaatttaccggagactttaaaacttactccttcaaaaatgggaacttatagttttaaattaaaggtttatgctgaactattaaatactagttacgataaagaagtagctaaaattcaaaaacatgcacttcaaaacttaaaattcaataagcacggtcttgaaggaaaaataactactaatcgtactggaatattaacttcttcaattccttattctaccggttggactgccacagtagatggaaaaaaagctcctgttattagaactaaccaagcttttgtaggattaaaactccctcaaggcacacataaagttaaattagtctataatattccaggtttgaaactagggatgattacctcaatcgttggattaattcttttagcaattagtttgatatatactaaatttaagaaaaaataa

SEQ ID NO: 1181 - DNA, 576 bp, Unknownn
  isolated from dental, unidentified
atgaacggcaagcagcgtatggttgagcagtctaagcaatggttatgtgacgcccttataaatttaatgacgaaagagaactttcaggatatttctattactgaaattgcccaaaccgctgaattatcgcgaaaaacattctatcattcttttaaaaataaagaagcggtcattaattacctgtgtgatcagttgttcgatcagtactttgaacaattactccagcagaaaccgcaggtaggggaactgatgttaaaaactacttttgatatttttttaaatttttggtggcgaaaacgggatttaattcaattattgatccgccaaggcttatttgatcacatgaatgaaatttggcagcaaaaagcaatccctcgttatcaacagtttgcagctccttggcatgttcatggcactcctacccaagtgaattatgtgatggcttttcaactaggtggtttaactaatattctacgtgtctggttaggacaagatcagcctgagccaccagagcaaattaaggatctaatgttgttggctgctcagcaattagctgatagtttaaatacaaattag

SEQ ID NO: 1182 - DNA, 1338 bp, Unknownn
  isolated from dental, unidentified
atgaagaataagacagttagattactagcagttgaattactaactagagttgaaagtcaaggtacatattcaaatctagcattaaataaagtgatagaagaaaataacttttctgttaaagatacaaaattattaacaacaattgtttatggagtaatacaacataagttaactttagaatattggttagaaccatttattaagaaggcaaataagttacaattatgggttaaggaattattattagtatcattgtatcaaatggtttatttagataaaattccagaccgagctgtatttaatgaatctattgaaatagcaaaaatcaagggacataccggtattagaaaatttgttacaggtgtgctgcattcaatcagaagaaatggtttgagagaagttaatgaaattgataacgatattacaagtttgagtatagggactagtacccctgagtggctagtggaagaattaattaaggaattaggaattactaaagtcgagtcgatattagatacaataaatacttctccaaagcatagtgtaagaatcaatactcataaagttaacaagcaaattttagtaaatgaactaaagaatgacggctatacgattagagaaagtgaagttacaccagatgcattaatagtagatggaggcttcttaccaaagagttcggaatttcgaaatggaaagatgataattcaagatgaaagtgcaatgttagctgttgaaagtatggatattcaaaaagatgatatagttctagatgcttgtgctgctcctggtggtaaaacaacacaaatagctgaaaaattaatgaaaggtgaaggcaaagtttgggctttagatattcacaaacataaggtgaaattgatagaagaaaatgctaataaattaggattaatatctaaagtatcagctaaacaattagatgcgagaaaggcgataacggagtttgattcggaaaaatttgataaaattttagtagatgcaccttgttctggattaggattaatgagaagaaaaccagaagtaaaatatgaaaaaaagctggctgactcatatagtctacatgatattcaagttaatattttagaaaaagtagcacctttattaaaaaaaggtggatacttgacttatagtacatgtacaattttaaatattgaaaatcaaaaagttattgatgattttcttaaaaagcatccagagtttgttcaagaaaagacttatacaaaaaataaattaaaagatgaaagagatacactttctttaaccatatatccagatgattacatgtcggatggtttctttatagcaacgctacgtaaaaaatag

SEQ ID NO: 1183 - DNA, 1566 bp, Unknownn
  isolated from dental, unidentified
gtgaaagacttggctaatgttgatatgcaaacatttgataaaattatcgttttagactttggtagtcaatataaccaattgattacacgtcgtattcgtgaattcggtgtttactctgaattactatcacataagcttacagccgctcaaattaaagaaatgaatccaaaaggaattattttctctggcggtcctaacagtgtttatgatgatggtgctttccaaattgatcctgaaatttttgaattaggtattcctattttaggtatctgttatggtatgcaattaatggcacacaatttaccaggtggtaaagtagaaagtgctgacaataaggaatatggtaaggctattattacagttaagaatcaagaaaatgtaatgttcaaagacttaccagaaactcaaacagtatggatgagtcacggtgatttagtaacacaagttccagaaggctttgaagttacagcaacaagtgataactgtccaatttctgcaatggctaacgatgctaagaaattctacggtttacaattccatacagaagtacgtaacacagaatatggtaacgatattttacgtcattttgctttcgacgtttgtcaagctcgtagcaactggtctatggatgactttatcgacatgcaaattcaaaagattcgcgaaactgttggcgataagaaagtcttacttggattatctggtggggtagattcatcggttgtaggtgtattgctacacaaagctatcggtaatcaattaacaagtatctttgttgaccatggtttgttacgtaaaggcgaagctgaacaagttatggatagcttgggtggcaagtttggcttgaacattattaaggttgatgctaaagaacgtttcttgaacaagttagcaggtgtatctgatcctgaaaagaaacgtaagattatcggtaacgaatttattcgtgtctttgatgatgaatctgctaaattagaaggaattgaattcttggcacaaggtactttgtatacagatattattgaatctggtacagatactgctcaaacaatcaagtctcaccacaacgttgggggattaccagaagatgttcaattcaaattaatcgaaccattgaatactttatttaaagacgaagttcgtgaacttggtgaaaagcttggaatgccacatgaattagtatggcgccaaccattcccaggtccagggttaggtattcgtgtaattggtgaaattacagaagaaaaacttgaaattgtacgtgactctgatcttatcttacgtgaagaaatcgcaaaacatggtttagataaggaaatttggcaatactttacagtattaccaggtattcgttctgttggtgttatgggcgatggtcgtacttatgactacacagttggtattcgtgcagtaacttctatcgatggtatgactgctgactttgcacaaattccatgggatgtattgcaagaaatttcagtacgtatcgtaaacgaagtagaccacgttaaccgtgtagtgtatgacattacttctaagccacctgcaactattgaatgggaataa

SEQ ID NO: 1184 - DNA, 1320 bp, Unknownn
  isolated from dental, unidentified
ttgtctagtggtcaggcggttagcaatttaatcgttgtagtaattgtatttttctttgctgctttctttgtggcagctgaatttgcaattgtttcagtacgtaaaagtcaaattgagagtatgttagaggatggagaaggtaacaagaaaaagctcgaaatggctttgaagatggtcgataacatgaacgaatatctatctacaactcaggtaggtgtttcattgacaggaatcatcttaggttggcttggagcagataccttatcgcaaatttttgctgacttttttggttttacaccgttaaatcacacaactattatggcaattagtgcagttttaggtgttgttttacttacatatttggaagttgttttaactgaaattgtacctaagaacataagtattgatatgccgatgaaagtgatgatgtttgtggttcgcccactacattacttccacatcttattctatccatttgtgtggttattaaatgcttctgctaacggtatagttaaagcgatgggattaaaaccagctggagaagacacagatgtattgtcagaaaatgaaatcttaaatttatcaaagaatgcagttactggtggttcgatagacaaagaagactatctatatatgcgacgtgcatttgaatttaatgataaagttgctaaagatgttatgattgatcgaacaagtgttgaagtggtagatattactgctactgtaaaagatgttttaaataaatatcttcaagaaaaacactcacgttatccggtagtagccaataatgataaagataagattttaggttatgtctatatttatgatttgattcgtcaatcacgtgtagatgatacgatcaagatttctaagttattgagaacaattatttctgttcctgaaaccacagaattacaaggcttgttacgacaaatgacaagaaaacgagttccaatggttgtggtgttagacgaatatggtggaactagtgggattgtaactgatagagatatttatgaagaagttttcggaacagttttagatgaagctgatgatgttttaccagatgatattattgataatcacaatgggacatataaagtctcaggtaagacaactttatacgactttgagcgttattttggattccaagaaaaagatttcttagaatcagaaagcgtaacattggcaggatatttacaagataactacaagattcagttgggaactgaagttgaacttggtggcttgaaagttaaagttaccgaattcaatagaaattatgttgattgggtcgaagtttgcgaaatgaagaagtaa

SEQ ID NO: 1185 - DNA, 1422 bp, Unknownn
  isolated from dental, unidentified
atgaaatcattggaaaaagttgattataaaaagtttatagtcccagttatagtgggcttaattatctggtttgcaactccacttagaccagtagcgatttcagttgctggttggcatatgtttgctttgtttgttgctactattattgcatgtattacacaacctctaccaattggtgcagtttcgattatcgcttttgctttggttgttttgacgagaactgtgccaatggaaaaggcaatcgtaggatttggtaatgcaagtatttggttgattgcgatggcattctttatcgctcgtggttttattaaaacgggattgggtagaagaattgccttgatatttgttaagttattcggtaaacgtactttaggattggcttattcattgatcggggtagatttgattctagcaccagcaatgccttctaacacagcacgtgcaggtggtatcatgtacccaattattgaatcattagccaaagaatttgactcagatcctaagaagaaaacagaaagaaaaatcggttcatttctaatttttgctgaataccatggtaatatgattacttcagcaatgtttatgacagcgatggccggaaatcctttagttcaaactttagctaagagtaatggtgtgcatcttcaatggatggattggttcttagctggattagttccaggtttattgtcattaattatcattccatttattatttacaagctttatccacctgaaataaaagagactccaaatgctaaggaatgggcagattcagaattagaaaaaatgggtaaaataacagttcctgaaaaagtaatgattggaatctttattttcgcattattattgtgggtcttaggtagtacattaaagattgatgctactttaacagccttcatggcactttccttattgttgattacaggtgtcttaacttggaaagatattttaaatgaaagtggtgcttggaacacattgacatggttctcagttttagtaatgatggctagtcaattaaatgaattaggctttattccttggttgagtaaaacaattgctggttcattacatggtattagttggttctttatcttgttgattttagttctagcattcttctatagccattacttatttgcatcttcaacagcacatatcagtgcgatgtacggagctttgttaggtgtagctatatctgctggtgttccaggaatgttagcagctttgatgttaggattctttggtaatctttgtgcatctacaacacactatgcttcaggtcctgcaccagtattgtttggctctggttatgtaacacaatctaaatggtggcaaatgaatgccttcttaggaattatctacatcgttttgtggatggttgtaggaacactttggatgaaagttatcggtatgtggtaa

SEQ ID NO: 1186 - DNA, 1779 bp, Unknownn
  isolated from dental, unidentified
atggcgacacaacatattgaaaacaaattaaaactattaccagatttgcctggctgttacatgatgaaagatattaatagtagaattatttatgtaggtaaagccaaaaatttaaaaaatcgcgtacgttcatattttaaaagtagtcatgaaggaaaaacagctaaattagtgtctgaaataagggattttgaaacaattatcacttcaactgataaggaagcatttttgttagaaattactttaattcaaaaacataagccttactataacattaagctaaaaaggggaactgggtatccgtatattaagataactcatgaaaaagacccacaattaaaaattgtcagtcaagttaaaaaggatggtggctattattttggcccttatcccaatgtctatgctgcaacagaaacattacagttactgcaaaaggtgtatcctttaagacgttgtaatggatatcaaaaacggccatgtttgtactatcatatgggacaatgcttgggtgcctgctttaaagaagtcccacaatccgaatatgaaaagcaaatcaaaaagataaagtcatttttaaatggaaatgtaagtaaaataaaaaaagaacttgaacaaaaaatgaaaactgcatccgagaatctagagtttgaaagagcagctgaaataagggatcaaattcactatgttgaaatgacagttgaaaaacagaaaattattagtaatgataatacaccacgtgatttatttgctttttacatgaataaaggttggttatctttacaaattttctctatcagacaagcacgtttgatgaaacgtgaaaaacgactatttccatgtatagatacgcctgaggctgagttagaatcttttattttacagttttataatcaaaaaaaccgtattttacctaaagaaattttagttccttcggggatggataaagaaacattaagtgaaattttaggtattccagtcaaaacaccacaacgaggacaaaagcgtgatttactagaaatggcacagaaaaatgctagattagtattggaagaaaaattccgtttacttgaattggatgaaagaaagacaacaggggctatgaatgaaataacagacgcgttaggattgcctaatggtcatagaattgaagcatttgatcattctcatttacaaggagaagacttagtatccgcgatggtttgtttcattgatggaaaaccagaaaaaacagaatatcgaaaatataagttaaaaaatgttgaccatgctgatgaagctgctagtacaagagaagttatttatcgtagatatagtagacttttgaaagaaaaagccaatttacctgatttaatattaatggatggtgcaagtattcaaattaatgccgctgttgatgttttacataatcaattaggtattgatattcctgtagcaggaatggtaaaaaatgatcgtcataaaacggctgatttaatgacggaaaatgatgaaaagattggtttagatcctaaaagtgaaggcttttatctactacaaagaattcaagatgaagttcatagatttgcgattactttccatcgccaagttcggtcaaaaaattcattagcttcacgtttagaaagaattcaaggagtaggtcctaaaacgagaattaagttattaagaaattatggttccctgaagaatatttctgcagcttcagtagaggatttggaaagcttaggtatttctaaaaaagtggctcagacaattaagttaagcttgaaaaaccaaagttag

SEQ ID NO: 1187 - DNA, 966 bp, Unknownn; identical to SEQ ID NO: 584
  isolated from dental, unidentified

SEQ ID NO: 1188 - DNA, 3075 bp, Unknownn; identical to SEQ ID NO: 592
  isolated from dental, unidentified

SEQ ID NO: 1189 - DNA, 699 bp, Unknownn
  isolated from dental, unidentified
atgttgaaaacgtttatacacaatgattggcaagaagtattaggtccagaatttgagaaaccttattatacagaattgcataattttttaaaaaatgaatataagacgcagtatattcacccagatatgtaccatatatacgaagcctttgaatggacgccattttcaaaggtaaaagttgtcattttaggacaagatccttatcatggccctaatcaagctcatgggttaagtttttctgtgttaccaggcgtggctattccaccttcattacggaatatctacaaggagttatactccgatttaggaataaaacctgttaatcatggttatcttgaaaaatgggctaaacagggtgttttaatgttaaattcagttttaacagttagaaatggacaggcattttctcatcaaggaaaaggttgggaaaaattgacggatgaagcgattaaaaagctctcagaaagaccaatgccagttgtttttatattgtggggagctgctgctagaaaaaaggcagctttgattgatagaaagaagaatatcattattgaatctccacatcctagtcctctttctgctaacaggggattttttggatctcgtccgttttcaaaaactaacgctgctttagaggcattaggtgaaacgccgatagattggcaattaccagagaaagtagaattgacagaaaagtaa

SEQ ID NO: 1190 - DNA, 1728 bp, Unknownn
  isolated from dental, unidentified
atgagttggcaagatacttaccaagactggaaagaaaataaagaattagttgaagatttacgtgcagatttagtacgtatggaaggaaatcaagatgaacttgaagatgcattctatgcaccattagaatttggtacagctggtatgcgtggggttttaggtgcaggaattaatcgtatgaacatttatactgttcgtcaagctactgaaggtttagctcttttcatggaaactcttgatgaagaaacaagaaaacgtggtgtagctattagttacgattcacgtcaccattcacaagactttgcttttgaatctgctagagtattaggacaacatggtattccaacatttgtttttgaaagtttacgtccaacacctgaattatcattcacagtacgtcacttacatacttatgcaggaattatgattactgcaagtcacaatccaaagcaatataacggatataagatttatggtgaagatggggcacaaatgcctcctaaagaatcagatttgattactaaatatattcgtaaagtagacgatctatttgcgattaaagttgcagatcaagaagaactaattgaagatggtgttcttaaggtaattggtgacgaagttgataaagcatacttagatgaagtaaaacaagttactattaaccaagaattagttgctgaagaaggtaagacaatgaaacttatcttcacaccacttcatggtacaggagctatgttgggtgaaaaagctttgcgtcaagcaggttttgaaaactttacaatggttccagaacaagctaagccagatcctgatttctcaacagttaagaaaccaaatccagaagatacagcagcctttgatttagctattaaattaggtaaagaagaaggtgcagatttattagttgctgttgaccctgatgctgaccgtttgggagcagctgtacgtcaaccagatggtgaatatcaattattaacaggtaaccaaattgcagcaattatgttaaactacattttaactgctagaaagaatgcaggtactttaccagctaacgcagcagcagttaaatcaattgtatcaagtgaatttgctacaaagattgctgaaagttttaacgtagacatgatcaatgttttaactggattcaaatttattgctgaacaaattaagcattttgaagatacaaatgaacatacatttatgtttggatttgaagaaagttatggatatttggttcgtccatttgttcgtgataaagatgctgtacaatcacttgtaatgttagcagaagtggctgctttctataagaaacaaggtaagaatctatacgatggtcttcaagaattatttgaaaagcatggatattttgttgaaaagacaacatcattaacttttgatggagttgaaggtgctaataagattaaagacttaatggctaaatttagagctgaagcaccaaaacaatttggtgattataaagttgttgcaatggaagatttcgataaatctgaaaagagttatgctgacggaaaagttgaaacaatgactctacctaagtctaacgtattgaaattcttattggaagatggtacatggattgctattcgtccttctggtacagaaccaaagatcaaattctatattggtactttaggcgataccttagaagcagcaacaaagaaacgtgcagtctttgaagaagaaattaataattttgtaaatgaataa

SEQ ID NO: 1191 - DNA, 1044 bp, Unknownn
  isolated from dental, unidentified
atgtcagagaaacatttaacaacagaagattttgattatgatttaccagaaagtttgattgcacaaacaccacttgaagaaagagatcaatcaagaatgttgattctagatagtaagactggtgaatatcaagatgattatttttataatgtaattgatcaattaaatcctggtgacgcattggttatgaacgattctcgtgttatgccagcaagaatatatggtgtaaagccagaaacaggtggtcatgtggaggttctattattaaataatacacatggcgatgaatgggaaactttagttaagcctgcgcgccgtgctaaggttggtacaaagatttcctttggtgatggagctttaaaagcaacagttactaaagaattggaacatggtggtcgtttaattgaatttgaatatgatggaatctttatggaaatcctagataaattaggagaaatgccattaccaccttatatcaaggaaaaattagaaaatccagaaatgtatcaaacagtttattcacgtgaagtaggatctgcagctgctccaactgctggattacactttactaaagaattgctacacaaaattgaagaaaaaggtgtaaaactagtttacttgactttacacgtaggactaggaacattccgtccagttagtgaaaaaaatattgaagatcacaagatgcatagtgaattctatcgtttaactgaagaagcagccgcaactttaaacgaagttagaaaaaacggtggacgtattgttgcaacaggtacgacaagtattagaactcttgaaactattggtaccaaatataatggtgaaattaaagcggatagcggttggacagatatctttatcaaaccaggttatgaatggaaagtagtacaagctttcattaccaacttccatttacctaagtccactttagtaatgttagttgcttcatttactggacgagaaaacattttgaatgcttataagcatgctgttgaagaaaaatatcgtttctttagttttggcgatgcaatgtttattaaatag

SEQ ID NO: 1192 - DNA, 768 bp, Unknownn
  isolated from dental, unidentified
atgggaacagttattgcaattgccaaccaaaaaggtggcgttggtaaaacaaccacaagtgttaacttgggtgcttgtttagctagagcaggacaaaaagtattgttaattgatactgatgcccaggggaacgcaacaagtggtattggtgtaagaaaacacaatattgaaaatgatgtatatgatgtgattgttagcgaattaccgattagagaagcaatcatgcctacttatatcgataatttagatgttgtgccggcaacaattcagttagccggagcagaaatagagctaacagcacaaatggctcgtgaaaagaaattgtatgatgcagttcaagatgttaaagaagagtatgactttattttaattgattgcccaccttctttaggactattaacaatcaatgcttttacagccagtgattcaattttaattccagttcaaagtgaatattacgctttggaaggattgagccaattgatgaatactattcaacttgttcaaaagcacttcaatcctgatttacaaattgaaggtgtattaatgacaatgttggatgcaagaactaatctaggtaaccaagttgttgaagaagtaaagaaattcttcaaagaaaaggtatataagacagttattccaagaaatgttagattatcagaagcacctagtcatggtatgtcaatcattgattatgatcctagatcacgaggtgcggaagaatatgaagcattagccaaggaggtgttaaaggctcatggcaagtag

SEQ ID NO: 1193 - DNA, 645 bp, Unknownn; identical to SEQ ID NO: 590
  isolated from dental, unidentified

SEQ ID NO: 1194 - DNA, 732 bp, Unknownn
  isolated from dental, unidentified
atgaaattaaaagaaaaagtagttctagtcactggaagttcaagaggaattggtgcagaaatagcattagcttttgctagaaaaggaagtactgtagttttaaatggacgccatcaaatacctaatgatatgattagtaagatggaagaaattggttgtaactatgatgtcattcttggtgatatcagtatagaaagtgatgttaaaagaattgttaaagaagttatcgaaaaatttggtagaatagatatactgattaacaatgccggaataactaatgataagttactaattggaatgaaacctgcagattttaagtctgtaattgatgttaacctaattggaactttccaaatgacacaagctgttgtgaagaaaatgtataagcaacgatcaggagtaattataaaccttgctagtgtgattggacagcatggaaatattggtcaagctaactatgcagcaagtaaagccggagttatcggattaactaaaagtgtggcaaaagaaggagctatgcgaaatattagagttaatgcgattgctccaggaatgatagttagtgatatgacagatgttttaagcgataaagttaaagaaaacattctcactactatccctttaaatcgttttggaaaagcagaagaagttgcacaaactgcagtctttttagctgaaaatgattatataacgggacaggtaattactgttgatggtggaatgacaatttaa

SEQ ID NO: 1195 - DNA, 648 bp, Unknownn
  isolated from dental, unidentified
atgaaaatagctccttctattcttagcgctgatatgttaaatctaggtgctgatgtacaaaaggtagaagatgccggtgctgaatatctccatattgatattatggacggaaattttgttcccaatctgtcttttggtgctaatgtagttaaagcattaagaccacaaagtaaaatggtgtttgacgttcatttgatggtgaataaccctgaaaattgggtagaagacttcataaaagctggtgcagacattgtaggtgttcattatgaagctacaccacacattcatcgtgcattagatttaatcaagaaaaacaatgctaaggctgaagtagtaattaatccaggaacaccagttagtgcaattgaaagtgttctatcaattgttgatcaagtacttgttatgacagttgatcctggatttggtggacaaaaattcataccagaaacattagaaaagattcgccaactacatcaaataaaagaagaaagaaatcttaactttgatatagaagttgatggtggaattaacgaagaaaccgttaagttatgtcgagaagctggcgcaacagttgcggttgccggatcatacgtttttaattctggtaatgaaactcatgctgaaagaataaataaattacgtaattaa

SEQ ID NO: 1196 - DNA, 744 bp, Unknownn
  isolated from dental, unidentified
atgaaaataataatttctccagctaagaaaatgatagaagatatggacagctttgatattagtaaattgccaatatttaaagacaaagcggaagtgttattaacatggttaaagagtaaaaactatgatgaattaaagaatatttggaaatgtaatgataaaattgccaaacttaactatgatagagttcaagatatgaatttagatgagaacttaacaccagcagttatggcatattcagggattcaatatcaagcgatgggaccacaagtttttacgcaagaagcactacaaagagcagcaaaagatttatatatcatatcaggattttatggaattttaggagcgatggatggtattacgccatatagattagaaatgcaggcaaaagtagatattaatgatcatcatactttgtatcaattttggggtgacagtatatatcaagaattatatagagataatgaattagtagtaaatttagcttctaaagaatattctaaagccattgagagatatctaaagcctcaagataaattcatcacttgttcgtttaaaaaggaaaagaatggtaaatatgtacaacaggcaacagctgctaagcaagcacgtggtgatatggtaaggtatattttagaaaataatattaaagaaattgatgagataaagaacttttcagtaaatggatatcaatatgaacctcaattttcaactgatactgaattagtgttcattaaaaactaa

SEQ ID NO: 1197 - DNA, 786 bp, Eubacterium infirmum
  isolated from dental, Eubacterium infirmum
atgattcaaactcaaaagaaagctggacgtttcaatatttatattaatgataagtatgcatttccagttagtgaaagtgtcctaattaaatatcgtttacataaaggacaagaacttgacgaaaatttaatagaagaaattaaattagctgatgatatttctaaaggctataatgcggctttaaattatctatcctatcaacttcgcactagaaaagaagtcgaagataaattacactctcttgatattcatgaagattatattcctgaaattatcaacaagcttattgatctagacttaattaatgacaaaacttacgctgaaagttatgttagaactatgatgaatacttctgataagggacctaaagttattagacttaatctttcaaaaaaagggattgatgataatatagctgaagatgctttaattctttacactgacaagttacaagtagaaaaaggtgtcgctttagctgaaaaactagctaatcgctatagtcatgattcatatcgtaataaacaaaataaaattaaacaagtcttactaacaaagggattttcctatgatattattgatacaatcattcaagagttagatttaatttttgatgatgatacagaacgtgaaattttattggaaaaagctaataaactttggtcacgttatgaaaatttagatattaagaagagaaaatttaagattcaacaagctctttttaagcaaggattttcttttagcgatattacatcagctttagacgaaatagaagatactaacatttaa

SEQ ID NO: 1198 - DNA, 1686 bp, Unknownn
  isolated from dental, unidentified
atgactgaagataaaggaaaacgttatggtgcagatgccattattgatagtttggtaaaccatgatgttaaatatgtttttggggtacctggggctaagattgatagggtatttgaaaaattagaacatccaacaaatgaaaaagcacctcaattgattattactcgtcatgaacaaaatgctgcatttatggctcaaggtattggtagaattactggtaagccaggtgttgtattaactacatctggtcctggggtgtcaaacttagcaactggattagttactgcaactgctgaaggagatccagtgttggcaatttctggacaagttcaacgtacagacttattaagattgactcaccaaagtatggacaacgttgcattattagctcctgtaactaaatatgctgctgaagttcaagaaccagaaaatatttctgaagtaattgctaatgcttatcaagaagcagaagctgcaaagcaaggtgcaagttttgtatcagtaccacaagacgttactgattcagaagttaaaactgctccaattgctccaatgccagcacctgttttaggaccagctagtcctgtagaatcaacattattagcccaacgtatcaaaactgcaaaactacctgttcttcttttaggtatgagagcatctgatccagaaacaactaaatctatcagaaacttagttgaagaaactcatttaccagttgttgaaacattccaaggagcaggaattattcctcgagaattagaagatgatttctttggtcgtgtaggattgtttagaaatcaacctggtgaccaattattgaaacatgctgacttagttattactgttggatacgatccgattgaatatgaaccacgtaactggaataacgaaggtgacgcaaatatcatcgtaattgattctatgcgtgcagaagtagataagaacttccaaccagaacgtgaattggtaggtgatatttctcaaactcttgacttcttattaccatacatgaaaggtttcaagttgcctgaaagttcacgcgaatatttagatggactacaagaaaaattaaaattaagagatgaaccaccagcaattactgaaaatcaagttacttcccatcctttaagcattattcaagctttacaagatagagttaccgatgatatgacagttagtgttgatgttggtagtttttacatttggatggctcgtcactttagaagttataatccacgtcacttactatttagtaatggtatgcaaacattaggtgtggcattaccatgggctatttccgctgctttagtaagacctaatacacaaattgtttctgtttctggtgatggtggtttcttattctccagtcaagatttagaaacagctgtacgtttgggcttaaacatcgtacacattatttggaatgatggacactatgatatggttaagttccaagaagaattgaagtatggaaagagtgcaggggtaaactttggtagtgtagactttgttaagtatgcagaaagttttggtgctactggtttacgtgtggaaaaagctcaagacttagaaaaagtattagaccaagcttttgcaactgaaggtcctgtagttgttgacattccagttgactacagcgacaacaaagaattaggtaagcaaattcttgaagatcaacttcactaa

SEQ ID NO: 1199 - DNA, 918 bp, Unknownn
  isolated from dental, unidentified
atgacaaagaaattagcattgcaagatattattttaacgttgcaacaattttgggctaaacaaggctgcatgttgatgcaatcatatgatactgaaaaaggtgccggaacaatgagtccttatacattcttaagagctattggaccagaaccatggaatgttgcctatgtagaaccatcacgtcgtcctgctgatggtcgttatggtgataaccctaaccgtttataccaacatcatcaattccaagttttgatgaaaccatctccaagtaacattcaagaactttaccttgatagtttacgtgctttaggtattgaacctaaagaacatgatattcgtttcgttgaagataactgggaaaatccatctatgggttgtgccggtgttggttgggaagtatggttagatggaatggaaatcactcaatttacttacttccaacaagttggtggtttagaagttaaaccagttgctgccgaagtaacatatggtttggaacgtctatcatcatatattcaagacgtagactctgtttatgatctagaatgggctgacggtgttaagtacggtgacatctttaaagaacctgaatatgaacattctaagtattcatttgaagaaagtaaccaagaaatgttactaaacttatttgatacattcgaaacagaagctaagaagcaacttgcaaatggattagttcatccagcttatgattatattttgaaatgtagtcatactttcaacttacttgatgctcgtggtgcagtatctgtaacagaaagagctggttacttatcaagaattagaaatatggctaaatctgtagctaaagtattcgtagctgaaagaaagaaactaggttacccattaattaaagatgaaaaactaagacaagagttactaaaggaggaaaaataa

SEQ ID NO: 1200 - DNA, 1467 bp, Unknownn
  isolated from dental, unidentified
gtggtaaaaatagagtatgatacagtagtaaatattaatttgacaaggagaaatattatgacttctaaatatgctatcatcttggctgctggtcaaggaacacgcatgaaatcaaagctatataaagtactacatccagtatgtggaaagccaatggtagatcatgtattaactgaaattgaaaagaataacatggatgaaattgtgacagttgtaggtcacggtgctgaaatggttgaaaaaactttaggtgatcgtacaaaatacgctttacaagcagaacaattaggaacaggacatgctgttttacaagctgaaaagttacttggtgataaagatggtatgactttaattgcttgtggagatacacctcttttcacagcaaagacatttgaagaattatttgaatatcacaaatctaaaggtgcggtagctacagttttaacagctcatgctgaaaatccatttggctatggtcgtatcatccgtaatgaaattggaattgtggaaaagattgttgaacaaaaagatgcaacagttgaagaagctacagtaaaagaaatcaatacaggtgtgtactgctttgataataaagaattatttgcagcattacaccaaattaaaaatgataatgcacaaggtgaatattaccttccagatgtaatggaaatcttccaaaaacaaggtaaagttgttgctgcttaccaaatgaagaactttgaagaatcaatgggtgttaatgatcgtattgctttatctaatgcaaccaaagtaatgcgtcgtcgtattaatgaaaacttgatgcgtcaaggtgtaactttaattgatcctgatacaacttatattgatatcgatgtaaaagtagggtcagatacagttatcgagcctggagtacaattaaaaggtaagacagaaattggtgctgattgctatattggtgctcattctgaaattatagacagtgtaattgaagatggtgtcaaggttacaagttcttatattgaagatgctgtaatgcataagaattctaacattggtccatacagtcatttacgtcctaaagctgaaattggcgaaaatgctcatatcggaaactttgtagaagttaagaaagctgcaattggaaagaatactaaagttggtcatttaacatatgttggcgatgcaacattaggtagagatattaatgttggttgtggcacagtatttgttaactacgatggaattaacaagcaccatacaacagttggagattactccttcattggtagtgcttcaaatattatcgcacctgtaaatattgctgatcatgcttatgtagcagcaggttcaacaattactgatgatattgatgcacatgacatgggaattgctcgtggacgtcaagttaacaaaaaaggttattttgaccgttatccagtagctgaagctgcacgtattgctgaagaaaaagctaaagaagaataa

SEQ ID NO: 1201 - DNA, 468 bp, Unknownn
  isolated from dental, unidentified
atgcagaaccgtaacatttcagatattattgaacaatatttgaaagatatattggctgattcaagaagaattgaaataaagcggtctgagattgcacagcaatttgactgtgttccatcacaaattaattatgtaataaaaactcgttttactttgaaaaatggctatgttgttaaaagtaaacgtggcggtggcggctatattcggattgtaaaagtagatttggcagagaatcagtctgttttagatgatttgatttctgcaattggcactgaaattacagaaaaccaggcttaccaattaattagtagtttatacgaggatggcgtcttttctagaaaagaagcaaattatgtcttagctgctattagccgacaagctttggatttgccgactgctgaaatggaaaatatgattcgcgcaaggattttggtaagtatcttaaatcaattgagatgcgaagaatag

SEQ ID NO: 1202 - DNA, 1185 bp, Unknownn; identical to SEQ ID NO: 510
  isolated from dental, unidentified

SEQ ID NO: 1203 - DNA, 1278 bp, Unknownn
  isolated from dental, unidentified
atgattatcacaataattgcatttattattgtttttggagtcctcgtttttgtacatgaatttggacattacttttttgcaaaaaaggcaggaattttagtaagagaattttccattggtatggggcctaaactatggttttatcgaaagaatagtactacatatacaatcagattattacctataggtggatatgtgcgtatggcaggcgccgaggaagatgatgttcctctgaaaaaaggaatgacagttagcctgttaataaatgatgaaaataaagtagtaaaaattaatacaagtaacaaaaaaactttaatttcaggtgttcctgttcaaatttctgattgggatttagaagataagttgtggatcgaaggatacgagaatggtaatgattcagaactaaaagtatatgaagtagatcatgatgcatgcataattgaaaatgatggaacagaagtgcaaattgcacctaaagatgtccaatttcagtcagctaaaattattcaaagaatgcttacaaactttgcaggccctatgaataattttattttagcaattgtagcttttctagtgatcgcacttgtgcaaggtggagtagcttctacagataatcaaataggaaaggtccaagaaaattcggttgcacagaaagcaggaataaagcctaatgaccgaataatagctgttgataatataaaaactactacttggcaagaagcttccgcccaaatccaaaaaaatgggaataaaaaaattattttaaaaattgatagaaaaaataaaattattaaaataaagataacacctaaagttcaaattgagaatggtaaaaaagttggaatgataggagttatggcaaaagtccattatgataaatcaattgttgcaattttgtcatatggatttactcaaacttggtatataataacaagtatcataggagttttaggtaaaatgtttacacagggattcagtttgaatgatttgggtggacctgtagcaatgtactcttatacgagtgaagctgctcattatggtatcttgagtattatgaatttaatggcagttttgtctataaatttaggtattgtaaatttattgccaatacctgcgttagatggtgggaaattgctattaaatgtagtagaagcaatcagaagaaagcctttggatccagaaaaagagggtataattactttggtaggatttggttttttaatgattttaatgattttagtaacctggaatgatattcaaagatattttttacattag

SEQ ID NO: 1204 - DNA, 684 bp, Unknownn
  isolated from dental, unidentified
atgattaggctagaaaatattaataaatactaccaacaaggcgattctcaatttcatgtgttacatgatattaatctaaatatcgatgcaggagaattggtagcaattattggtgaatctggctcagggaaatctactttgataaatattattggttttttagatgataagtttgaggggacttattattataatgatgaaccaattcatgattatgatagaaaagatttttcaaaacttcggaacgaaaatgtagggtttgtttttcaaaattttaagttattaagagacgttagtgtggcagaaaatgtggctttaccattattgtatgctggtaagaaacgtgcggagattaaggaaagagttagcgaagttttgagtaaagtaggtctggctggttatgaaaataaattgcctaaaaatatgtctggtgggcagcaacagcgtgtttcgatagcacgagcaatagctacgaatcctaaattcttaattgctgacgaaccaactggggctttggatacacaaactagccaagaaattatgaatttatttaaggaacttaatcgagaaagtcatacaactattattttagttacacacgatccacacgttgctgagcaatgtgaaagggtagtaacaattcttgatggtcacatgataaaagatgaaaggaatgagatataa

SEQ ID NO: 1205 - DNA, 918 bp, Unknownn
  isolated from dental, unidentified
atgaacaattatttgaaaaagaaaatgaggattagtaatttaactgaatttgaaaaaatctcactcccaaaattagagaatgagatggatctttatttaaattctttgaatagtaatcaaattttgaaagaatctatgagatattcagttgatgctggtggaaaaagaataagacctttattggtgttaatttcagcgtattctttaggtaagaaaatttcaaaaagtgattatcaagtggcaggtagtttggaacttctgcatacctactcattaattcatgatgatttaccagaaatggataatgatgaattaagaagaggaaagccaactaaccataaaaaatttgggcaagcaatagcagttttagcaggggatggtttgttaacgacttcatttgaatggctatctcttactgatattgataacgataaaaaaataaaattaatctcacaattagctttggctgctggaccacaggggatggtaagtggtcaaactgatgatattttaggggaaagtaaaaaatataatttggaagaattgaaacatcttcatgcaggtaagacaggtgcattgttaagatatgcttgtgttgccggagggattttgagtgatgcttctgataatcaattagagttactaagaaaatatggtgagaattttggcttagcatttcaaatttatgatgacttattagatgtgattggtgatgccaaatctttaggcaaaaatgttcataaagatgagatagaaaataaaaatacttatccaattcttttaggaatacaggggaccaaggaagctttagttgaagttttaaataatactgagaatttattaaaagaaatggcaaataatgatattgcaatagacctatttgagcaattgttagattattttaaagtaaggaagtaa

SEQ ID NO: 1206 - DNA, 708 bp, Unknownn
  isolated from dental, unidentified
atgtggatagttggtggaaaaagaggattggcttctttttcaagtgtagcgttaaacttcatactcttgtttttgacggtaatttttatttcaattggagtaccagctttatggacaactatttttgcgggaatagcgattttagctgttactatttatatgggaaatagcgatgaaaaaacgactaatatagcgtttggagctactttgatttcattagcgatagttgttgtagttatggttccttttattaaattagttggaattcaaggttttagtccagaacaatcagaagaaatagaagcttttaatttattaatcggagtaaattttgaaagtatcgtaatttcaactatgatcttgagtactttaggagcgattgcggaagctgcgattgctattgcaagtggtttagatgaaataattgaacaacaaccagacataacgttgccggctttatacacaagtggacgaaatataggattacaaattatgggtatgacatttaacactttattttttggaatgtttggtggagatttagcattgttcatcttgctatataaattagatgcgacatttggatattacttaaattccaaaatatttgtagcagaatcaatggaagttttattctcatcaatttcaataatcttagtaatttggataacaacttatatgatgggaaagaaagtcagacggacataa

SEQ ID NO: 1207 - DNA, 2553 bp, Unknownn
  isolated from dental, unidentified
ttggtagatttaccaaatagaattaaagacgttgatttatctaaagttatgcgtacatcgtttttagactatgctatgagtgttattgtagctcgtgctttgcctgacgtacgcgatggtttaaaaccagttcatcgtcgtatcttgtatggaatgaatgaattaggggttactcctgataagccatataagaaatccgcacgtattgttggtgatgtaatgggtaagtttcatccacatggtgactctgcaatttatgaatcgatggtacgtatggcacaagatttcagttatcgttatatgttagtagatgggcacggtaactttggttctgtcgatggtgatggtgctgctgcgatgcgttatacagaagctagaatgtcaaagattactctagaaatgctccgtgatatcaataaagatacaattgatttccaaccaaactacgatggaactgaaagagaacctgttgttttaccagcacgttttcctaatttgctagttaatggggctacaggtattgctgtaggtatgacgacaaatatcccgcctcacaatttgggagaagttatttccggaattcatatgttaatgaaaaatcctgatgtaactacagctgatttgatggaggcaatccctggaccagatttccctactggcgcaattgtaatgggaaaatctggtatcagaaaagcatacgaaacagggaagggtactgttactttgcgtgccaaggttgaaattgatgaacaagctaatggaaaacaacaaattgttgtacatgagttgccatacatggtaaacaaagctcgattaattgaacgtattgcagaattagcacgtgaaaagaaaatcgaaggcattactgacgttaaagatgagtcagatcgtgaaggtatgcgtgtaacgattgatgttcgtagagatgttagtgcttcagttgtattaaataatttgtataaattaacattaatgcaaactacttttggttttaacatgttggctattgttaatgggacaccaaagattcttagcttgaagcaaattctacaatactacttgaaacatcaagaagaagtaattcgtcgtagaactgagtttgaattaaagaaagctaaagcaagagctcatatattagagggattacgtatagctttagatcatattgatgccattattaatatcattcgtggttctcaaagtccagatgtagctaaagatagattgatgaatgaatatcaattaagtgataaacaagctcaagctatcttagatatgcgtttagtacgtttgacaggacttgaaagagacaaagttgaaaatgaatattcgaagacaatggtagcaattgcagattatgaagatattctagctaaacctgaaagaatcgataagatcatttatgaagaactactagaaattcaagaaaaatttggtgatgaaagacgcactgaattgatggttggcgaagttttaagtattgaagatgaagatctaatcgaagaagaaaatgtagtagttacattaacacataacggctatattaaacgtctaccaactagtgattttaaagcgcaaaatcgtggtggtagaggtgttcaaggtatgggagttcatgatgatgacttcattgaacatttattgacgacctcaactcatgatgaattactattctttacaaatgttggaaaagtataccggatgaaggcatatgaaattccagaatatggtagaactgctaaaggaattccggtaattaatttattggatatctctgcagatgaaaaaattcaaacagtgataaatattcctgcagataaagttcaaactgacaaggaaatgtatctattctttatcacacgtcaaggaacggtaaaaagaacttcggtcagtgaatttggaaatatccgtaaaaatggtttgaaggctataaccttacgtgatggtgatgaattaataaatgtcctagctaccgatgattctaagaacataatcatcggtactcatcaaggttatgctgtatctttcgatgaaaaagatatcagatcaatgggtcgttctgccgctggtgttagaggtatccgtcttcgtgataacgactatgttataggttctgcaattcttgaacctgaaagtaaagtctttgttatttctgaaaatggctacggtaagcaaactgctgctagtgagtatccaattaaaggccgtggtggaaaaggtataaagacaacaaatatcactgaaaagaatggaccattggcaggactaacaactgtaaatggtgatgaagatatcatggttattactgataaaggtgtcatgatacgctttaatattagcgatgtatctgaaacaggacgagcaacattaggtgtaagattaattaatttaggtgctgattctattgtatcgacaatgacaaaagttgagccagaagacgaaaacgaaaatagtgaagaaacaactcaagaagtaagcactgaaattagtgatgatacaaaagatagcgatgttgctagattattagatgctgcccaaaaagatggtgaatag

SEQ ID NO: 1208 - DNA, 1578 bp, Unknownn
  isolated from dental, unidentified
atgaaaaataattttggaaatgttatgaagggagcaataatcctatcaggggcttcttttatagctaaaattttaagtgcgatgtaccgaattccttttgaaaatatggtagggaatttaggattttacgtttatcagcaagtttatccgatttatgcaattggaatgactttttctttatcaggatttcctgtattcatttcaaaaattattgctgaacaagatgatatagaatcaaaatatcagatttcaaaaagaatatttaacgttttagttgtactggctatcttgtgctttttgtttctacaattaggatcaactcaaattgctgaagccatgggagatataaagctggaagtgattatccggagtgtttcctggatgtttttgttgatgccttttttatcagtaggaagaggattttatcaaggtatattcaatatgacgcccactgctgtatcacaagtgtatgagcaactaataagagtgattgttattattggggttgcatggtatgcggttagacatcattggtctatttataaaatgggagcttgggcgatgtttggctcaacattaggaggcttagttgcactactatgttttgtaggtatttttataaggcttttttcaagaaaatcccacaaacatagtataaattatcgagatttagtaaagagactaatgacagaaggaatcatgatatgtttatttactgcattgatggtacttttgcaattaatagattccttcacaattaagaataatttggagatttacggcctatcttcaataaaagctagcaatataaaaggtatttacgatagagctcagcctttaatacaattaggattagtaataggagtaagtttttcttcaacgctattaccttcactaacagcagcaattgaaaagaaagaaaaaactacttttgaaaatactgcatcatctatcttgagaattagtttaggaatagctagtgctgctacagtgggattattagctttattgcctgaagttaataaacttttatttggtgatagtgaacttagtttggtaattggaatatatttactgggaataattttaatgacagtaatcaatagctatagttctattttacaaagtattgatgagtacagagtgttactaattggattaggggtagctttcctaactaaatatattcttaatagttacttaattggtaaatttggaataattggagcaagtattgctactacagctagtttattattagctgcaattatcattattctctttagttcaataaagcttgagattttatttagaagtgatggttatgtcttaaaattattacttatttcatgtattatggggatagtagtaaaaggcctttcgatattattaggatacctattgggaagctctagattagatgtcggaataatttcagtaatatgtattcctgtaggagtatttatttttggaattttagcgattaagtttaatttatttaccaaagaagaatatatggcgatgccaggtggaaataagattataaaaataattgacaaattaaatggaggacgttga

SEQ ID NO: 1209 - DNA, 2367 bp, Unknownn
  isolated from dental, unidentified
atgacaacttctattggggtcagaaaattagtcgaatttatcctaaaaaaaggaaacttaacatctgatactaattcacaaaatactgcgctagatggaattagtattcatcaacgattacagaaaaaattttctaatgatacaaaatcagaaattgcgttaaaaaaagaattagacattgatggtgaaacttggattattcatggcagagctgatggaattaaatacattgataaccaaccacaacaggttattgaaataaaaacttctagtccacaattttcagaattagctcctaatactctcgaactttattgggctcaagctaaaatttacgctcatataattatggaacaagaacaactaccagaattagctcttaaactaatttatgtacagactactgataatacaatttctgaagaaactcaggttattaatcaggctgatgctcaaaatttctttaataacattattacagaatttacagattggataaaactccagcatcaactccaaaaagaacgcgatcattctattaacaaattggattttccattttcatcttataggaaaaatcaacatgaatttgctgctgcagtttataaaacaatagctttaaataaaaaattattagttgaagcccctactggaaccgggaaaactatttcaactatttttcctgcagtcaaggctttaggtactaaaaaatgtcaaaaaatattctacttaactgctaaacaaagtactcgcaaagtagctgaagaaactttacagttattggtaaaacatggactttctattactgcaattaccctaacttctaaagagcaaattacatttcctgaagaattagatttggcagacgatgaaaatccttattacttgggttattatgatcgcctacgaccagctttgatagatattttaaccaatgaaaaagtgattacccggaaaattgtggaaaattatgctaagaaacatatgcttgatccttttgaattttctctagatattagtaattcttgtgatgtagtaatatgcgattataactacctttttgatcctttagttaagttacaacgattctttacagaaagaaactatgattatacttttttgttagatgaggctcataatctagttagtcgttctcgagatatgtatactaaagaaatttcttcacaacaaatcaaggatttattagacaaactccaaacgctgccacatccaccccaaaagattgtggataagctaaatactcttttaaatgattttgatttgattaaggaacccttagttaattatcaacaagctgacgtaataattgaggaaaaacttgcctcactgacaaaaaaaataatgtatttttgtgattttactactgattggctggcagaaaatccacatttttctcttaaagatgacttactggaatttttcttcgccgcttatgcctttgttaagattagtgattattacaataatagctttagaacacatttatttattactgaaaattctgagttactaattagggtgttttgcttagattctagtgaattgattgctaatagccttaacttgggaggtagtgctgttcttttttcagcgactttgtcaccattaaattactaccaagaaatgtttggattaattgataacagtttgttataccagctatcctcacctttcgatgaaagtaatcttaacttgttaataacatcttatattcctgttacttatcaacaaaggcagcaaagtcttggaaaaattattgatgctattcacactatgattgctactaagcaagggaattatctgattttcttaccatcttatacttttttgaagcaggtagttgtggcatttaatcaagcttatccacatattgacactgtaattcaagaaaacgatatgactagagaacaacaggaagattttttgaattatttcattgaaaatccaactaaaattttagtcggttttgctgtattaggtggtagtttttcagaaggaattgatttaaaaggtaatcgtctaagcggtgtagcaatagttagtgtgggacttccaaaattaagtaaagaaactaatgaactccaaagttacttcaataataaacaaaaagatggatttcaatatgcttatcaacttcctggacttaataatattttccaggctgctggtcgtgttatccgaagttctactgatgtaggtgcggtccttttaatagacaatcgttttgctacttctagatatgcgaaatttttcccaccacattggaaatatgcacagattattcacaatcaatatgaacttgaacaaaacttatctacattttggaataaaaataaagacagctaa

SEQ ID NO: 1210 - DNA, 2847 bp, Unknownn
  isolated from dental, unidentified
atgggatttttttgtttccaatttttaactgagagagaaaggatggatcttatgaaagtcaaagatactttaaatttgggtaagacaaaattcccaatgcgtggtaatttacctgttcgcgaagttgaaagacaaaatgaatgggaagaaaataaagtttatgaacaaaggcaaaaattaaacgagggaaaaccaagttttgtgttacatgatggacctccatatgctaacggtaatattcatatgggtcacgcaatgaacaagatttctaaggatttcatcgttcgttctaaatcaatgatgggattccgcgcaccttatgtaccaggttgggatacacacggtttaccaattgaacaacaattgaaaaaagctggtgttgatcgtaaagcattatctgtagctgaattcagagaaatgtgtcgtcaatatgctttagaacaagttgataagcaaagaaaagactttaagcgtttaggtgttgctggtgaatgggataacccatatttaacattgaaaccagaatatgaagcacaacaaattcgtgtctttggtaagatggcagaaaagggcttaatttataaaggtaaaaagccagtattttggtcatggtcatctgaatcagctcttgctgaagctgaagttgaatatcatgatgtaacatcaccatctgcattctacggtgaacaagttgttgatggtaaaggtgtattagataaaaatacatatatggttgtttggactacaacaccatggactattcctgcttctgaaggtattacaattgatgctacattcgactacgcagttgtacaacatgacgatgatgaacgtaagtatgttttagctgctgatttagtaaatgctgatgctgaattatttggttggaatgatgttaagattgtgaagactgttaagggtgcagaattagaaaatgttttatgtcaacacccattctatccagaaagaaaacttgtaactatgttaggcgacttcgttacaactgatgctggtacaggtcttgttcatacagctcctggctttggtgaagatgactttaacattggtgttaagtatggtttagatgtatatgttcctgttgatgataagggatatatgacagaagatactggcgaagattttgcaggtttattctatgaagacgcaaatgaagtttctttgaagaaattggaagaagctggcgtacttttgaagcaaatggattacgaacatagctacccatttgactggcgtacaaagaaacctattatcttccgcgctacaccacaatggtttgcatctgttgataagattcgtgaccaaattttaggtgcaattaatgaagttcaattcttcccagattggggtcaaaaacgtctttacaacatgattcgtgatcgtggtgactgggtaatttcccgtcaaagagtttggggtgttccattgccaatcttctacggtgaagacggtgaagctatcatgaccaaggaaacaattgaacatgttgcaaaattagttgaagaacacggctcaaatatttggttccaacgtgaagctaaggacttattacctgaaggctttacaagtgaacattctccaaatggtaaatttactaaagaaacagatatcatggatgtttggttcgattctggttcctcacaccaaggcgtatgtgctgaacgtgattacttaacatatccagctgacctatacttggaaggttctgaccaataccgtggttggttcaactctagtttgattacatctgttgcttactctggtcatgcaccatacaagcaaattctttctcaaggatttacacttgatggtaagggacgtaagatgagtaaatcattgggtaacacaattgttcctagtgaagttatcgataagatgggtgctgaaattattcgtctatgggtattgagtgttgatacatctgctgacgttcgtgtatctatgggaagtttccaacaaatcgctgaaagttatcgtaaatttagaaacacagttcgtttcttacttgcaaacacaacagatttcgatcctactaaagatgctgttgctttcgatgaaatggaatccattgataaatacatgacagttcttgtaaacaaatttactaaggaaattctagatgcatatgcaaactatgaatttatggaaatttacaagaagttaattaacttcattacaacagatctttctgcattctatatggacgttgctaaggatgttgtttatattgaagctcctgatagcaagaaacgtcgttcaatgcaaacagtattgtatgatgtagtggtacgtctaactaagttaatgactccaattttacctcatacaacagaagaaatttggaagtatttgaaggaagacgaaaaatacgcacaattatccgaaatgcctgaagttaaacatttcaataatgaagaaaaacttgttgatttatggaacagattcatgaatttacgttcaggtgtatttaaagctcttgaagaagcaagaaatgaaaaattaattggtaagtccttcgaagcacatgtagacttatatgtatctaatggtgtacaagctgatttagatgcattaaatgctaatgttcgtcaagcattgattgtttctgcattagatgttcatccattatctgaagcaccagaaaatgctttgaagtttaatgatgaatatgctgttgtagttgaacatgctgaaggtgaagtttgtcctcgttgccgcatgatcaagacagatatcggtagtgatgctgacttatcaacactatgtgcaagttgtgctgaaattgttcgtgaaaactatcctgaagctttagcagaaggtttagaataa

SEQ ID NO: 1211 - DNA, 321 bp, Unknownn
  isolated from dental, unidentified
atggaaatggtaatccaaggtgtttcaactcgtaaagtagctgagattactaagaagttatgtgggacaaccttttctaaaagtacggtctcggctttatgcagtaatttggacgaccaagtgctggattttaaccgacgtccccttacgcaaaagtatgcttttgtgtacgccgatgcaattttatttaaggttcaccgtggtcatgttgtgacgagtaatagcttgctcgttgcgattggaatcgaccctagcggtcgtcgagaagtgctcggttttgatagcaggttaatcaagaaatccggcgtcgtgaccgtgtga

SEQ ID NO: 1212 - DNA, 1539 bp, Unknownn
  isolated from dental, unidentified
atgaaacgagcattagttagtgtatctaataaaaataatttagtaccatttgtaaagaaattagtagaacatgattttgaaattgtttcaactggtggaactaagaaatacttagatgaagcaggtattaagactatttctgttgaagaagttactcatttcccagaaattttagatggacgagttaaaactttgaatccttatattcatggcggtttacttgcaagacgtgagttgccagaacatatggaaactttaaaagaacaaaatattacaccaattgatctagtatgtgtaaacttatacccatttaagcaaactatcgaaaatcctgaagtaaccttagaaaatgctattgaaaatattgatattggcggaccaagtatgctacgctcagcagctaagaattatcgcgatgtagtggttgttgtagatgcagatgattatgaaggattagagaaagaattagatgaaaatggagaaatttcattagaaacaagatttaaattatctgctaaaacatttagacacacagcagcatatgatgctttaattgcagattacttaagtaaacaagctggtgaaaataatccagaaaaattaacgctaacatatgatttgatttcttcaatgagatatggagaaaatagtcatcaaaaagcatggttctatgaagatgctatgcctaaagcatactctattacacaagctaagcaattaaatggtaaaaagctttcattcaataatatacgcgatgctgatgctgcaattagagcagttagagaatttgatacaccaacagttgtagctttgaaacatatgaatccttgtggaataggtcaagctgataatattgaattagcatgggatagagcatatgaagctgattcaatctcaatttttggtggtgtaattgctttaaatagaaaagtagatttagcaacagcagaaaaaatgcataaactatttttagaaattataattgctccggaattcgatgctgacgctttagaagtattatccaagaagaaaaatctacgtttattacaacttgattttactaaaaaagatgaagatgttcgtgatgaaacagtttcaattatgggtggtttgcttcgtcaagaacaagacgttatagatgaagatcctaagaattgggaagtagtaacagaaaatgctcctagtgatagtcaattagaaacattattatttgcttggaaagcagttaaacatactaagtctaatgcaattgttgtagcaaatgatgagagaacattaggtataggagctggacaaccaaatcgtattgattctacaaagatagcaattaagcatgctggcgattcactaaatgataaagctgtgttagcaagtgatgcattcttcccaatggatgattgtgttcaatatgctgctgaacatgggattaaagcaatagttcaacctggtggatcaattagagataaagattccattgctatggctaataagtatggggtagcaatggtattcacaggtgtaagacattttagacactaa

SEQ ID NO: 1213 - DNA, 537 bp, Unknownn
  isolated from dental, unidentified
atgaagagagttgctgtatattgtggagctaatcctggtaaaaatcctatttatactcaagccgcaatcgatgttgctgattggttagctcaacaccatttagatcttgtttacggtggtggcggagttggtttaatgaatgtattggccgaaagagctattaaaaatggtacttataccattggcattatgcctcaatttttagtagatagagaaattgctgctccacatctagatgaattttacgttactgatgatatggacgaaagaaaagctaagatgctttctttagctgatgcttgtttagcattacctggaggtccagggacattagaagaaatcagtgaagctttctcttgggcaagagtggggcaaaatcctaacccttgtgctttttataatgttaatggctattatgataaattagctgacttcttcgatcatatggttacagaaggtttcttaacaactgaagatagaaataaacttctattttctgattcacttgaagaaatttataatttcatgacaagataa

SEQ ID NO: 1214 - DNA, 1470 bp, Unknownn
  isolated from dental, unidentified
atgaattcagaatcaatggacaaagctttctttggtcatcctcgtggattatcaactttgttctttactgaaatgtgggaacggtttagttactatggtatgcgtgccattttactattctatatgtactattccgtatccgatggtggtctaggaattgataagaccacagctgcttctatcatggctatatatggatcgcttgtatacttatctagtgttattggtggtttcataagtgatagaattttaggaagtcgccgtacagtatttatcggtggtgtattaataatgttaggtcatattgcattatcaacaccatatggtaaaggagctttgctcttatcaattattttgattgttttgggtactggcttattaaaacctaatgtatctgaaatggttggtagtttgtattcttcaaatgatcctcgtagagatgctgggtttaatatttttgtttttggtattaacgttggtgctttggtttcaccaattgttgttggacaattaggttttaacgttaacttccatttaggattttctttagcagctattggtatgttcttcggtttattacaatactggttagacggtagaaaatacttatcaaaagatagcttatatcctacagatccaattgaatctgacgaattaaaaggtttacttacaaaaacagttattggtattgctgcaattgcattaatattaataattatgaatttattgaatgcactaaatattactaatattatcaatttaatttctattattgctgtattaattccaatttattatttcgtgttaatgctaagtagtagaaaaataactaaggtagaacgttcacgtgtattagcatatatacctttatttattgcctcagttttattctggtcaattgaagaacaaggttcagttgttttagctttatttgctggtgaacaaacaagattatcattgtttggattccactttgcacctagtttattccaaagtatgaatccattattcattatcatctacgtaccattctttgcatggttatgggtaaaattaggaagcaaacaaccatcatcaccaatgaaattctcaataggtttattcttcgcaggattatcatttatgtggatgatgttaccaggaatgttatttggaactgataagttagttagcccattctggttgattattagttgggctttagtaatcattggtgaaatgaacatctcaccaattggattatcagtaactactaaattggcacctaaagcattccaatcacaaatgatgagtatgtggttcttgggtgatgctgctgcacaagctatcaatgcacaaatagttaaattgtatagtcatggtacagaagttatgtattatggtgtagttggtgctattacaattgcatttggtattattttattattctttgtacctaagattgaaaagttaatgtcaggtgttttataa

SEQ ID NO: 1215 - DNA, 864 bp, Leptotrichia buccalis; identical to SEQ ID NO: 535
  isolated from dental, Leptotrichia buccalis

SEQ ID NO: 1216 - DNA, 771 bp, Oribacterium sp.
  isolated from dental, Oribacterium sp.
atgactaataaaaaagatgcccctattggagtttttgactctggtatgggaggaatttcggtattacgtgaattagttaaaataatgccgaatgaagattatatattctttggtgattctgctaatgcaccttatggtattaagacggtagaagaagtccaaaaattatcatttgagaaagtagagcatttgctatcatataattgtaaagcaattgttgtggcatgtaatactgctacgagtgcggcaattaaggaattgagagcagcatatccggatttaattatcgttggactagagccagctctaaagccagcagtagaacataaaaaagattctaaagtaggtgttatggcaacaccactaacattaaaagaaaagaaatttaatgacttgatgaataaatatgttacaaaggcagatattcgaaaaattcctgcaccagatttagtagagtttattgaatcaggtgatgtggattctcctgaattagaaacatatttacaaaaattattaagtccttataaagattcagattccattgtgcttggctgcacacattttccatttgccaaaaaggtaattcaaaagattatgggcgatgatacgtttattgtcgatggtggagaaggtgctgctagagaaactaagcatttattggaaaagagtaacttactaagtgataagacagaaaagggttctgtgaagtttgaaaattccagaaatactaaagaggaattagaacttagtcaaaagctatttaacttgtaa

SEQ ID NO: 1217 - DNA, 1299 bp, Unknownn
  isolated from dental, unidentified
atgaatagattaaccaaagcgacctatgtgtattggttgttagtaatgattaattttgtttcggtaatgtttaatgtgtccttatatttactaattactagttacatttcaaaaaagaatcttagcttgtatctcttacaacaattacaggtcatacctggtaattttagattacttttttgggtagtatttgtactttttggatgcttagttactgtcatctatttacgccgaacctcacccaataaaaagacgaataaattactctggctagaattattactaatagtattaattttttggctaactaaggcaacttatggtggtttagtcttcttagcctttgctgatatctttttttcaactgatgatttccacaccattagtaataaattttattggctgattttcattatcgttgcttcggtatgcttactagtatcaaatagtaattttttggcagctttaatttctttaccatcattagagatttacattagtttcttgccaagtcatgtagcaactctattatctctaatgcgtctatttctttttattattagtatcgttatttttactttagccttatttacacatgtcgtttatataacaaatgaaaaacgtaatattgaagaagagcttagaatggctgatcatgctaatgtcgaacttcaacactatattagcgtcgctgaagaaaatgctgaattgcgtgaacgaaaacgtatttcccgggaaatacatgatactctaggccatgctttaaccggaatttcggctggtattgatgctgtcctagtgctaattgatatggataaagatagtgccaaagaacaattaaggaatttatctgaggttgtacgtcagggtattgtggatgtacgtaagtcattaaacaaaatgcgtcccggagctttagaaaaattatccttatacgattcgattgttgatatgattagtcgttatgacaatattccaactttaacaattgatctggattttcaatggcaaggcgttgatttagaaaagaccactgagaatgttgtctttagaattattgaagaatctattactaattctattagacatggtcatgccgaaaaaatttggataagaatgactaaagatgataaatattactatattgaaattcacgataacggtaaaggtagtccaactatcaagcctggatttggtctaactcagatgcaagaaagacttgctattattggtggcactgtaacctaccagggggatcacggatttactacgaaaataaaattcattattaaaaactag

SEQ ID NO: 1218 - DNA, 1308 bp, Unknownn
  isolated from dental, unidentified
atgaaaaacgagaaattcagaaaccctgaggcaatccttgatattcaagataaaccgactttccctcagtggttacttctatcagtccaacatttgtttacaatgtttggttcaactgttttagtacctttattaattggtatgaatccaagtattgctttgtttagttctggggtaggtactttggtatatattctttgtacaagagccaaaattccagcatacttaggatcaagttttgccttcatcatgacaatgcaggctttgatgaaatctgagggatatcctgcagtaggtcagggggcaattgcagcaggtttagtttatgttattgtttccttgatcataggaaaatttggttcacaatgggtagacaaggttttaccaccagttgttgtaggtcctatcgttatagttattgggttatcattagctacaactgcagctaacgatgcaatgttcaataataaccattatgatcttaaatactttggagtagcaattttcactttagttgcaacaattatcttcaacatgttcttacgtggattctcaagtatgattccagtgcttttaggtataattgtaggttacattttcgctgttttcatgggaattgttgatttatcaggtgtagcagcagcaaaatggttctccttacctgcatttgacgtaatgtttgttaactatgactttaagtggtatccaggagcaattattggaatggcaccaattgcttttgttactatgactgaacacatgggacacgttatggttttaaataaattaactaagcgtaatttctttaagaatccgggactacaccgtacattgctaggtgatggtttatctagtgtaattgctggtttcgttggtggacctccaacaacatcttacggtgaaaatattggtgtgttagccatgacaaagattcatagtgtttgggtacttgcaggagctgctttctttgctattttattcagtttttgtggtaagattgctgctttgattcaatctattccaactcctgtaattggtggtatttcattcctgttattcggtatgattgctgcaaatggattacgaattttagttgataataaaataaactttgaagcaaaaagaaatttgattattacagctgttatcttggttgtcggaatcggtggtacttatttgaagttaggtaatttccaacttacaagtattgctctatcaacaatctttggaattgttttaaacttaattttaccaaagaaagcagctagtgaagctgaacatgagaaaaagataagaatggatatttaa

SEQ ID NO: 1219 - DNA, 747 bp, Unknownn
  isolated from dental, unidentified
atggctgaagaaaaaacagttcgtgaaaagaatcaagaagctgccaagaaacaagctgaagcagtttctcaacaaaagaataaacaaatcatggaattcaatgaaaaatttgaaggtttaacaaagcgtaatcaagactacatgttccatttaaataaggcgttagctgaaaagaattatgcagaacgtgaaaaagttgttagtgaaatgtacaatgaattgatggaaaaacaaaagcaaggcgttgtagctaacaagttatatggaacagttaatgaaaaggttgaagcaattcttgctggtcctaagaaagaacctaaaatgcctactttatgggaattatcacttgataatggattgatgatgttagctttattctgtatcatgtacgccttcttaggtatgttctctaagagcaatcaaaatgcagcaaatggtggaataatcacattgattgttacatctattgttgctggtgttggtttgggttatttctatcgtgcgatgatgccaggtcaaagcaaacgtcgtggttggttaaacattatctttatgatcgcaatcttaatggtagtatgggtagctgcattcggtattgttgcaattatcccaccaacaattaacgttgttcttccaccattagcttatgcagtacttgctattgttgcttatggtgttcgttggtacttaaagaagaagttgaacttcattagtccagcagatttcagaagaaatagtcaaaattaa

SEQ ID NO: 1220 - DNA, 876 bp, Unknownn
  isolated from dental, unidentified
atggaacgtatcgatggacatactttattaattggtttgatggcatatcctattagacattctatgtcaccaacaatgcataacaatgcttttgctaaattaggtttaaactatgcatatttagcatttgaaattgataatgataaactagaaaaagctgtagatgcaattagaactttagatatgcgtggatctaacgtatctatgccaaataagcaaaagattattccttatttggataaattagatccagcagctaaaatggctggtgctgtaaatacagttgtaaacgataatggtgtattgactggatatacaattgacggaacaggtttcatgaagtcactagctgatgaaggcttagatattcgtggtaagaagatgacattagcaggtgcaggtggtgctggtactccaattgcaattcaagcagcacttgatggggtaaaggaaatttctatcttcaatttagatgatgctcaatgggaacaagctgaaaagaacgttgaaatcatcaatcgtgaaacagattgtaaagcaacactacatcacctagaagataaagaagactttaagaaggaaattgcttcaagttatatctattgcgatgctacaggtgtaggtatgaaaccattagaagacatgacattagttgaagatcctagttggttccacaaagatatgattgttttcgatacagtctatgcaccaagagaaacaaaattaatgaaagttgctaaagaagctggcgtagatcatgttcttaatggtttaggtatgatgttagaacaaggtgcagaagcattcaagttatggacaggtgaagatatgcctgtagactacatcagagaattattatttagcgaagataactag

SEQ ID NO: 1221 - DNA, 1056 bp, Unknownn
  isolated from dental, unidentified
atgtttttgacactgtggcaacgttttttaggaaacgaacggttaaggcgatttacagttttactatttttagtaggagtgctgtatctagctcgaagtatgatgagtttaatcttactaacctttattttttcgtttctagttattagtttaaatgatgcaattagaaagaaaatagatattccttctaaattaattgtcatcattgtttatttgttgatgataggtggtatttacttagcaataactatctacctaccaaaattagttacacaaacagaaaatttggtaaattacattgttaagttctataatcatccacctaagggaacaaatgatgtgattaatatggtcacacaatacattagtcaatccgatattatgaaacaaatgcgtggtggtatgtcaattatcgttaagtatttggcaaatattggaacgatgggaatgacgtttattatggcgttattgctaagttttttctttacaattgataaagatgatttgtttaagttttcaaaatcatttttaaagggtccatattcatggttctttaatgacgtttactactttgctaagatctttgttaacagttttggggttgtattagaaactcaatttattattgctttaattaatacggcaattacaacaacgattttagcatgtatgaagatgcctcaattgttcagtttagcgttattaatattcttcatgagtatgattccagttgctggggttattatttcagcaattccgatgatgttaattggttacactgttggtggggtaaagtatattatttatatcatcattatgctttgtgtggttcatgccttagaagcatatgtgttaaatcctaagttaatgtcaagtcgaacagaattaccaattttctacacatttgttgtactatatgtgtctgaacatttatttggaatgtggggattaattgttggtatcccagtatttacattccttttggatattttaggggttaaaagcgaccatattcgcagagaaagactaaagaaattcagagagaaggtaaaatag

SEQ ID NO: 1222 - DNA, 705 bp, Unknownn
  isolated from dental, unidentified
ttggatagtgaaattattgcccggccattggtgaccatcaccaacgtcatttggagttttaatactgaattacaccgaccacaattactattgattaagcgggcagatgaacctctaaagggacattgggccctccccgaaacccgcttgcggagtaaagagagtgccgacgcggcctgcattcgtctaattgacgataaaattggcctgcaagttccgatgaattcaaccgaacaactggccacctttacagatcccaagcggattacgggaactcgggcactggcactcgcctatatgacctatttaccatcaaccccaaaattgcatccagggtatggggccacagatgcccaatggttcgtgcttgataaagatcagggcaactatgtgatcacccatgaccaacaggagattatcctaagtcccgccggtcacctggccttcgatcatattcaaatcattaccaccgccattaatcggattaaaaacaagctggactatcaaccccaaattcttcggatcttaggtaatacctttaccctgcgccaagcgcgcgaagtctttgcggctttcttaggtacgacaattggcaagattgataattccaactttaagaaaactcacaaccacctcttcaaagaagtcggggccgccactttgaaccattctgggcggccaccaaagctctaccaacttaactaa

SEQ ID NO: 1223 - DNA, 981 bp, Unknownn
  isolated from dental, unidentified
atgaataagggaataaaaatggtatctatagcaggttacctacctgataatgttgtaacaaatgatgacttgagcaaaattatggaaacatctgatgagtggattcaaagtcatacaggtattaagcaaagatactatgcttttaatgaaaatacatcagatttagctactgaagtaggaaaaaaactcctagaaagagcaaatcttaagtctgaggatatagatttgttaattgtatcaactatctctccagatgcaattacaccctctacagcagctattgtagagaagaagttaaatttaaaatcagcttttgcctttgatatttctgcagcttgtgctggatttatctatgctctaagtacagcccataaatttttagtttcaggtttatatcgtagagcaatggtaattagtgctgaaacaaattctaaaatgatggattttaaggatagaacgtcagctgttttctttggcgatggtgctgccgggatgattgtagaggcgactgatgatgaaaaagaaaacatttatttatctgagaaattggttacggtaggaaatgaggaagttattcatagtggtagaattgctcctcttaaagaaatatctagtgataattatccaagtatggacgctttttatcagaatggaagagaagtttataattttgtaacaacagatatagttaagcatattaaggagtttttaaagacaaataaagtggactccaaagatttatcatatgttgtaactcatcaggctaatttacgattgatagaaattatatcaaaagagattgaagttcctctaaatagagtggcaactgatgttaaggaatgtggtaatacttcttctgttggaataccattagccttggctagaaagtttgaagatgaaaatataacaggtaaggttctattaacaggttttggtgctggtttagcttatggatctattcttttagaatttggtgaataa

SEQ ID NO: 1224 - DNA, 837 bp, Unknownn
  isolated from dental, unidentified
atgagtaagaaaaatcctattactataagttcttggacattgggagacaagtgtacatttgaacaacgctgtaaagctgctgctgaagctggctatgatggtatcggtttaagagccgaaacatatgtagatgctttaaatgaagggcttacagataaagatattatagatattttaaataaatacaatattacttgtacagaagtagaatacatcgttcaatggtgcgaagaacctcgctcatatgaacaaaagtataaggaacaaatgtgcttccatatgtgtgaactatttggtgtaaagcatattaatacaggtttaatggaagattatcctgtagactataccgcacaaaaacttagagagttatgtgatagagccggagatttaattattgcccttgaaccaatgccatatagtggtttaccaaacttagataagacatggaaagtattgcaaaaagctgattgtgataacgcaatgatgctattggatacatggcactgggttcgtgctaaccaaccatatgacttattgacaaaagaacaagctaagaaagttatttctatccaaattgatgatgcttatgaaagaccatatgcagattcaatcttgagagacgaatcaatgcatgatcgtttagctccaggtgtgggacaagctgacacagtagcattcttaaagatgatcaaggaagcaggtatcgatccaaaagttgttggggttgaagttatttctgataactatatgtccaaaggtattgattgggtagctgattatacttataagaatacagaaaaagttttgaaagaagcttggccagaaattttagactaa

SEQ ID NO: 1225 - DNA, 1488 bp, Unknownn
  isolated from dental, unidentified
gtggcaaaaaacaagatacgtgtacgttatgctccaagtccaactggacatttgcatataggtaacgcaagaacagctttatttaactatttatttgcaagacataataagggaacttttgtattaagaatcgaagatactgatacaaagcgtaatattgcagatggtgaaaagagccaaatggataacttggagtggcttggtattgactgggatgaaggtcctgataagccaggtaagtacggaccatatcgtcaatctgaaagaaaagatatctacaagccattaattcaagaattattagataaagatttagcttatgaatcattcatgacagaggaagaattacaagctcaacgtgaagaacaaaaagctagaggagaagctcctcgctatgtctatgaatatgaaggcatgtctaaagaagaaatcaagaaggctcaagatgaagcacgtgctaagggattaaaaccagttgttcgtattcgtgtgccacacaacaagacatacgaatgggatgacattgtaaaggaaaagattagcttcttatctgacacaattggtggagatttcgttattcaaaaacgtgatggtatgcctacatataactttgctgttgtggtagacgatcatttaatggaaattactcatgtattacgtggggatgatcatgttgctaatacaccaaagcaattagttgtatatgaagcatttggttggaaagcacctgaatttggtcatatgtccttaattattaatactgaaactggtaagaagttaagtaaacgtgacgaaacagtgcttcaatttatagaacaatatcgtgaactaggttacttacctgatgcaatgtttaactttattactttattaggttggtctcctgttggcgaatcagaaatctttaataaacaagaattcatcaagatgtttgatgcaaaacgtttgagcaaatctccagcagcatttgatggcaagaaattagaatggattaataaccaatatgtaaaggctgctaaagaagatgaaattatggattcttcattacgtcaattaattaaggctggtaaagtacaagctgatccagatgcttatacaattgaatgggctagaaagctaattagtctttacaaacaacaaatgtcttatacaggacaaattgtagaaatggcagatgtattctttaatgaaccacctgttttaagtgaagatgctaaaaaggaattagctgatgaatcagcagcaattgtattaaaagaatttgctgaacgtgttaaagatttaccaatctttgatgctgttgaaattcaaaatacaattcgttctattcaaaaggatacaaagattaagggacgtaaactctacatgcctatccgtatcgcaacaacacgcgaaatgcatggtccagaattggcaccatcaatcgaattattaggtcgtgaaaaggcattgaaacatctaaagcaaactttagaagaaatgaactaa

SEQ ID NO: 1226 - DNA, 867 bp, Unknownn
  isolated from dental, unidentified
ttgaatatcattattgcattgatacctgctgtttgttggggtatttttccattaatcgctagcaaaactggcggtggtcctgctaatcaaattcttggaaccggtttaggtgctactttggttggtttaatcgtatttgctatcatgcacccaacaattacagcttccgctttcatttgggctttcatggcaggtgcttgctggacaatcggtcaaattggacaatttatttctatgaaacctgaacgtatgggtgtaacaacaactatgcctatctcagctggtttccaattagttggtaactctttaatcggaatgttattcttaggtaactggagtggaacaacagctaagattattggtcttgttgctttagcaatcgttgttgtaggtgttattctaacagctgtaacagatgataataagagtgaatcagcttctgctaaagatgtattattcttattagttacaacaattggttactggatttatagttcattccctaacttaccagctgtaagacacgtttctccaactgcattatacttacctgaaatgttaggtattttgtgtggtgctttaatctttgttttcgctactagagaaacatctgcattaacagcacgtgaaagttgggctggtatgatcggcggagcaatttggggtattgcagcatttgcatatatcttctctgctcaagaaaacggaacttcaagtgcatttatttacacacaattaagtgtagttatttctactttaggtggaatgttgttcttacatgaacgtaaaacttctcgtgaactaggtttcacattagctggtttagtactactagttgttggtagtgtaatcacaggatttatctaa

SEQ ID NO: 1227 - DNA, 1770 bp, Unknownn
  isolated from dental, unidentified
gtgcgtgttcaaggtcttggagttgaagatgcgatcgtaaaatttacgaaaggctttaacttgattgaaggtctctcaaatcatgggaagacgatgatcgttcagtttatcgagtatgcttttggtggtaggaatcagaaagattcgctgtccttaaatattgaaggcacaaactatgcgacagtgaaagtaacacttcaaacggaacagggtgaagtagagttagctagaaatttagttgaaaacaagagcacgatcaaagttataagccaagataaaagattgttaagtggagactataccgcaaacagcagtactgataaaaaattaaatatcggtattgcgctcttacagttaatagatatgccaacggacctatatctcccaaaaaatgagaaaagagatccggggcacgtctctttcaatgtcttgaaaccattgtggttactaaatgagaatgatatgcccaaggatgattcagtattgttaccatctagcaatagtggcctttttctcagttctctactgtatttattaaatggaaaacagattgatacctatgattggcgggaaattgaaaaaagaaggatcgtcagagactatatttctggacaaatagaaatggtggaacataagaaagcgcagttgaagcaaaaaagtatcggaaatgaatccaaactgcaggaagaactggataacttaactatgcaattagatgaagtatccacccttgtgacagataaactcactaaaagtaagaaaacttttaatcagatgagtgagtttaatgacaagatagtggcagcagatgtaacgttatccagatatgaatcactgaagggacaatatatttctgacattaagaggttaagcttcattgttgatggggaagttgcttttgaaaatattgaagaacctttactttgcccagtgtgtggacagccagttattaatgtagaaaatgaaactaagcacgttgaagcagccaggaaagagctttctagaaccctagccttattaaatgatctcgagcaagcaacagctagtcttgccgagaagaaactttctttgcgaaagcaatatgctgagctggagaaggaacgcaatgcaattcaaatagagctcgatgataagctatatccacgcctagatgaaataaaagcagccgagaaggattaccgagaacagatagaggtagtatcacaagttaaggtctttgatgctttattaggaaaatggacgtcgaagattaacgatttgactaatgagggaatactagaaagggatgttaaattcaaacccaaacaagaactgggagaaaagttttatgatgatatgggtgaaattttaaattctctattagagaagggaaattaccctaagcatcatgttgctacttttggtcaagtttcatttgatattatgattaacggtaataagaagaaggttagtcatggtaaaggtttcagatcatatttgaattctgttacagttatggccttgagcgaatatataaataagaatgctctatataagccggagtttttaatcatcgatacaccacttgagggattatcagagaagtacagcgaaaatcctaatgaaagcatgaaacatggcatttttgagcttttcatagagaggggcaagaattaccagacgattgttgttgaaaatccggatcatttaccaagtgatatagattttaaacgcaaaaatattaatgtgattagttatgaaaatgaagaaggatttttaaaggaaatttag

SEQ ID NO: 1228 - DNA, 1488 bp, Oribacterium sp.
  isolated from dental, Oribacterium sp.
atggatgataaattactattagatacatttataaagcaagtaattgaacaaggaaattatacagaacttgatagaaattacttatataatcggattttgaatttggtaggagaaggtgttgaaaaactaacaactactaaaaatgaaattattgatttaaaaaacgagctagttgaatatgctgtccaacatggtaaagttggtgaaactttgaatgaacaagattgtttaggtgcagagttgatgaatttcattactcctttaccaagtaaagttaatcaagatttttggcaaacctatcaacaaaagtcgccagaagaagctattcaaaatttttatgatttaagtaaacgaaatgattatattaaaacgaaagctattgccaaaaacatttattttccagttgaaacatcatatggacaattagagataacaattaatttatcgaaacctgaaaaggatccaaaacaaattgctttggctaaaaagatgaaggcaagtggataccctctatgtcaactttgtatggaaaatgaaggctatcaaggaagagttaattatcctgcaagagcaaatcatagaattattcgtttcgatttagatgataaacaatggggattccaatattcgccatatgcttattttaatgaacattgtattttcttagatacaattcatgaaccaatggaaatcaccaagcaaacattcaataatttgttaggtattattgagcaatttccaggatattttgtaggaagtaatgctgatctgccaattgtaggtggttctatattaacacatgaacattatcaaggtggacgtcatactttcgcgatggaaaaagcaccaatagaaacagaattaaaatttgcaggttatgaagatatacaagcaggaattgttaaatggccaatgtcagttattcgtttacgtggaaattcaaaagaagatttagtagatctagctgataaaattctaaaaacttggcgtggatattctgatgaagaagtttctgttttagctgaatccaatggtgaaaaacatcatacgattacgccaattgctcgcaaacgagatggacagttagaattagatttggtattgcgtgataatcaaacttcagaacaatatccagatggtatctaccatcctcatccagatgttcaacatattaagaaagaaaatattgggctaattgaagtaatgggattagcaattttacctcctcgtttgaaaggtgaacttcaagaagttgagaaatacttattaggtcaagaaaataaaatggaagaatatcatcaagtgtgggctgatgatattaaacaaaaatattcagatataagtcaagataatgttggtacaattattcaacaagaattaggtcgagtatttgctagagtgttagaagatgctggtgtttataagcatgatgaaactggcagaatggcatttaagcgttttgtagaggaagtaggaattgtggattaa

SEQ ID NO: 1229 - DNA, 1428 bp, Unknownn
  isolated from dental, unidentified
atgaaaccgtttactttgacggggaaagaaggtttttgtatgtttaagaagttacttgcgccacccggcaaaaagccacgtctttcagatgccgaggtcgctcgtaaatacccacgttatcgtactcaagtcattatttccattttcgtaggctacatgggatactatttcgttcgtaatactacttccattctttccggaattttgaaaatgtcagccaccgaaattggtattatcacttgtgccagctatattgcttatggggtttctaaatttgtttcaggtcttatttccgatgaatctaattctaaaattttcttgccacttgggctattattatcaggtattattaacattttcatcggcgttattccatcagtaatcacaagtgtttggctatttaccatcttctatctaattaatggctggttacaaggtatgggttggccacctggtgccagaactctagtatactggtttggtaataaggaacgtatcacttacggtaccatttggaacttatcacataacttcggtggagcaatcgcacctttacttgctggagctggtttagcacttgcaggaaatgatccattagcacaagcacgtgcagcatattggttcccaggtatcgttgtttgtatcatggccgttattatttactttattcaagaagatacaccagaatcagttggacttcctccaattgaagaatacaaatccgaagaataccgtgaaagcgacaacgctaaactcgaagaagatgctgccgctgttgaaatgagcatgggtgaaattgttaagaagtacatccttccaaataccaaattaatgtggtcttcactttatgccgctctcgtttacatcttacgttacggtattgtttcctggacacctaagttcctagcaacaagcattcaagatggaggaaaaggaattactgccactgctggtatgggtggtttctccttcttcgaacttggcggaattgctggtatgttaattgctggttgggtatctgctaaattattcaagaattctaaaccattaaccaacgttgcatgtttaattctcaccctcgtattactcgttgcttattggtttatcccagctggtcctgaatatatgatttgggatttcgcaattcttatcggtttaggtgcttccatttatggaccagttatgatggttggtttgtatgcgatggaacttgttcctaaagctgctgcaggtgctgccgctggcttgtctggtactttcagttatgttggtggcgctactgttgctactttggttatcggtatcatcgttgaccatttaggctggggtattgcatttatcgtattcggtatctctggcatcgccgctatcatttgtaccctactttctcgtgataaatcacttgagtactgggatgaagaaaaataa

SEQ ID NO: 1230 - DNA, 597 bp, Prevotella melaninogenica
  isolated from dental, Prevotella melaninogenica
atggaggaattaggagttatgaagttattagaagagagaattaagaaagatggagttgttttaccaggaaatgtgttgaaggtaaatcaatttttaaatcatcagatcgatcctgaattgatgtacaaaatgggagaggaatttgcaagattattcaaagatgaagaaataacaaaaattattacagttgaatcatcagggattgcacctgctgtaatgactggattagttatgaagttaccagttgtttttgctcgtaaacataagagtttgacattggtagataatctatatacttcagatgtttattcttatacaaagaaagttactaatacaatttctgttgataagaaatttttaacatcagatgataaagtgttgattattgatgatttcttagctaatggccaagccgttcaaggaatattcaatatttgcgatgctgctggtgctgaaattaaaggtgtaggaattgtcattgagaaatctttccaagaaggtgcaaagattattcatgatagaggagttagattagaatctctagctgttattagttcatttgatgataaccaagtacattttgaaggggaagaataa

SEQ ID NO: 1231 - DNA, 900 bp, Unknownn
  isolated from dental, unidentified
atgaaacaaggaacaaaacttttagaactagataatgggtaccatctatttactcgaaaggaagggaaaggtcccgttaagatgttatgcgtgcatggtggtcctggaggaaatcatgaagaatttgaaaattttgctcaaaatttaaatgataagggtgtagaagtttatacctacgatcaattaggttcgttttattcagatcaaccagacttttctttggaagaaaataaacattatttaacgcttgattattatttggaagaactagaagaagttagaaaaaaattgggattagataatttttatttagttggacattcatggggcggacttctagcacaagaatatgctttaaaatacggagaacatttaaaaggcttagttgttttcagtatgattgataatattgaagaatatacaacgcatatcaataagttaagagaaaaaatgtttaatagtttagaagttcaatatatgaaagatgttgaagaagctgaaaattttgatgatccaatgtatcaagaattgttgaaaaagctctatgctaaatatgttactagacatccaaaagtttcacatatggtcaatacaatggcaacagatgtatacaattatttccagggaaataatgaatttgtgatggtaggaactttgaatggttggagtgtacgagataagttagcaaatgtaaaagtacctactttattgacatttggtgaatttgacacaatgccattagatgtagctagaagaatgcaagatactttgccaaactctagattggtattaactccagacggtggacattgccacaatgaagataatccagaagcattcttcaagagcttatacaagtttgtatcagaagtagaagacggaacatttgggaaagaataa

SEQ ID NO: 1232 - DNA, 978 bp, Unknownn
  isolated from dental, unidentified
atggctaaaacaacaatgattaaagctattacagcggcaatggatgaagaattaaagcgtgatgacaaggtcttagtatttggggaagacgttggtaaaaacggtggtgttttccgtgcaactgatggacttcaagaaatttacggagaagatagagtgtttgatacaccacttgctgaatctggtattggtggtttagcagcaggtttagccttcactggttttcgtccagttcctgaaattcaattctttggttttgtttttgaagtaatggattcaattgcaggacaaatctcccgtgaacgttatcgtatgggagcaactcgtaagatgcctgttacatttagagctccatttggtggtggggttcatacacctgaacttcactctgatagtttagaaggcttgatggctcaaactccaggtttacgtgtagttattccatctggcccatatgatgctaagggactgttaatttcagctattcgttcagatgatccagttgtattcctagaacatatgaaattatatcgctcagttaaagaagaagttccagatgaagcatacatcgtaccattggacaaagcagcagttaagcgcgaaggtagcgatgtaagcatcataacatatggctacatggttcaagaaagtttgaaagcagctgaagatttagctaaagaaggaattaacgctgaagttgttgatttacgtacagtatctccacttgatgaagaaacaattttagcttctgttaagaaaacaggtcgtgttgtacttgttcaagaagcacaagcacaagcaggaatttctccagcggtagcttcattaattgcagaaaaaggtattctttcattggaagctccaattggtcgtgtaagtgcacctgatacaccatatccatttagtgaagctgaaagtacatggttaccaaataaaaaagatatcgtagagaaagttaaagaagttgtgaacttctaa

SEQ ID NO: 1233 - DNA, 1383 bp, Unknownn
  isolated from dental, unidentified
atgtcagaatttcgcattgaagaagatacattaggagaagtaaagattcctaagactgcactctggggaccacaaacagaacgtagtcgtaacaattttccaactggacgctttatgccaattgaaataattcgtgctttacttcaaattaaaaaggcagctgcacaatcaaatatggaattaaaccagattagtgaagcaaagggaaagttaattgttgaaagtatcgatactttacttgctttaagtgatgaagatcttcgtaaagattttccattaaaagtttatcaaacaggttctggtactcaaacaaatatgaactgtaatgaagtagtagctcatcaagctgcaaaattaaatcctgaacttgaaattttacctaacgatgatgttaataaaggtcaaagttctaatgatattttcccaacagcaatgaacattgtagctgcagatgcagtagctaagttggaagaatctgcacaacacttgattgatgaattaaagaaaaaacaagaaaaatattggagagtagttaagatcggacgtactcatttacaagatgctacaccattaacttttggtcaagaagtatctggctgggtatcagctctagaacatgatcttgaatacttaaaacaattagacggtacacttttagaattagcaatgggtggtactgcagtaggaacaggtttgaatgctgctcctggatttgctgatgtaattgctgaaaaagttggtaaagtatacggacatgaatttacagctaaaagcaataaattctatggattatcccatcactctaacttaaatgtagtgcatggagcaatgaagactttagcagacgacctaatgaagattgctaacgacgtacgtttcttagcttcaggtccacgtgcaggatatgatgaattgaatatcccagcaaatgaaccaggatcttccatcatgccaggtaaagtaaacccaactcaagcagaagcaattactatggctgcagttcgtgttacaggtaatgacgttgtagttggtatggcttcttcccaaggtaattttgaaatgaatgtttacaagccagtattaattgaagcattcttggaatcagctgatttattagcaggaacaatgagaggtttcgcagataagatgattagtggcctaactgttaatgaaactcgtatgaaagaattagtagacaattccttaatgacagttacagctctatctccatatattggataccatgacagtgctaagattgctcaaaaggcagataaagaaggaacaactttacgtgaagctgcaattgcatcaggtaaggtaactcctgaacaatttgatgaatgggtagatccattgaagatgacaaatatcgatcgataa

SEQ ID NO: 1234 - DNA, 3231 bp, Unknownn
  isolated from dental, unidentified
atgattttatgcaagttattgatcaaagaaaggaagaaagaaacaatgcctaaaagaacagatgtccacaaaataatggtgattggttcaggtccaattattatcggtcaagcagcagaatttgattattctggaacacaagcttgtttggctttacgtgaagaaggatatgaagtagttttagtaaactccaatcctgctactatcatgacagatacagaaattgccgacaaggtatatattgagccattaacagttgaatcagtttctcgaatcattcgtcaagaatttccagatgcaattttacctactttaggtggtcaaattggtttgaacctagcaatcgcattggctaaaactggaattttagaagaattaggaataaagcttctaggaacgcaattagatgcaattgatcaagctgaagacagacaaagatttaaggacttaatgcaagaattaaatgaaccagttccagactcaaagactgttgaaactgtgcaagaagctttagattttgcagctgaaattggatatcctgttattgttcgtcctgcatttacgatgggaggaactggtggcggattgtgtgataatcctgaacaattaaaggaaatagtagccaatggtctagaactgtcaccagcaactcaatgtttgattgaaaaatcaattatgggttacaaagaaattgaatttgaagtaatgagagacgctgacaataatgcgatggtagtatgttcaatggaaaactttgatccagttggtatacatacaggtgattctatcgtgtttgctccaactcaaactttatcagatagagaatatcagatgttgcgtaactgctctttgaaattaataagagcattgaaaattgaaggtggatgtaatgttcaattagcattggatcctaatagttatagatactatgttattgaagtaaatcctcgtgtatcacgttcatcagcattagcttctaaagcaacaggttatcctattgctaaattagcagctaagattgctgtaggattgacactggatgaaattaaaaaccctgttacaggaacaacatttgctgaatttgaacctgctcttgactatgttgttgctaagattccacgttggccatttgataaatttactcgtgcaaatcgtcgtttaggtactcaaatgaaggcaactggtgaagtaatggctattggacgtagtgctcaagaagctttacaaaaagcagttcgctcattagaaattgacgaaaaagatttaatttctgctaaagcacaatctgcaactgatgatgaagtagaagaaaaattattccacgcacaagatgacagactattttatatagcagaagcatttcgtaggggttacacaattaaagaagtacacgaattaactaagattaatttgtattacttagatattgtaaaacaaattgtagaattagaaagtgaactttctcaaaataaagaagatttagacgttttaaaacgtgcaaaacgttacggatatagtgattacacaattgctaagctatggggtactacagaagatgaagtaagaaatttacgtaaagaacataaattgctacctgtttacaagatggtagatacttgtgcagcagaatttgattcaagtacaccttatttctatagctcatatgacttagaaaatgaaagtaaaaaatctgataaaaagtcagtgcttgtaataggttcaggtcctattagaattggccaaggtgtagaatttgactatgcaactgtacacagtgttaaggctatccaaaaattaggatatgaagcaattgtaatgaattctaatcctgaaacagtatcaacagatttctcgatttctgataaattgtatttcgaacctttaacacttgaagatgttttaaatgtgattgatttagaacaaccaatgggagtaattgtacaatttggtgggcaaacagcgattaacttagccgctggattagaagcacatggtgtaaagattttaggtacaacagttgaagatctagatagagctgaagacagagaactatttgaccaaacaattaagagtttaggattaaaacaaccaattggtaaaacagcaactactcaagaacaagttattgcttgtgcagaagaaattggttatccagtattagttcgtccaagttatgttttaggtggtcgtgctatggaaattgttaataatgaacaagagttattagattatttagcacaaaatgctcctgcagaaattgatcacccaattctcgtagatgcttacttgtcaggtctagaatgtgaagtagatgcgatttgtgatggtaaagacgtattacttccaggtattatggaacatattgaacatgctggcgtccacagtggtgattctatggctgtttatccacctcaaagctttgatgaaaatataaagcaacaaattgtggatgcaactgaaaagttagctgtcgcattaaagtgtgttggtattatgaatattcaatttattatccataacaacgaagcatatgtgttagaagtaaatcctcgtgctagtcgaactgtaccattcttaagtaagattactggaattgaaatggcacaagttgcaacaagagtaattctaggagaatcattagcagaacaaggatatcaaagtggtttataccgtgaaagtgatatggtacatgttaaagcaccagtattctcatttagtaagttagcagatgttgatagcttcttaggacctgaaatgaagtctacaggtgaagttatgggtagtgactacacctttgaaaaagcactgtataaagcatttacaggtgctaagatggaattaccagataatggaaacgtgctattaacaattgaagataaagataaggatgctgtattaccacttgctaagagatttagtaagataggttatcgtatgtttgcaactgaaggaacaagtcaatttttacgtgaaaatgatttgtttgtacaaactgtagataagttaggtaaagatactggtaatgaaacttcattacatgatttgatcgttaatgatggtgttgatttagtaatcaatactatgagtcatgatcaagaagtagcatcggatggatttgtaatccgtcaattagctatcgagcataatattgcattgctaacatcattaaatacagcagatgcattattaaaagcacttgaaaatcgttcatttgctactaattcactttaa

SEQ ID NO: 1235 - DNA, 1008 bp, Unknownn
  isolated from dental, unidentified
atgaaattaaacaagactttattatccttaactgccgctactggtattatcgcaactggtgcagctgctaatggtgctaaagctgacaaaatcactgtaaaatccggtgatactgtttctcaacttgctttagaccatgctactaccgttgataacgtacaacaattaaataaccttgaaaatgttgatttgatctttgttggtcaaactcttgaaatgggcgatggtagttatactacaactacatatcaaactgcatcccaataccaacaaaattacgctcaaaatacagatgcacaagctaactatactcaaactgattatagtgctgctcaaaataatgtgcctgctgcaacagatcaagttcaagatactacaactactgttgaccaaacagctactcctgaagatacaactactcaagatgctcaaactaatgttgctagcgatactacaacttctgaaacacaagttgatgctacaaatactgatcaagcagctactacaacaaatgatgcagtttccacaaatactactgatcaaacagcagctcctgtagaaacagaaactacaacaactcaagcacaagcagaagttcaagcacctgctactacaacatatgtagaaaatacacctgctgaagctcctactacaacttggacagatactactagttctgtaaataatactgtagctaatactaactctaactattcttcagcaagtactacacctgctgctactacaacagctactcaaaatactactactagctctacttctagcgatgaagatgctgctagagaatggattgctaataaggaatctggtggtagttacacagctaagaatggtatctactatggtaagtatcaattaactgcaacttacttgaatggtgactattctgccgaaaaccaagaaaaagttgctaatgaatatgtagcttctcgttatggttcatggactgctgctaaagctcattgggaagcaaataactggtattaa

SEQ ID NO: 1236 - DNA, 366 bp, Unknownn
  isolated from dental, unidentified
atggctcgtattgcaggtgtcgatttaccacgtaacaagcgtgtcgtaatcggattaacttacatttatggtatcggtaattccacagctcaaaagatcttgagcgaagcaggtgtttcagaagatgttcgtgtacgtgatttaacagctgatcaagaagataagattcgtgcagttgtagataagtacaaagttgaaggtgatcttcgtcgtgaagtttccttaaacatcaagcgtctttctgaaattggctcttaccgtggtctacgtcatcgtcgtcatttaccagttcgcggtcaaaatactaagaacaacgcacgtacacgtaaaggcccagcagtttcaattgcaggtaaaaagaaataa

SEQ ID NO: 1237 - DNA, 768 bp, Unknownn
  isolated from dental, unidentified
gtgggctttatgattgaaaatgaaacaattaaacatcaactaaatcatcgtgcaattagagcttttaaagatcaaactttatcagaagaacaattaacgactttatatgaagtagctagacatacagctactagtatgtttatgcaacaatttagcatcttacatattactgatgaagagaaacgtaaacaaattagagaaataacaggtcaaaaatacgtaggtgctaatggagatttatttatttttattatcgatttatatcgaaatcaacaaattcgtaaacaaatgggaaatgatgatggacgtttgcatacaatggatattttcttccaagcattacaagacacaatgttagcagtccaaaatgtaattaatgctgctgagagtatgggacttggaatagtacctttaggaacggttaatgatgatcctaaagcaatgttaaaagtgttagatttaccagaactcacatatccagctttaggcttacaagtcggtgtaccagatcaagaaccacaattaaagccaagacttccattagaatttacaacttttgaaaatgaatatccacgtgattttgaagttagtgagttgaaagattatgatgaaatagtacaaacgtattatgatttacgcgatgctaatcgaagaattgattcatttactaatcaaattaacggaaaaaaattgaatacacatcaaaataaacgtgatgacattgtagaagctattcatagtcagggattagcgctagattttaattaa

SEQ ID NO: 1238 - DNA, 861 bp, Prevotella sp.
  isolated from dental, Prevotella sp.
atgagaagaaatgagaattatagtttaaatactgatatttatattatcttgttgttagtttgttcaatcatgacagctattttcgttggaatttcatctaatttgatgattttgaattgtgttttcttagcaattacttgtttcttagtattgattacttattttctcggcctattagctggattaatctttaatttactgtttgtctttattcagggaagttatgttttatatgcagatgtggtcttaggaaaagaactagatttatggttaattgtttggattttcttaccattgatttggtcattattagtaagctttatgacacgaaatcttcaaaaactacaagaagaaaatctaagtcttagagaaagtaatgcacgtaatctgggatataatagtgaaacagacttgcgtaccatgagatcttatcgtcaagacgcagaagtatttattgaaactcataaacgttttgatattcctgtttcaacgggaataatttcaattcgttacttccatcaaattatgaatattttaactgaagaacaacaacatcatttgatcaaaagattatcagatattttatctgagagttttagaaataatgacattgtttacagtattgatggtgtaggtggtgtacctcaatggggagttctattattcgcggattatgatggagcgatggtagcgatggatagaattaagcaaagagtaactactttactgcgtgaagataaggaattaggaaagtatgatattcaaatatctattggagttgttgaatacaatgaagataagataaagagtgtcagccaatttattgactctgctcagcatgtacttcaatacgacgtttag

SEQ ID NO: 1239 - DNA, 930 bp, Unknownn
  isolated from dental, unidentified
atgccagcttctctacaagaagttaaacgtcgaattgaatcgactaaaaaaactagtcaaattaccagtgcgatgcagatggtttcaactgctaagcttagtcaaattcaaaagcatgcgactagttatcaagtttatgccaccaaaattcgcagtgttataacacatctttctaaatcacatttactagattcagtaaatactactagtaaaaatagtgatggaaaggtaaacactctaggaatgttaaggcagcgtccagtaaaaactacagggattgttgtcattacttctgaccgtggtttagttggaagttacaatagtaatgttattaaagaaactctcgaacttatagaaaataatcatcatagtactgaagatgtagctattatagctattggaggtactggagcagatttctttaagaagagaggttataacgttgcttatgagtaccgaggaataagtgatattcctacttacaaagatgctagacctttagtagaggcaattgtaagtatgtatgataaagaagtatatgatgaattattcgtttgttacagtcattttgtaaatacattaacatcagaatttagagctgaaaaaatgttaccagtttcagctgaaaacatgggacatgatgacttaacaagtaacgatgaaggctacagtattgaatacgaaactgagccttctgaagatgcaatattagaagtagttttgccacagtatgctgaatctttggtatatggtgcaattcttgatgctaaaacatctgaacatgcatcaagttctactgcaatgaaatctgcatctgataatgctaaggatattatttcttcattagaattgcagtataatcgtgctcgtcaaagtgctattactactgaaatcacagaaattacaggtgctcaggctgccttagaatag

SEQ ID NO: 1240 - DNA, 1347 bp, Unknownn
  isolated from dental, unidentified
atggatagcgcattgaataaactatcaccaaaagatggatatttggtatctgcatctacctatatagataatcatgatattgaaattgttcaagtgctgtatcagccaataataggtattgtagcggtagcattatattcatatttacgttttgaaattgaccctaaattaatattaagtgagagaaaactgaataagaatattatagatggcttaggtataagtattcctgagttatatgatgcacgtttgaaacttgaggctactgggcttataaaaacgtttgaaggtgaagataaattaggtaagtatcatatctatgaacttcaaaaaccattaaacgaagtgaaattttttacagatgatttattaagcacggcgttattagaaatggttggaaatgaaaaatttaaaaaattatctttatggaataaatttgataataattatcatgataaaaaagaagttacaaagcaattttttgatgtatttaatttaaataaagataatattgttttacaagctcaattaaataatagtaagatttcaaatgatgaatctcttattaatcgtcaaaaggtgtcattagacatgacagtttttagtgatttcataaagaactcatatgtaagttcagatgatgttatgaatcacttagatattattaaaagtgtcaaattagtttatggtatagatgaatttcaattagtaaaacttttagaaaaagcaattaatgtaacaaataataagattgattataatgaatttaaaaaattagctcaaaaaaattttgatagcggaattcgaagaaactttaagaaaaacaagatagtagaaacggctaaagctaaagatgacgaaaaagataagaatattgatcctttagttaatgcttttaaagcctatgttccattagaatttttagagattctaaaaaatgagttaggaagttttgtcactgctaatgaaaggtatgctgtaaaaacattggtagaaaagcagatgttaccaaatgaagttattaatgttttaattcattatttgttagttgttcaagatagttctaccatcttaaaaggaacatttgaaagaattgctgctgattggacaaagaaaaaaataaaaaacgctcaagaagcgatgacttacgttaaaagtttcactcgagaaaaatcgctacaacgcaaagcgacaaaaaaagattcaaaaggccgcaaaagtaatgtaattgttaaagagaaattacctgaatgggctaaagaaaagggaaagaataagctaacagatgttggaaagaaagaaaataaagaaattgacgagctattgaaaaaaataaatggaaagtag

SEQ ID NO: 1241 - DNA, 831 bp, Unknownn; identical to SEQ ID NO: 511
  isolated from dental, unidentified

SEQ ID NO: 1242 - DNA, 951 bp, Unknownn
  isolated from dental, unidentified
atggataaattattaagtctaaataatttcgtttcggttgaaaatttagaaaatgaagatgttgaaaaattaattaaaagagcagaatattttaagaatggtggggaagctcctcatttgaacaaagaagtatatgttgctaatttattcttcgaaaattcaactagaacacatacaagttttgaaatggcagaaagaaaattaggattaacagttattccttttgatccaggtcattcttctgtaaataaaggagaaactttatatgatacattattaacacttggggctcttggagtagatttatccgttattagacattcagaaaataattattacgaaaaattgattaatttaaatcccgatcaacatttaaacatgggaattataaatggtggtgatggaagtggacaacatccatcacaatgcatgttagatattatgactattcacgaacagtttggaacttttaaaggattaaaagttgtgattgttggagatttaaagaattcaagagtagcaagaagtaatatgcaattactaactagattaggtgcaaaagtatacttctcaggacctgaatattggtatagttcagaatttgataaatatggggaatatgcaccattagacgaactaattgaagatatggatgttgtgatgttattaagagttcaacacgaacgtcatgacggtgataaaaatgaaaaattattttcagaaactgagtaccataaattgtatggacttgatgaaaagcgttacaataaattaaagaaggatgcaattattatgcatccaggtcctgtaaaccgtggtgtagaatgggcagatgaattagttgaagcacctaagtcaagatacgtaacacaaatgaaaaatggtgtatttatgcgtatggcaatgattgaagctgtaatgagaggtcgaaagttagggggactagaataa

SEQ ID NO: 1243 - DNA, 2286 bp, Unknownn
  isolated from dental, unidentified
atggaacattatgatggaccagctttttttcgtagacaaggtcgatcaagtaatatagatgaaaatagtgcaaaaaaaagttcaaatgtttcttctacatcttcttttaagaaagctagtcataaatttgaaggaagaaatattagacgtcaaagagcttttgtgcgaacaagcacaactttggacagttatagaacacgttcatttcgccctacatatgtaccaccttcatctattaagtttactaacaagaatgacaaagaaaaatatagtaagttagtagcaaaattgagattaaaatttaataatttatggttattcacggatgattttcaagagtctaaagatattgtagatgataatatctttgaagaaaataatctccaacaaattgaaaataaaaatgaattacctgaggatgaattagaaacaccagcagatagtaagttaactgaagaaataaatgatgacaatgctgatggtgatattaaagttaataaagaacaagaaattagcgagcctactgatgataaagagaatcaaggaaatgaggagacagaagatataaatagtaacgagatagaagtttcagaagattctatggaacaaaatgatattgatactatttcttcagaagaaagtgacgacaatagtatggatacagtaattccttacgaaacagctagaaattatcatcatgaagaaattgaaaaaactatagaacttaagcagcaagatgataatgctcctaagaaaaaagcattagatcgttctttagatgaaattatgcaacaagaaaagaatgatatgcaaagtcacttatccttatttaaccagtcgcaaaaaggtgacaataaggaaaatttaatgtataaattcccggaaatgtcattactaccagatcctgtaattaatgatgaagatgagatggatgaatgggtgttacaagaagtagatattctaaatgagactttagaggcttttcatgttaaagctgaagttactaattggactattggcccaacagttactcaatttgaagtaacgttaaataggggagttaaagttaataaaattacaaatttgacagatgacttaaaattagctttagcagctaaagatattagaatagaagcaccaattcccggaaaacgaagtgtgggaattgagataccaaataaaaagtcacgtccagttatgttatcagaagtcttaaattctaaagccttcaaagaagcaacctcacctttaactgtggcattaggtgtagacttatttggacaaccccaagttacaaatatagctaaaatgccacacggtctgattgcgggggcaacaggttcggggaaatcagtatttatcaatagtatgttagtatctttattatataaagcaacaccgacagagctaaaactgctactgattgatcctaaagctgttgaaatggctccatatcatgatattccacacttattggcccctgttgtatctgatcctcaagcagctacggcatcattaaaatgggcagttaatgaaatggaagaacgatttgaacgtttagcggctgcaggagctaaaaatatagaatcgtacaatgaaaaagctgaagaaaacggagattatggattaaaaatgccatatattgtcatcgttatagatgagttggcagatttaatgatggtcgcttcttctgaagttcaagattatattataagaattacacaaaaagcgcgtgcagcggggatacatatgataattgcaacgcaacgtccaagtgtagatgttataactggtgttattaaaagtaatatacctactagaattgcttttatggtatctagtcaagttgattcaaggacgattctagattcgtctggagcagaaagattacttggtagaggagacatgttgtatttaggaaatggtgaaagtcaagcaagacgtattcaaggaacgtacgttgaggatgaaatagaaaagattacagactttatccgagaacaaggaactccgacatatgcttttaatccagataagttaaaagttatagagacacagactgaaaatgaagatgatttaatgcctgaaattttagaatatatcgttaatgaagatggaatttctatatctaagcttcaaagagtattttcaataggctataatagagctgcaaaaattattgatgatttggaaagtaaacaatacatttcgtctgcaaaggggtctaagcctagggatgtatatttaactcctgaaaaacttagaaaaatgaaggaaacaaattaa

SEQ ID NO: 1244 - DNA, 1074 bp, Unknownn
  isolated from dental, unidentified
gtgctaaaagaggtggttggtttgctaactgaaagacagttgttgattttggaaacaataatccgagattatactgatttaggacagcctattggttctaaaactttgcaagaacaattacctatacgtgttagttcagctactattcgaaatgaaatggcagttcttgaaaaacaaggttttataactaaagagcactctagttctggtcgaattccttctcttaagggatatcgttattatgttgataatttagttaaacccgttaaaatagattcgaaatctgtaagaagtattcaatctctatttggaaatgaatatcgtagagttgatgaaataatagaaatgtctgcaaagatattgtctgatttaactaattatacggcgataactttgagaccagaagctagtgatttaaaactcgaaggattcaggatggtaccattaggaaatggccaagtaatggttattctcgttgccagtgatggatcagttgaaagccaaatttataatttacctaataacatagatggagagtctctagaagctgttattaggctaattaatgataaattggtaggttcttcccttagtgaagtcacttctaaactacaagaattgcagccgttacttactaaatatattgaaaaatctgatggatttatcgatgtatttggtggaatcttagataaagctatcaaagagcagttttatattggtggaaggcgaaatttgttaaattttgctaacggtaataatttagaacagatcaaatccctgtattcattaattgacgatgaatcagataagattggtgggttagtagataatacgactaatccacacgatcatcatggaatttcggttaaaataggcgatgagatgtctgataggttattgttagattacagtcttgtatcggcaacttacaatgttgggagtcatggtcgaggcatgattgctattctagggcctactaacatgccgtattctaagatgataggattggttgaagttttccaaaaagagctaactaaaaaattaattgattattaccgaaattttgataagtga

SEQ ID NO: 1245 - DNA, 2586 bp, Unknownn
  isolated from dental, unidentified
atgagtaagaaaattttatggaaagatgcatttcaagctattactagctcattgggtagatttatcgctatttttctattaatgatgctgggctcgtttacattaatagggctaaaaattactgggccagatatgagagaaactgcgactagtttttaccaacaacacaaattagcagatacaactgtggtatctaattacggcttggatgctaatgatgttcatgtaataaaagagtattcaaaaatcaaaaactatgatttaggttattttcaagatactaaggtaaataatgggcaaacggtagttagggtattttctaatccaaagaatatttcaacctatgagttggtaagtggcaagatgccgcataaaagtaacgaaattgcacttagttatttattaaaaggaaaatataaaattggacaaacaattgatgtagataaaaatacaagtttaaagcatgaaaaatttagaataacggggtttgtccgttcaagtgagcatttagataaaaatgatctcggccaaactaatgtagggacagggcaattaaatggagtagcagttgttgcgaaaaaagcatttaagaccaaagtatatacaattgcaagaattagatataaaaatactgcaaacatgagtccctattctgcgcaatatagaaatactgttgagaagtatcagaaaataataaaagataggctagataagaatagccagaataaattaaataaatatcaaaatcaaattgagcaggctagaaaccagataatgcagggaaaagaacagataaatcaggtgaaattattttcttcggcacaagctaatcaacttgaaaaagaaattagccaaaaggaaatagaattaaataaagaagaacaaaatataaaacaactaggttatccaacttataacgtgcatagtcgtaattataacccaggttatactttgtatcgatctaattctgaaagaatagatattctagctaatattttccctgtgattctattcgcaattgcggcactagtttgtctgactacaatgacaagatttgtagacgaagaaagaataaacataggaacgttaaaggcattgggatacagtgatggtgatgttagaaagaaatttgtcttatatagcttggtttcaggaatccttggaatcttattaggcgcaactttaggatatacttttctgccaagattgatttacaaagcttatactactaatttaacgatgcctgaagttaagttacaattttcatggatatatttattagtaacattggctattggactattatgtacaactttcgcggctttgtgggctttgagaagaacgttaaatgaaaaaccagcgcaattactattaccaaaggcaccaaaaaagggcgcacggattttactagaaagaattacgccactttggaatcgaatgagttttacttataaagtaacagcacggaatcttttccgttataaaagtagaatgttgatgacgatttttggagtagctggatgtacaggtctattagtaatgggatttggtataaaagactcgttgaatggaattagtgagatacagtataaaaatatcattaagtatgatttagtaactgtacagcaaaataatttgaccaagaaacaacaaaataagctagatgaagtattaaatagtgatgaaattaagcagtataaagatgtacattatgaacaactaacgaaaaaagctggagtagatgatacagaacaaatgataagtctacttgtaccaagttcgaataaaaatttgggaaagtttattggattgcatgagcgcaagactaataaagagctaaaattaacagctaatagtgtaattatctctgaaaaactagcagatctattaggcgcaaaaaagaatagtacaattactttaaaagatgatgaaggaaaatggcgtaagtttaaagtaacagacattacagagatgtatatgggacattatatgtttgtgggaaagcatgcatatcaaagaagtatggacaaaaaatatgcgactaatggggagttagtaacacttagaaataaaagtaataaaaatgttcaaacgatgtctgaaagatttataaagacgaatgcgattagtgtggtctcacaaaatataaataataaaaagacaattgacaatgttatgaatggattgggtagagtaatctttattttaattggaatagcagtgattttagctgtggtggtaatttataatttgactaacatcaacgtgtcagaaagaataagagaactatcgacaattaaggtgttgggattctatgataaggaagttacaatgtatatttatcgagaaacgataattttatcgttcatagggattttatttgggtatctgcttggaaaatggttgcataactttataattacgagtttaccaccaacgaatgcgatgtttgatcctaatatgtatgcgatgaattacattttatcaggggcaattccactgattgtaacgctaattctggcctttgtaatgcataggaagatacgttcagtagatatgttagaagctctaaaatcagttgattag

SEQ ID NO: 1246 - DNA, 687 bp, Unknownn
  isolated from dental, unidentified
atgattggaacattcttcaacgtcagtacaattctaattggaagtttacttggaaattacttcaagaaaagctttgccgataaatatcaagaaattctgatgcaagcgatgggactagccgctacttgcttaggaatgcaggctgtcttgcaaaatctccctaaaagtaaactccctatcttatttattttgagtttggcaattggcggagtattaggtgttaaatttgacctagctactcgtttttctaattccgtcaaaaaattcagtaattctaaatcatctgaaggattgtcaactgctatcttactatattgtatgggtactttatccattctaggccctgttgaagctgctttacaccacaattatacttatctttttacaaatggtattcttgatggcattacttctatcattctagcttcaacttttggattaatcattatgttggctgcacttgtcttattcttctggcaaggtagcttttatctaatagcattcttgttacaaagtaacgtcaatcctgactttctgcatgaattatcaattgttggcggtgttctaattctagcctctggtcttagtattcttggaattaagaagtttgagactatgaatttattaccatcgctacttgtctctggtattctcttctttattcttcattacatcggcacaatttaa

SEQ ID NO: 1247 - DNA, 681 bp, Unknownn
  isolated from dental, unidentified
atgaaaatgggggtttatctagtgggtaaattttatgctgtaaaaaagggaaggaaaactggaattttcactacttgggcagagtgtcaaaaacaagtatctggctttccaaaagcggagttcaaaagtttcattagcaagcaagaagcagatgattggttgaaagaaattaaaagtagtaatgaaaatagaagaaagagttatagtgttattgtctatacggatggtggttctagaaatcatggaaataaaaaaggagagcatgtaaagaaaaacgataaagctgcatgggcatatctaataaaatatcaaggttcaataattagtgatactgatggagaatatggaagtactaataataggatggaaatcatggctttaaagaaggcattattggatttgaaacaacgagagttacaaaatgaaaaaattttggtagttcttgattcaaaatatgttttagatgctattactaagcgatggttacaatcgtgggagaaaaatggttggaaaacttctgcgggaactggtgttaagaataaggaattatggatggaaattagcagattattgccagaatttccaaatttagattatcaatggacaaagggacatgccaatgatgaaggaaataatttagttgatgagttgttaaataaaactatggatcaaatggattag

SEQ ID NO: 1248 - DNA, 219 bp, Unknownn
  isolated from dental, unidentified
atggaccactacaagcatattaccatagatgaacgggaaaccatctttttaatgaggaatcatggaaactcacttcttgagattgccagccataccaagaaaagttactcaaccatttctcgagaattaagtcgtaattctactggtaaatcctattcaccttcgaaggctcaggagaagtacaaacagcgcaaagagaagcaggttccgaccatataa

SEQ ID NO: 1249 - DNA, 2646 bp, Unknownn
  isolated from dental, unidentified
atgaaagaaccatatcagataaagaaagaagaattatctaacgtttataaaaataataatttcaagcaaggattaacttcaaaagaagcattagagagattaaatgcagatggacctaatactttagaagtgaagcagactcccaaatggaaattatttttacgacaattcaataatgtagttatatatattctattgttgtcggcactgttgacactttttatcaaacattatacagatgcaatcgtgattattgcggtagtggttattaattccttgataggatatttccaagaaactagtgctgctaatgctttagctaaaattaagaatttaatggctcaaaaagcaacagtttatcgcgatggaatacgtaaagatattgcagcagctgatttagttaaaggagatgttgtgttcttagaagctggagataatgttccagcagacttaagaattgtagaagcagataatttaaggatagaagagtcagctttaacaggtgaaactaattctgtaactaaaagtgaggctactctaagtgaagaaaatattccattagctgaacgtactaatatggcatatgcttcaactgctgtaacaacaggtagtggtctaggtatcgttgtagcaacagctaatgatactgaaattggtaaaatctctcgtgaagtttcacaaataaaatcaactaaaacaccattaattaaagaaattgatggcgttggtaaagttgtatcatatatttcaattatcgcatcgatcatcatctttgtaatagggttcatgttgaagatatatgccttgccagcactagctttagcagttgtagcgatgttagtaggtgctattccagaagggttaccagcaactacttctgtgattctggcttttggtgtaagtaaaatggctcgtgaacataagactattattaaatcgatgccagcagttgaaactctaggttcagtagatattatcgccacagataaaactggtactttaactaaaaataaaatgacagttaccgatttatgggtaggaaatcagaaatatcaagtaacaggtagtgggtatgagcctttaggtaaacttctacaggacaagaaagaagtaactatgactgataagattgaacagtttattgaagctggctatcaagcaaatgatacaatcttatctgaacatgatggtaagtggcggataaatggtgaagcaactgacggagctttcttaactttataccataaattaaaaggtaagaatgccaagagtccataccatgaagtagatttattaccatttgattcagactatcgttatattgcgaaattggtagaaaacgatgctggtcaacaaatgatatttgtaaaaggatcaccagataaattattggaaatggcgcaaatagctgataataattttgagacaaaactatggatagatcgagcagcaacttggtctaaagcaggtaaacgagtgattgctgtgggttaccaagaagtgaaaggtaagaaattatcagaagtaacccatcaagatttgtaccaaggaatcacatggctaggaatggcagctttacaagatccaccaagagaagaagtagtggtagctcttcaaaagatgaatcaagctggtgttgcagttaagatgataactggtgaccatcctgagacagctcgagcgattgggaagcaattaggtttaactaaaggtaagattaaagcaataactgggcaacaatgggatgctttaactaaggaagaaaagcagaaggcagcacttgaaaatcaagtttttgctagaactactcctcaaaataagctagaaattattacggctttacaagaacagaagaaagtaaccgcaatgacaggtgatggtgtaaatgacgctcctgccttgaagaaagcagatattggaattgcgatggggataaaaggtactgatgtggctaaagatgctgctgatatgattttggcagatgacaacttcgcaacaatggcaactgttatcaaagaaggacgtaggatttacgataatatcaagaaaagtattctcttcctattaccaacatcttttgctgaaggtttagtagtggctttctcaattctgacaggacaacaagtaccgctacaacctgcacaattactgtggatcaacttgatttcagcaattacaattcaatttgcttttgtttttgaagaagcagaaagtgatttgatggatagaaaaccacgttcattgtcacaaaagttaatgaatatgagtgaaattagacaaatgggatttgttgcagctctaatggcaggttttgccttaattgcttatgagtggttcatcagtatgggagtcagtgagatcagtgcctctacaatgatggttaacatgattgtcataagtaagattttttacttctttagcattcgaacagatgattttgcactaggtaaagctatcttagaaaataagcatgcttggtggataattggattaatgatcttattccaattattcctaacatacacaccatttatgcaagtagcatttaaagtgacggcgatgtcactattagaatgggtagtagtaattctattttctattttgattttgctcatagtggaaggtaagaaacgattaactaaataa

SEQ ID NO: 1250 - DNA, 996 bp, Unknownn
  isolated from dental, unidentified
atggctactttagttttaggtggagctggatatattggctcacatacagtggatagattgatagagaagggtgaaaaaacaatcgttgttgatagtctggtgactggacatcgtcaagcggttaacaaggatgctaagttttatcaaggagatattgcagataaagattttatgcgtcaagtttttaaagaaaactctgatatagatgcggtcattcactttgctgcctattctttagtagcagagtccatgaaaaagccattgaagtattttgataacaatactgctggaatggttaagttattagaagtaatgaatgaattttcaattgataaaattgttttttcatctacagcagctacttacggtattccagaagaagttcccattaaggaaacaactccacaaaatccaatcaatccatatggagaaagtaagttaatgatggaaaagattatgcgttgggctgataaagcatatggaataaaatttgtaccattacgttactttaatgtggctggtgctaaacctgatggatcaatcggtgaagatcatatgcctgaaactcatcttttaccaattgtgttacaagtagcaatgggtaaaagagacaagctacaaatctttggtgatgattataatactccagatggtactaatataagagattatgttcatcctttagatttggcagatgcgcatattctagcggtagattatctaaaagccggtaatccaagtacggcatttaacttaggttcgtctacaggtttttctaatcgagagattttagaagcagcaagaaaggttacaaataaagaaatcccagctgaaatagcacctagacgtggtggagatccagatgtattagtggcttcttctacaaaagcacgagaagttttaggttggaaacctcaatttgatgatattagtaagattattgagacagcgtggaagtggcacactttacatccagaaggttatcaagataagtaa

SEQ ID NO: 1251 - DNA, 378 bp, Unknownn
  isolated from dental, unidentified
atgctaatagttaatagtagaaataatgtacataatatagtacaatataatgtaagagaaaagaaaggagtccttattatgccaattgctactactcaaagtgatttccgtaatcatattaaagactacttagataaagtcaatgatgaaaaccaaacagtactaattgcacgttctaatcaacgagcagcagctgttatctcacaagaacaactcaatacccttcttgaagctgttaatgctaaagaagattcactagattatgctattgccagagataagttaatcgaaatgcacatcttacctgatgatcctatcgttgaaccaactgacgattattggaacagttttaagccaaaggataacagtaaccaatga

SEQ ID NO: 1252 - DNA, 1845 bp, Unknownn
  isolated from dental, unidentified
atgtcaaaagctactaaaattatcagtttcatcgggttaaccattgcgatgtttatgggtaccttagacagtaccatcgtcaacattgctttaccccaaattatgactcatttcaatgccagtctaactgatacaagttgggttaccaccatctatacgttagccttagccgtgtttatgatcacgggttcaaagattgctgatcgttatggtcgtaaaaaaattatgttattaggattagccttatttggcggcttttcagcggcttgtatgctggcaacgtcgttaccagaattgattgcttttcgattttttcaaggattaggcggtgccattatcaccccgattgtcttaccaatgggaattgaaatatttggcaaagcgcatatgtccaaaattgctagcgttgtgggcgcggtaacggctttagccgctgccggggggccaccgattggtggcgtgattattaaatatgcttcttggcgctgggtattcggcattaatgtccccttaaccattgtagcctttctaattatagctatgggggtgagggaatcatatgacgaatctttggcggggagaattgacttaccaggaacgatttttttaacactaggcttgggtggtttaacctttggcctactagaaggccgccaatatggttggcaatcgggcatcatcttaggaaccctcattggcggcgtattagctattggattgttcatctttatcgaaagcaaagtcaaacacccactacttgaattagatttgttccgtgaaaaaaccttaactgcttctagtttagtttactttttaactggctttacgttagttagtcccaccctgattttaaattattttttacaagacgttctgaacgatacagcgttacatgcggccctaattattgttccagtttccttaacaatcatggtagcgatgcctttgggaactaagttatttgatcaagttggcgcagttccggttactttgattggtctcttagtcatggcagctagtttactcctcttgtcgtttatcaccaccacaacgcccaaagctgttatcattacttttctggtgattcatggtgttggttttgggttctcttcggtttcgttagtggcctcggttaagcatttgccaaaaaataaaagtgggattggttcgggaattgttaacgcagcgcgtcaaattggcacctgtttaggaattgcaattctagtaacagtccttgataataatgtcaatacagctaagcagcatattcatcaagatgccattcaaattgttgatcgacagcaattatcacccaaagtaaacaaagtggctcatcaacaattgaatagcctattttccactactggatcagccaaattaacaactaaaaacaaacagacgaacctaagacgtgcccttaaatcagcggccaaatctcaagttgatttaccacagccccaaaagggaaccgatctttaccaggtctaccaagcccagaagaagttagcactagctactgacaacttaaaagcgggtaaccagcaactagcacttaccttaaccaagttagaaaatcaaaataccactatatctaaactgtcagtagcttctcaaaaaattaatttgggtaatcagaaaataagccagggtcagaaaaaattgttagtaggtctcaaacaattggcacaaaaagaagctttaacgacagctttgagaaaaattaagcatactaagaatcaacaaattagccaggccttcagtcatacctacttagtaggcgcggtgattgttttgattctgtcgccggttgctttgttgacagatcgtaagtcattaaaaatttga

SEQ ID NO: 1253 - DNA, 2253 bp, Unknownn
  isolated from dental, unidentified
ttgaaaaaattattgggtgttgaggtgagatttatgaaaaaagaaacaatttggtcagctcaagatgtaattgatatgtgcaaaggatacatgaatgaaaatcatgttaaatttgttgagaaagcgtgtgaatttgccacttatgttcacagtgagcaagttagaaaatctggtgaaccttatataatccatccaattcaagttgccggaattttagcaaacttaaaaatggatccagaaactgttagtgctggttttttacatgatgttgttgaagacacaaaggttacactaggagatattggtgaattatttggaaaagatgtagaagttattgtagatggtgtaacaaagttaagcaaaataagatataaatctcatcaagaacagttagctgaaaatcatcgtaaattattgttggcgatgtctaaagatttacgcgtaattattgttaaactagctgacaggttacataatatgcgaactttgagtcatttaagaccagataagcaaagaagaatagcaaatgaaacccttgaaatttatactccattagctgatagattaggtattagtacaattaaatgggaattacaagatatgtctttgcgttatctaaatcctcaacaatattatcgtattgtacatttgatgaactctaaacgtgaagaaagagttcattatattgatgaagtgattgttgaaattaagaaagcaatcgcagaattgaatattgaatatgatatatatggtagacctaagcacatatattcaatttaccgaaagatgagagatcaacataagcaattcagtcaaatatatgatctttctgcagtacgtgtaattgtaaagagcattaaagattgttatgcagttttaggagctatccatactcgttggaaaccaatgccaggtcgttttaaagactatattgctatgcctaaagctaatatgtatcaatctttgcatacaacagtcatcggccctaatggtagaccttttgaagttcaaataagaactgaagaaatgcatcgcgtggctgaatatggtattgctgcacactgggcatataaagaaggacgtaaagatgcagttcctcaaacaactactggaacgaaattgaacttgtttaaagaaattatagaattacaaaaagagtcaaacgatgcttccgaatttatggaaagtgttaaaggtgacttgtttagtgatcgagtttatgtctttactcctaaaggtgatgtgtttgaattaccaaaaggctcaggcccattggatatggcatatagtatccatactgaaattggtgctcatacaactggagcaaaggttaatggtaagattcgacctcttgactatcaattgaagaacggggatattgtagatattttaacttcacaaaattctgcaggtcctagtcaagactggttagatttagtacacacaagcaaggctagaaataaaattaaacactttttcaagaaacgtgatcgtgaagaaaatgttgaaaaaggtagagaaatattagttcaagaattaaccaatgcaggatataatgctaaagatgttttaaatgataatatggctaaatgcttagagaaaaagcaatttaagaaagccaacgatttgtatgcttccattggttctggtgatactgcaccagttggaattgttaacattttaacagcagatcttagaaagaaagccgacgatgatagaaagcgtcaagaagaaaaggcattattggaaaatcatcaagaaattaataatgatacaaaggaaaataagaaacctaagcaagaaagtggtatcttaattgaaggtattgataatttgcttgttagattaagtcattgttgtaatccagttccaggtgatgacattgttggatatattactaagggtcgtggagtttctgttcatcgagttgaatgtcctaatgtgaaagcagccgaaagccagggaactagattgatagatgtatcttggaatatcttacctgacgatagagcttactataatgctgatttagaagttcaaggatataatagagatggcttgttaaatgatatacttcaagcaatcaacaataacactaagagtttgaattctgtaaatggacgaattgatcataataagatggcaaatatttctgctacgattggtgttaaagataaggaacatctccaaagaattattgatagaataaagaatattccggatgtttatatggttaaacgtccaatacattag

SEQ ID NO: 1254 - DNA, 906 bp, Unknownn
  isolated from dental, unidentified
ttgtctttaaaagtcttcctagagcttgttgagatcaaagctaaaacggcaagtattttaccatttttgataggaatttgttttagttattactactataactcagtacacttaggtctatcggtggtattttttgttgcgatgcttttgtttaatatggcagttgacgcattagataattataatgattatcaccatgcagttgataaactagaatataagcgtaagacaaatatcatcggaagagaaaatatctctcctaaattggtatttgtaattttagcaattatgacagtaattgctgcaattatgggactatatctagtatatgtaactggcttgccattgctttggatgggaatgttttgttttgctgtaggaattttctattcctcaggtccacgtcctttatctagtttacctttaggagaatttttctccggtattacaatgggttttgtaataagcttaatctgtgtttatcttaattcataccaaatgttttcatggcattgggagaatctagctaaggtatttttgatttctttaccaaatatcttatggatttctaatctaatgttagctaataatatttgtgattatgatgaggatgaaagaaataaccgacacacaattgttcattttattggtgtaaaaaatgctttatttgcatttagcttgaagaatgttttagcatttgctgcaattattctatctttttatctcaaactagcaccatggacaagtttgttagctttgttggcaataccatttgtatataaacaagataggatgttgatgaaagaacaagttaaatccaaaacatttaagtgtgcagtaaagattttagcttttggttcatttatacaagttctaacctattctattggattattatttttgtag

SEQ ID NO: 1255 - DNA, 642 bp, Oribacterium sp.
  isolated from dental, Oribacterium sp.
atggcaaatagggaaaacaaaccagtaataataggtgtaacaggtggatcaggttctggtaagacaacagttagtcgagcaatttttgaacaactacatggtcactcattattgatgttacaagaagattcttactataatgatcaaagtgacatgccttttgaagaacgcataaaaacaaactatgatcatcctaatgcatttgatactgagttgttggttaagcaattaaaagatttattagattggaaaaccattgaaaaacctatttatgattatacagagcatactagaagttcagaggttgaaaaggttgagcctaaggaagtaatcattctagaaggtattttagtattgaatgatccggctttgagagacttgatggatattaaaatttttgtagatactgacgatgatatccgtattatcagacgtattcaaagagatatcgaagaacgtggtcgctcattgcaatcagttattgatcaatataaatcaactgtaaaaccaatgtaccatcaatttatcgaaccaactaagcgttatgctgatattattgtccctgaaggtggagaaaaccaagttgctattgacttgttagttactaaagttagagatattttaagaaaacgagaaaaataa

SEQ ID NO: 1256 - DNA, 702 bp, Unknownn
  isolated from dental, unidentified
atgagtattattttactaattattgctttaatattcttctttatttgttccgtaattccatttaataaatatcacggaatcattgccttctttttcttaataattgctactttgagtggtatctcaattgttgctaatgatacttaccattatggtatgaaagtgaaaactactactactcgttaccaattagtttcagcttcagataagatgaacgtgcttttatatcaaccacttggaaatggctctgaaaaagtttatctttacaagacttcttccaagcaaaagatcaagcctatgaaaactaaagactctagtgctaagtacgttattacaagtgataaaccaaatgtaacaattactgaaaaacgctatgtttacaaagatggcgtatctaaattcttctttggcattcttcacaataataatgaattgaagcatcgctattatactttcaatatcaatcgtgattggaatgtattaacagctaagcaagccaaggaattaggtaagttggttaaaaagaatcaagctgcattgaagtctcaagtagaaactgaggttaaggctaaagttgctgctgcaatgcaagccaacccacaaatgtcagctgaacaacaaaaagaattaatccaacaagctcaaaatgaggctactcaagctgcgatgcaaaaattaattcaatctgtaaaagaaaaataa

SEQ ID NO: 1257 - DNA, 1059 bp, Oribacterium sinus
  isolated from dental, Oribacterium sinus
atggttgatacaccagcaattaagtttgaaaacatctcaaagacattccaaacagctgataatgaagtcaaagctgtacagaatgtaaatcttgaaatcaaatccggtgaagtatttggaattgtcggcttttctggagcagggaaaagtacattagttagaatgttaaatggattagaaaaaccaacgaaaggtaaaattcttattcatggtaagcgagtagataatcttgctggaagagacttgcgtgaacaaagaaagaagatcggaattattttccaacatttcaatttactttggtcacgaacagttttggaaaatattacttttccgttagaaattgcacatgttcctaagaacgaaagaattgagaaagctaagaaattagcagaattagtaggattaggcgatagattacatgcttatcctaaccaattatctgggggacaaaagcaaagagttggtatcgcaagagcattggctaatgatcctgaaattttgatttcagatgaagctacaagtgctttggatccacaaactactgaagaagtattggatttacttgaagatattaatcgaaagttaaatctaacaattgtaattattactcacgaaatgcacgttattagacgtttggctgataaggtggcagtaatggaaacaggtaaagttattgaagaaggacctgtttcagaagtatttactcatcctcaacaagacttaacgaaacgtttcgttaatgccgaagttgatacaaataatacacctgatgttaagaaagttgtaaatcaacttttagaaaaatacccacatggtcaattagtagagttaagattccatggagatcaggttcaattaccggtagtttcggaattagttagacaatttccggaagtgcagttaagtatcttggaaggatcaattcatcagttggccgacaaagctcgaacaattggaacgttatttgttcagttagttggtagcgatgaagatattcaagaagctttgaagttccttgaaactttaagagtggaagtgagggtgataagtaatgaataa

SEQ ID NO: 1258 - DNA, 1032 bp, Unknownn
  isolated from dental, unidentified
atgtttaagaatatcattgtaactggtggagctggattcattggttcaaactttgtacattatgtagtcaataatcatcctgaagttcatgtgacagtattggataaactaacatatgctggaaataaagaaaatcttgctggcttgccacaagatcgtgtagagttagttgtcggagatatttgtgataaagaattagtagataagttagttcaaaatgctgatgcggtggtacattatgctgctgaaagtcataatgataactcacttagaaatcctgatccttttattcaaactaatattgttgggacatcagttctaattgaagcatgtactaagtacgatgtacgtttccatcatgtttctactgatgaagtttatggtgacttgccattacgtgaagatttaccaggacatggtgaaggcccaggtgaaaaattcacacctgaatctccatataaaccaagtagtccttactcatcttcaaaggcaagttcagatttgttagttagagcatgggtacgttcatttggattaaaagcaactatttccaattgctcaaataactatggtccttaccaacatatcgaaaaatttattccacgtcagataacaaatattttaagtggtattcgtccaaaattatatggaacaggtaagaatgtacgtgactggatccatactaatgatcattcaagtgcagtttggaagattttgaatgaaggtaaaattggtgaaacatacttaatcggtgctgatggtgaaaagaacaacaaagaagttttagaattaatcttgaaattaatgggacaatcagcagatgcttacgaccaagttaaagatcgtccaggacatgatttacgttatgctattgatgcaagtaagttacgtaatgaattaggttgggaacctcaatacactaattttgaagaaggcctaaaagcaacaattgattggtatactaaccatcgtgaatggtggcaagatcaaaaagctgcagttgaagctaaatacgctaaaaatgggcaataa

SEQ ID NO: 1259 - DNA, 1620 bp, Unknownn
  isolated from dental, unidentified
gtggaaattttaatggatgacttaagcagtaaaaattatatttcctggcctattctaactctaatggcctttgttactgttatcggttttgatgacatcatgtataacttccaaaaccaaggaatgactgttattacttcctgggttttgatgctatttttatatgttattccttattctttaatcgttggacaacttggcggtatttttaataaagaaggtggtggtcttagttcatggattcgtggaactaacggagaatttctcggttacttcactgcttggacttattgggctgcttccgtaccttacgtagttgattctgcaaattctgttgtagttggttttggctgggcatttactggatcaaataaatttcaagatacaatgtctaatgccgaatttacattttggacttttttaattttcatcgtatttatttttattcaacgtcacttgaaaaattcaatggaactcctttctacaatcggtggcggtatgatgttcatcatgacaattttatttgttgttttagccttttttggtttagctaagaatggcggtcatatggcaactcagcctatgacttggaaaacaattatccctaaatttgatctaaaatactggtcaactgttggtatgttaatctatgcagttaatggttgtgaactcattgctccttatgttactaagatgaaacaacctaagcgtgattttcctaaggcaatgatcgctttatcaatcatgacagctttcttaactatttttggttcatttgcattaggtatctattttaatgcttatcacttaccaaatgatttaaagatgaatggttcttactatgcttttcaagctttaggacaacaacttggtgtgggtaaattgttcatgtacatctacgcttggacttctgttctttatatgtgtgctttactagcggttctattagatgctatgacacgtatgttaatctcagatactggtgataaattcatgcctaaattcttacgtaaaactaatagcgatggcttacctattaatggctatattttaactagctcattatcagctttcatcatgctattaggggtattcttaccagaaatgaatgatgtatttaattggcttttgaatttaaacggtattatttctcctggcgttacctgctggattttctatgccttcatgcgtgttcgtaaaaattcagctaaatatccatcagaatatgtttacataaaaaatgacaaactggcttatattgttggtttcttattacttgctgtaactgctattgctactattttgggaattacacctcaagatgttaagcaattcagtcatacatggtggtatgaattaattattaatattgttgcaattgtagttttaattggtttaggtgctatcttaccttctatccgtcgacgcgaagaaaaatatggtatcgcctttaataaaggtcagtggattgctattttaggcatcgtcattgtatctattatttttaatctctggcttggtggtactcatctagcttggcgcggattatatattgcaattgaatcaattattgccttgattgtaattactatgataggtcgtaagaatccaaatatttaa

SEQ ID NO: 1260 - DNA, 1326 bp, Unknownn
  isolated from dental, unidentified
ttgaaaggggctggaaaaatgggtgaaagaggtcctattgaaggagaatttacagaattaaattcatcaaataacaatcaaaataacaacaacaataacaataataaaattatcaagaaagttgcacttgttagcttagtagcaggcctacttggtggaggtattgcagttggtggatacaactggtatgaaaatagaaatgtaacttccaacaattctttgggaacaacgaaaacatctaatattaaggtagatgtaagtagtcagacaactaaagctttcaaatcagtgaaaaatgcagtagtttcagttgaagcttattcttctagcagtgcatctgattcacttgaagcaatctttggtaatagtagtaaaggagaaacaacaagtactagtgaaggttctggtgtgatttacaaaaaatctgggaatacagctttcattgtaactaataatcacgttgtttctggatccaataagattgaaattatcttggctagtggtaaaaaagtctctgctacagaagttggacatgatgcagttagtgacttagcggtattgaagatcaatgctaaagacgtaacacaagtagcgtcatttggtgactctgacaatattcaagttggtgaaacagccttggctatcggttcgccattgggttctcaatatgcaacttcattaactgaagggattatctcagctaagaaacgtacaattgatgtaactgatagttctggtaatgcaactggccaagcaactgtaattcaaacagatgcagccatcaaccctggtaactctggtggtcctttaatcaacttagcaggtcaagtaatcggaattaattccatgaaattgtcttctactggcacaagttcatatggcagtgacagcacatcagttgaaggaatgggatttgcaattccaagtaatgaagttgttaagatcattaatcagcttgtgaaaaatggtaaagtatctcgtccagccctaggtgtggcagtggtcgatttgagtaacatttcttctagtgatcaatcatcaactttgaaattgccaagtagtgtgactgaaggtgtggtaattgcgagtgttgaatctgattctccattgaagaacactgatattaagaagtatgatgtgattacaaaggttaatggtaagaagattagcgatgtagcgacattgaaagaagaattgtacaaacataagattggtgatactgtttcaattgagtattatcatgaaggtagtaagaagaccactaatgtgaagttgactttagaggcaaatgattctaataccacttcagcatctaacgaaaattaa

SEQ ID NO: 1261 - DNA, 1698 bp, Unknownn
  isolated from dental, unidentified
atgagtgatataaaaataatctcgctaggtggggtacgtgaaaatgcaaaaaacatgtatgctgtcgaagttgatgatgaaatatttattttagactgtggattaaaatatccagaaaatgaattattaggtatagattttgttattcctgatttttcatatttaagagagaattcacgtaaaatagtgggtgttttcttaacacacggtcatgcagatgccataggagcgctaccgtattttgttagtgaatttgatgtgccagtttttggatcagaattaacaattgaactagctaaaattgcatgtgaaaatgaagaagatgctagaaaattcgatgattttcatgtaattgatgagagtacagaaatagattttgaaaatgcaacgatatcattttttcaaactacacattctattccagagtctttgggtgtggttattaaaacagaaaatggaaatgttgtttatactggagactttaaatttgatcagtctgcagaaaaaggttatcgaacagattatgcaagattaactgaaattggtcgtgaaggtgtgctagctttattaagtgagtcagccaatgctgaaaatcctagagaaacagttaatgagcgagcaatatatgattttattagtgaaaattttgaatatcgtaaaggaagaattattgtagcttgcgtagcttcaaatattttacgagtacaacaaatttttaatgcagctgcagctaataatagaaaagtggctcttactggacatgatgtagaaaaagttgttaaaactgcaatgcgtttaaataaattagtattgccggaagaggatttactcatacctattaaaaaaattaacgactacaatgatgatgaaattgtaattcttgaaactggacgttctggagaaccattaaaatcattgcaaaaaatggctatgggtagacatagatttgtcaatctacatgaaggagatttggtatttattacaactactccatctcatgctatggaaactaaggttgcaagaactagagacatgatatatcgctcaggagcagatgttaaagccatttttgatgaattgaattcttcgggtcatgcaagtaagaatgacttgcagttgatgatgaacttggtaaagccacgttacgtcattcctgttcaaggtgaatatagaatgttgtctgcacatgcagaattagctagagaactaggaattcctagtgaaaatatctttttactcaaaaaaggtgatgttttagaatataagaaagatgagatgacaatttcatcaagtgtagaagtaggcaacaccatgattgatggaactggcgttggagatattggaaatattgttttgagagatagaaaaatcctatcagaagatgggatttttattgctgtggttactattgaccgtaaaaagaggaagattgttgatactcctaaaataacatctcgtggtttcgtatatattaaaacaagtaaagatttgatggttgaaagtagggatattgtagctaagattgttcagagagatttggataataaggaatttgactggagccaattaaaacaagatattcgagaaaatttgaataatttcttgtatgagcaaacaaagcgtcatccagttattttaccagtaattatggaaataaatcaaaataatcatttttctaagaagaaaaagaaaggttaa

SEQ ID NO: 1262 - DNA, 2100 bp, Oribacterium sinus
  isolated from dental, Oribacterium sinus
atggcaaataaaatactaaaaattggtactacttcaacaactgaagaatacgtaccattaccatggcttgctagcaatgtttatagtggaattacagcagccgaattagcagcttttgtgttgcctaaagcagatgaagttgcttatcaaaaagctcaagaattaatggcaaaagacggattgcaggttccggtaattttagtagatgctggtgaaagtttgtcgaaagaagaacttcaaaataaggtagcacaggcagcacaacaatatgaagcagaaaatgtacctggatttttgcgtgatttaatcaattttgctgatgaaaaaccagtcagttatacaactccgggacatcacaatggacaattttatgaaaaacatccagctggtgtagtgttcaaaaagttctttggagataatatgttgcgagctgatgtgagtgacacagtggcagaattaggtgatactttaactcatggtgggactccacttgattctgaacaagaggcagcacaagcattcaatgctgataaagtttattatgtaacaaacggaacaactagttcaaatacaatttgcgcaaatgctgttttattagaaggagacttagtattatttgatagaaataatcataaatctttatacaatagtgcacttattatgactggagctaaacctgtatatcttccaacaagtcgtaatcctttgggcctaattggtccggtaattagcgatgacttagatgaagaaaaaattagagctgaaattgctaaagttgatccagaaagagctaaagctaaaaggccgtttagaatggcagttttacaactcgaaacatttgacggtgttttctataatgcgaagtggctattagataagattggcaaactttgtgactatgttctctttgactgtgcttggggtggttacgagcaatttgtaaatatcatgaagcaactatcaccactacaatataaatatacagctgatgatcccggaattttagttacacaatctattcataaacaacaagcaggcttggctcaaacttcacaaatcttgaagaaagatgcacatattaaggggcaaaagcgttatgtagaccataaacatttcaacaatgcttatttgaaatatgtaacaacttcttattcctatccaatttatgcatcattggcagtgaatacagctttggctaagggtgaagcccctaaaaaatggtgggaagaagctatgaggaagggaataagatttagaaaagctttgaatcaaaaatctaaattattcaagaccttaaatgcccaagaaataaatgaaaagtcagaacaagaattaatggataacctatcttactggaagatggaagaaacagatgattggcatggatttaaagggatagctaaagatgaagcaattatcagtccattaaaattaactgtggtttgtccaggaattaacttagaaactggtaaatacgaagaaacagggatacctggaaaagttattggagagtatttaacagaaaaaagagtaattacatgtaagtctgatttgtattcaacattattcttgttaactcctggagaaagagatgctgatttagaagcactgttaacttcatttttagaatttgaagagtattacttgcgcgatgcactattggaacaagtattaccacgattggttaaacaaaatcctgaacgttatcaaggatatacaattagacaactttgccaagaaatgcatgaatattatgctaaaaatgaaatctacaaacttcaacaagatttgttcttaaagaagactttccaagattatgaaatgacaccagctgaagcagataagttatttatgaagaatgaaggagagttagtagatttagatgaaattgaaggaagagtagctcttgaaggtgcgctaccatatccaccaggagtatttattgtagctccaggtgaaaaatggcaaaagattgatgtggattactttaagattctaatgggggccattgataaattccctggatttgatccagaaattcaaggtgtgtacttggataaagatactggggtaaccaaggctcaaggatttgtgttatag

SEQ ID NO: 1263 - DNA, 2226 bp, Unknownn
  isolated from dental, unidentified
atgaataaggaattaacacctgaacaaataaaagaacaaaaggtttatctagaatggggcttaacacaaaaagaatacgaatatatttgtgataaattattaggtcgcttacctaattatacagaaactggtcttttctctgtaatgtggtcagaacattgctcatataagaaatccaaaccagtgcttaaactatttccaaataaaaatgaacgtgttttgcaaggccctggtgaaggtgctggtatcgtagatattggtgataatcaagcagtagttttcaaggctgaaagtcataatcatccctcagctgtagaaccttatgaaggtgcagcaacaggtgttgggggaatattacgtgatattttcagtatgggagctagaccaatagcatccttagattcattacactttggtgaaattgataatgctagaactaagtatcttatcaatgaagttgtagctggaatcggtggttatggtaactgtatgggtattccaactgttgctggagaaataacttttgatgattgctatgctggaaatcctttagtaaatgcaatgagtgttggtattttagaccaaaatcatattcaaaaaggacaagctaaaggtattggtaatgcagttatgtatgtgggggctaaaactggtcgtgatggtattcatggtgcaacatttgcctctgcagattttgctgatgataaggaaactcaacgttcagctgttcaggtaggtgatccatttatggaaaaactacttatggaagcatgtattgaattaacaaataatcaccaagactggttagttggtattcaagatatgggagctgcaggtattgtttcatctagttgtgaaatggcttcaaaagctaacagtggtatggaattaaacttagatatggttccacaacgtgaagaaggaatgtctgcttatgaaatcatgttgagtgagtcccaggaaagaatgttattatgtgtcaaaaaaggtcatgaaaatgatgttaaaaagttatttgaagactacaatttagaagctgtagttataggtagagtaacagaaggacatgattacatattacatcataaaggtgaagtagttacaaatataccagtatctactctaacggatgatgttttagaagaacctagtgaagaaagagttcctcaacgtattttagataataaaaataaagatgcttgggtaccacagttatctagtgcaaaagaaacattaaaagctttattgcaacaaccaacaattgcttcaaagaagatgtttacagaaacttatgattcacaagtacgaacaagtacagttgtaggaccaggaagcgatgctggtgtaattcgtattcgtggaactaaaaaagctttagcaatgacaactgatggaaatggtcgctttatttatttaaatccagaagttggtgggaaaatggcggttttagaagctgcaacaaatatcatttcaagtggtgctttgccattggctataactgactgtttgaattatggtgatcctaatgatcctgaaatctattgggaactacatcagtctattaatggaatggctgaagcttgcagaactttggatacaccagttatttccggtaatgtttctttgtataacgaaaataacggagaagctatttatcctactgctatgattggtatggttggattaattaaagatgtttatcgcacagtaccatcttttgttcaaaatgtaggtgacaaactttacttggtaggtaaaacaggtaatgattttaatggttctgaattgcaaaaattattaaataagaagatctctggagatctaaatgattttgatttagaaaaagttagctcatatttgaagaatcttttagcagctatggaacaaggtttagtttcatcttctcatgacttgagtgaaggtggcttgggtgttagcttagctgaaatggtttttggaactgataaggggatcaaagttagtttagatatgaaaaaagaactactattcagtgaaactcctggacgattagttgttagtgtttcaaaagataatgtagcagcttttgaagaaattatgggtgaagatattacggaaattggtgaagttcaagctgatcatcaattagatatagctttaacagatgaaaactttgttgcagaagtatcagaattagaaaaactatgggaggaggcaatcccatgtcttatgaaatcaaaggattaa

SEQ ID NO: 1264 - DNA, 2079 bp, Unknownn
  isolated from dental, unidentified
atgaataacaacaggaatggtaacggacttcttagaaatagtttcttttatatcgtagtattcttgggtattatgggtgtcttgtattatatgtttggtagtcgccaaagtatgcagacacaacaaattcaatctagtcaatttataacagaattgaagaagaataatattaaagattttacgatgcaaccttctggaagtacgtacaaaataacgggtacttatcgtcatgctaagaaatcatctggttcgagtggtattgccggaattgcttccagtggtgcggatgaatcaactggttttacaactaatgtattgacgaatgactcgactgtaaaacaaattcaagagtatgcacaaaaaaataaaataaaaaatagtgctaaagaagaagaatctagtagtatttggattcaacttttaatttcagtagttccaattctattcttcattttcttcttctacatgatgatgggtcaagctggccaaggtggcggcggtggccgtgttatgaactttggaaaatccaaagctaagcctattgacaaaaagaacaataaagttcgtttttcagatgtagctggtgctgaagaagaaaagcaagaattagttgaagttgtagaatttttgcgtgatccacgtaagttcttagctttaggtgctagaattccatctggtgtgctattggaaggacctccaggaactggtaaaactttacttgctaaagctgttgctggtgaagctggtgtaccattcttctcaatttctggttctgacttcgttgaaatgttcgtcggtgttggtgctagtcgtgtgcgtgacttatttgaaaatgctaaaaagaacgcaccatctattatctttatcgatgaaattgatgcggtaggtcgtcgtcgtggtgccggaatgggcggtggacatgatgaacgtgaacaaacacttaaccaaatgttagttgaaatggatggtttcgaaggtgatgaaggtgtcatcgttatggcagctactaaccgttctgatgtattagaccctgctttgctacgtccaggtcgttttgatcgaaagattttagtaggtcgtcctgatgttaagggtcgtgaggctattttgaaggttcacgctaagaacaagcctttagcaaaagatgtcgatttgaagatgattgctaagcaaacacctggttttgttggtgctgacttagagaacttattgaatgaagctgcattacaagctgctcgtcgtgataagaaagaaattgatgcatctgatatcgatgaagcagaagatagagttattgcaggacctgctaagcgtgatcgtgtaattagtaagcatgaacgtgaaacagtggcatatcacgaagctggacatacaattgtaggtttagtattaaatgaagcacgtgtagttcataaggttacaatcgtacctcgtggacgtgctggcggatatgctatcatgttaccaaaagaagatcaaatgttgatgtccaagaagaaccttaaggaacaaattgctggtttgatgggtggacgtgcagccgaagaaattatctttggtcaacaatcttctggtgcttctaatgacttccaacaagctactcaattagctagagcaatggttacagaatttggtatgagtgacaagttaggccctgttcaatatgaaggtcaagctaatatgcaacctggtgaattcaatggtcaacatagttactctggacaaacagctaatatcattgacgaagaagttaaacgtattgccaatgaaggtatgcaacaagctaaggaaattatcgaagctcatagagaacaacataaagtaatcgctgaagcattacttgaacatgaaactctagatgaaaaacaaatcttgagtttgtataagacaggtaagatgccagcagaaaacgaagatgaatttcctagtgaaaaggcagcaacttttgaagaagcaaaacaagctgttgaacgtagagaagctaaaaaacaattagctgaaaaagatgaggaacataaagaaacagaagtgttctatcctcatgaatcagatgaagattctgataagaaagatgaataa

SEQ ID NO: 1265 - DNA, 1026 bp, Unknownn
  isolated from dental, unidentified
atgcttgaaaaaatatattttggaacttataccagaaataacagtaagggtatttatcaagccaaattagatactgagaaaaaagaaattagagatttagaattatttattgatggtattgtaagtcctacatatcttacaacaactgatagtggaactttgttgacaattgctggaaatgatcaggggcaaggaggagttgcaagttataatcttacaacgcctaaacctgttttagttgatcaaaaattagctgatggtgcatctccttgttatgtaagctatgatggtcagcgtaagttggtgtatactgcaaattatcacaaaggtttagttgaagtatatcgcctagaaaatgataatactttaacattaaaagattccgttacttatgaaggaaaaggtccgcgtccagaacaagataaatcacatgctcattatgcagatttaacacctgataataaattgataactattgatttaggtgacgataaggttcacacatatgatgtatcagaagaaggtaagatttctgaaatagcagcttttcaaactcctgaaggttttggccctagacacattgtattttccaatgatggtaaattagcatatttagcaggagaattatcaagtgaagtagccgtattggaatataataatggtattttgaaacttattcagatagtatcaactatacctgtagactggacaaagcataatggggtagcggctatacgtatttcttctgatgataggtttgtgtatgtttctaatagggggcataattctatcgcagtatttgaagttgaggaagatggtattttgaaacttattcaaactatttcaacaaatggagattttccacgcgattttgcgcttgataatagtgagagatttatagttgttgctcatcaaaattcaacaattgcatctttgtttgcaagaaatgaaacttctggtaaactggaactattgcaaacagacattccagttccagagggtgtttgcgttcattttgtaaaatag

SEQ ID NO: 1266 - DNA, 849 bp, Unknownn
  isolated from dental, unidentified
atgactaaagaagttgtaattgtaacaggtgcttcaaaaggaatcggttttgaaacagttttagctgctttaaataatgatatgatagtagttggcacttctcgtacacctgaaaagttggctgctaaggttcaagaaaaattaccagctaaagtagataactttactgcaacgaagatggacttcaatgaagaaagcattaagcaagttgtatcagaagtgattgctaaatttggcagaattgatgttttagttaataatgctggttatgcaattttgggtgcttttgaagatatggatatggcagaagttagaactaactttgatgtcaacgtctttggattaatgagtatgactcaagcagttttgccacaaatgcgtaaacaaaagagtggtcgcattattaatctatcttcaatttctggatctgttactggtccaagtcaatcaatctactcagctagcaaggcagcagtaactttaatgagcgaagccttagctcaagaagtagcaccatataatattaaagtaactgcactttgcccatggggagtacgtactgatttcttagatgaatcatctttgaagaagccagctactcaaggtggggattacaaggtagttgatcaaactttagctggcttggcacgtctaaatcataatcaaaatggcgatcctgctttagtagcacaagcaatcatgaaagtagtagatatgcctaatccaccagctcgtctttatttaggtgcaggtgctttaatggcagttcaaagtaagattgaagaaatagtccaagtggcaaatgaaaatctagaattaagtcaaagtatcgatagcccagcaaattaa

SEQ ID NO: 1267 - DNA, 924 bp, Unknownn
  isolated from dental, unidentified
gtggactttacagagtttttaactaacaatccagttgttttagatggggcaatgtcaactccacttgaaaaattaggcgcagatacaaataatgatttatggacagctaaagcattgattgataatgaagaattggtatatgaagttcataaaatgtatttcgaagctggagcggacttaataattacggatacttatcaagctaatgttcaagcatttgaaaaagttggatacagtgaaaaagaagctagaaatttaattaaaaaagcagtaaaaatcgcacaaaaggcacgcgatgattatgaaaatagaacaggaaagcataattatattgctggaacaattggtccatatggtgcttacctagctaacggaagcgagtatagaggagattatgagttatctgttgaagaatatcaacaattccatttaccaaggattgaagaattggtaaatgcagaggtcgatatcttagctattgaaactcaacctaagttagatgaagtgctagcaattctagaattgttaaaggaaaaatatccgcaacaaaaagtgtatgtttcttatactttgagcgatgatgatacaatcagcgatggaacaccattgcctagagctatccacgcacttgaggattattcgcaagtaatagcagtaggaatcaattgtgtaaaactagagttagtagaaccggctttaaaaaatatgaaagaaatcacagataagcacttaatagtatatcctaattcaagtgcggtctatgatcctaagagtaagacttggtcccaacctaaaactagtgcaacctttgaagaattgattcctaattggtatgaggcaagagctagaattattggtggttgttgtacaacaggaccaaaggaaatcaaagcagtggcggattttattaagcgtaatagataa

SEQ ID NO: 1268 - DNA, 780 bp, Unknownn
  isolated from dental, unidentified
atgagagattttcaaggcattgatgctaacgttaaagattggctaagaaaagctcgggaaataatattagatagtttcaatttaagcttggatgttgaaacgaaaagtggaccgacagatttagtgacgaatgttgataaagaggttgagagattttatattcaacaaatacaaaatgcatacccagaagctaagattttaggagaggaaacttcaaaaatacatccgcttacaaatatggaagggctagtttttattttagatccaattgacggtacgatgaattttgttaagcaaaagcgtaattttgcaagtatgattgccgtatattataataaccgtccgcttttaggatatatatatgacattataagggatgaactatattggggtggaccggtatatgatgccgtttattgcaacgattatcagcttgcaactccaacagatagtattttaagtgaaggtttagtacaactttgtagaccttttgtcatgaatgatagctatggttttagaagagtagtagatgctagtgctggtttaagaatgtacggttgtgctggtctagaatttattaatgttttaacaggaagatgtatttgttatgcgtcagcattacgcccttgggatttggctgctggaaaaattttagctgaaacattagatttagttgttgaaacaattgacgtaaaagaaactaatatgttatcatcaaaagttgtattagtagctacaaagaatgctgaaaaagacattacaaaactcatttatatatag

SEQ ID NO: 1269 - DNA, 1098 bp, Unknownn
  isolated from dental, unidentified
atggctggtattgattttgataaattaaaaaacatcgttgatgacaagtttgaaacagtgcgtgttctcgataatgatggaaatgttgttaacaaggatctatttcctgatttaagtgatgaacaaattgttgaattatttaagaaaatggtttggtctcgtgtcctaaacgaacgttcaactaaattgaatcgtcaaggacgtctaggtttctttgctcctactgcaggtgaagaagcttctcaaattggatcagaatttgcaatggaaaaagaagactatatccttccagcataccgtgatgttccacaattggtattacatggattgcctttatacaaagcattcttatggtcacgtggtcatgttgatggaaataaatatcctgaaaacttcaatgcattaccaccacaaattattatcggtgctcaatatgttcaagctgcaggaattgctttaggtttgaagaaaaaggggtctaagaatgtagcttatacatacacaggtgatggtggtacttctcaaggtgatttctacgaaggtatcaacttcgcaggtgcatttaaagctccagcaatttttgtagtacaaaataatggatacgctatctcagttcctcgtgcaaaacaaacagctgctaaaacattagctcaaaaaggtgtggcagctggaattccatttgttcaagtagatggaatggatgcactagcaatgtattcagtaatgaaagctgcacgtgaatatgcagcagctggtaacggtccagtattaattgaaacattaacatatcgtttcggaccacatactttatctggtgatgatcctaagcgttatcgtacagctgaagaagaacaagaatggaaagaaaaagatccattaattcgtatgcgtacttacttagataagaagggtctatggtctgaagaaaaagaaaaggcatggacagaagaagtaaacaaggaaatcgatgaagcaatggttctaacagaaaaagcacctaagcaaaaagttagcgaatatctaaagaatgtctttgttgatacacctgcaactattcaagaacaaattgataaatacacaaagaaggaggctgaataa

SEQ ID NO: 1270 - DNA, 999 bp, Unknownn
  isolated from dental, unidentified
atggtaggagttattcttgctagtcatggtggttttgcagatggtattcatcaatctgctgaaatgatctttggacctcaagaaaattttaagagctgtatcttaaaacctgatgaaggcccagaagatgttaaaaagaagatgcaagaagctgttgcaagtcttgataatcaagatgaagttttgtttttagtagatttatggggtggaacaccttttaaccaagcttcaagtttagttaaagaacatgaagataagtggacaattgttgcgggaatgaatcttccaatggtaattgaagcattaacacaacgtttctcagtagaatctgctagagaaatcgctagagcaattgttccaactggtaatgacggtattaagacatttccagaagatgcaatgccagttaaaaaagaagctgatactaaagcagttaagacaagtggcaaaaagaagacaatccctgaaggtactgttttaggcgatggacatatcaagtatgttcttgctcgtgtagatacacgtttacttcacggacaagttgctacaggttggacacatactactcaaccaaatcgaattattgttgtttcagatacagtttgtcatgacaagttgagaactagcatgattaagcaagctgcgcctaatggggttcgcgtaagtgtagcacctatcaagaatatggcaaaggctaataatgatcctagatttggtgatactcgtgcgatgctcttgtttgaatcagttgaagatgctttagcagctgttaaggcaggggtagaagtaaaagaaatcaaccttggttcttctgcttataaagaaggtaaagttaacgtaacaaaagccttgtcatttgatcaaacagatgttgattcaattaaagaattacaaagtatgggtgtaaaatttgatgttcgtggggttccagctgatagtcctgcaaatatcgatgatttaattaaattagctgaaaagaaattagctgagaaaaattaa

SEQ ID NO: 1271 - DNA, 1149 bp, Unknownn; identical to SEQ ID NO: 172
  isolated from dental, unidentified

SEQ ID NO: 1272 - DNA, 1011 bp, Unknownn
  isolated from dental, unidentified
atgctcagactaggaattattggaacaggatggattgctgaccaatttgttgaagctgctcatgcaacaaaaagatggcaattatcagctgtttattcaagaaggatgaagagagctaaagaatttggaagcaagtattctgaggatattgtctattttgatcgattatccgattttttccaaagtgatagttttgatgtagtatatattgcttctccaaatagtcttcattttgaacaagctaaagctgcaataatggctggaaagcatgcaattgtagaaaaaccaattacatctaatccacaagaaatgtcacagttaattaaaatattaagaagacatccacaacaatttttatttgaagcagctagacattatcatgaagaaaacttcaaagctgttcaacaagctgtacaaggaatggaagaaattcaaggtgcaactttgacttatatgaagtattcctcaagatatgatgccttcttagaaggtaagaatcctaatgtattttcaccagattttgctggtggtgctttacaagatttaggggtttatatggtgtatgatgcactagcatggtttggagtaccagatagtgtaaattactatgctacaaagctaaataatggaattgatggaaaaggcattgcaatttttaattacccacaattcgaagtaactttgcaatttggaaaaactgcaaactcatatttacctggtgaaatctatggtaagaaagaaacaattgttatggataatgctgcagatttaaatgaagtttacattgtcaatggcgaaggtgaaaagacaattatttcagagttagcagataataatccaatgttagcagaagttatagattttgctgatgtattagaaaatccagatagtcttgaagctagagatattgctgatgaatggttagctatgtcagttgaagttaataaagtaatgtataaattacgttactatgcaaaaatagaatttccaagtgattatgaagaagagtag

SEQ ID NO: 1273 - DNA, 1143 bp, Unknownn
  isolated from dental, unidentified
atgaaatttgaaacaaaattaattcatggcggacaaagtgaagatcaagcaacaggagcagtatcaatccctgtatatcgttcatcaacattccatcaatatgagttgggtggtaatcctaagtgggaatacagtcgtacaggaaatcctacacgtgcagccttagaagcgttgattgctgatttagagggtggagtagctggatttgcctttgcttcaggttcagcagcaattcatgctacattctctatgtattcagctcatgatcattttatcgtaggaagtgacgtttatggtggaactttccgtttgataaataaagtgttgaaacgatttggtttagaatttacagttgttgatatgcaagatttggcagcaattgaaaatgcaattcaagataacacagtggcaatctactttgaaacaccaactaatcctttgttacagattgcagatatttcagctattacaaagattgctaagaaacataatttaaagacaatcgttgataatactttcgcaactccatacaaccaaagaccacttgaattaggtgctgatattgtagtgcattcggctactaaatatttaggtggacatagcgatgtagtagcaggtttagcagttactagcgacgaagaaatcgcagaaaaactagcatttctacaaaattcaatcggtagtacattaggaccagatgatagctggttgatccaaagaggaattaagacattaggtgctagaatgagagttcatcatgctaatactgaggctataattaagtttttagaaaatgatggtcgcgttgcaagaattctttatcctggtttgcctgactttcctggatatgaagttgctaagagacaaatggatcattttggagcgatgatttcttttgaattacaagaaggattagatactaaaaagtttgttgaaagtttgaaagtaatttctcttgccgaaagtttaggtggaattgaaagtttaattgaagttccatcagtaatgacacatggctcaattcctagagaaattcgtttggaaaatggaattaaagatgaattgattcgtttgtcagtaggaattgaagatgaagaagatttgattgatgatttgaaacaagctttggataagattggataa

SEQ ID NO: 1274 - DNA, 876 bp, Unknownn
  isolated from dental, unidentified
atggcaagtagatctaaaggactaggacgaggaatcgatgctttattccaggaatctaaagaagaacaacaaccagatgaacaagtggtagaacttgaaattagtgagattagacctaatccctatcaaccacgtaagacttttaatgaagaggcattagaagaactagcaaaatcaatcaagaaatctggagttttccaaccaattattgtgcgtaaatcttcagttaaaggatatgaaatcattgctggtgaacgtcgctatcgtgcatctaagttagctaaaaagacagagattccagcaataattcgtgaatttaacgaagaacaaatgatggaagtggcagtgttagaaaatcttcaacgagaagacttaacaccattagaagaagcagaagcctataacactttgatggaaaaattgaatttaactcaaactcaagtgtcagagcgactaggaaaatctcgtccatatattgctaattatttgagattattaggtttaccaggtaaagtaaaactaatgctacaagatggaagcttatctatgggacaagctcgtactttattagcagttaaagatgaagaaaaattaatggaattagctgaaaaaactgttaaggaaggcttaactgttagacaattagaacagttagtagcacaaattaatggtaaaaagccaaagaaagctaagaaacaaactaatccatatgaaccttacattaagcaaacagaaaacttacttcaagaaaaatttggaactaaagttgccgttaaagctaatgctaagagtggtaagggaaagattgaaattgattatttaagtattgatgacttcaatcgaattatggatattttaaaaattaagttagactag

SEQ ID NO: 1275 - DNA, 1152 bp, Unknownn
  isolated from dental, unidentified
gtgaaatttcacataactggtcgagaaaagagtgagctattaggcgaaggtattttaacaattatattgttaattctgttaaatatgtcgctttatgtgattttgaatcaattgttagtatctaatcctgatttagcttcaggaatattcctaatcaaaacttccttagattttaagtatgcacatattcaattatggagttggggttggatattcattatacttatggcggtagttgatgttatcgtagtttattggagattagttcgacgatatcatcaaatgcaattgagacatatcattaatgagctccactatattgcagatggtcactttaatcaccgtattccttttcaattaaagggacaaatgcaaagagtagtagcaagtgtcaatgcacttgttgatagtacgattaaagcgatggaagatgaaagagagatcgaacgctctaaagatgaattaataacgaatgtcagtcatgatatacgtacacccctgacatctattattggatatttgggtcttattgaagataaacaatatcgatctgaagaagatattttaaaatatacgcatacagcatatttaaaatctaagcagatgaaatcattggtggatgacttatttgaatatacgaaagtacgtcaaactgatgcaccattacaaatacaatctctagaattgaatgcgatgctagaacaaataggagctagttttgaattggaagcaaataaaaagggtatggaaattaatacaattttacccgacagtccagtaaaaattgaagctgatccagaaaagcttgctcgagtatttaataatttaatcacgaatgccttgaagtatggtagtgatggtaaaaacatttacttgcaattaacaaaagtagatgaaaaagaaatagaaataagaatttctaatgatggagaacctattccagaaaaatcattgcgacaggtatttgatagattttatcgagtagaaagttcacgttctaaagaaacaggtgggacaggactgggattggcaatagctcaaagtattatagaattacatcatggatatatttatgtagaatctaataaaaatttgactagttttattatgagattacctattaaacatgataatgtagtaaaaaaatcttag

SEQ ID NO: 1276 - DNA, 1338 bp, Unknownn; identical to SEQ ID NO: 242
  isolated from dental, unidentified

SEQ ID NO: 1277 - DNA, 873 bp, Unknownn
  isolated from dental, unidentified
atgaggggagtactgatgaatttaaagcaactgcagtattttatagcggtagtggaagaaaaacagatcacggctgctgcgaaaaagctaaatattgcccaacctccattaagttaccaattaaaacaattagaagcagaattagaaactaaattatttactagaactgcccatggaattgtattgacggatgcaggtatgatgttagaaaaatatgcaagaaaaattctggatttgactacagtggctaaagaaaaagttaagaagaccactaaaggagaattgggaaaaatttctttaggtacagtttcttcttccgcagctgctttaccaataggaaaattgaaagagtttagaaagtattatcctgaaataaactttgaaatatttgaaagcaatacgtatggaatactggaaaaattatttaatggtgagatagatttaggattggttagaactccttttaatcaaagagaacttgaaactaaaattgtgatggaagagccaatggtagcagtggtaaatagcgatgattatttaaaaggaaaaaagaagataggaattgatgatttagaagaagtaccactaataatatataggagatttgaaaatattttccgacaaactttttcacaatttgggataagtccttatatagcagtaaagtgtgatgatgcaagaacagcaatttactgggcaaagttagaaatgggcgtggctttagttccagcttcttgtgccaaaaattatacgaatggtagaataattcctataaattacccgggatggaatacccagttaacattaatatggctgaaaaatagtaataaatcaccactaatattgaaattaatagagctatttagtgtataa

SEQ ID NO: 1278 - DNA, 1674 bp, Unknownn
  isolated from dental, unidentified
aggaggaatcagaaattgaaagatattgaaatagcacaaaaaagtgaaatgttaccaataactgaagttgctcaaaaggtgggattaactgctgatgaaatagaacaatacggtaagtataaagcaaaaatcagcttacctctttctgcacgtgaacaaacaaaaagaaagttggttttagttactgcaattaaccctactccagcaggtgaaggtaaatctactgtaacagttggtttgggcgatgcatttagtttattaaacaaaaaggtaatgattgctttacgtgaaccatcattaggacctgttatgggaatgaaaggtggagctactggtggtggatattctcaagttgttccaatggaagatataaaccttcattttacaggggatatgcatgcattaacaactgctaataatactttagcagctttgattgataaccatatttaccaaggaaataaattaaacatcgatcaaagacgtgttatttggaaacgtgtattagatattaatgatcgtgcattacgtcatgtagtaatcggcttaggtggagctactcaaggtattccaagagaagatggattcgatatcactgtagcttcagaattaatggctattctatgtctttctaaagatatttctgatttaaagaaacgtatcggtcaaattgttataggatacaattttgataaagaaccagtaactgtagatcaacttggagttacaggtgctattacattgttattaaaggatgcttgcaagccaaacttggttcaaacactagcacatactcctgcaattgtgcatggtggaccatttgctaatattgcacatggatgtaatagtgttcttgctactcaaacagctttgaatttagctgattacacaattacagaagcaggattcggtgctgacttaggtgctgaaaaattccttgatattaaaactccagtgttaggaaaaacacctgatacaatcgtaattgtggcaactgctcgtgctttgaagatgaatggtggagtagctaaggataatttagatgaagaaaatgttgctgcagttgaacaaggttttgcaaacttgaagaaccatatccaaagtatgaaacgttataatgttcctgttgtagtggcaattaataaattcactcaagatactgatgctgaattagctaagattgttgaactttgtgaacaaaatgatactagagcaattgttgctgacgtttgggctaaaggtggagaaggtgctacagaattagctaaagcagttattgaatcttgtgataatgatcaagaatttacaagactttacaatagcgatgattctgttgaagaaaagatcaacaagattgttactgaaatttacggtggcgatggggttgaatttagtgctaaagctaagcgtcaattaagacaatttgaaaaattaggttggaaccatctacctgtatgtatggctaagacacaatattcattgtctgataatgctaaagttttaggtgctccaaaaggatttaagattcatgtgcgtgaatttgtaccaaaattaggtgcacaattccttgtagcattaacaggaaatatcttaactatgccaggtctacctaaagttccagctgcagatggcatggatgttgatgaaaatggaaagattagtggtttatactaa

SEQ ID NO: 1279 - DNA, 921 bp, Unknownn
  isolated from dental, unidentified
atggaaaatagactaaattattataaaattgaacgcgatgaatggagcaatttctatcaagaacatattgttccgttaaccgaagaagaattattgaatttaaaatctttaaatgaccaaatttccttgaaagatgtgcaagatatttacatgccactggtgcatctattaagaatacacttagactcacaccaagagctacaagacagccagtctgagtttctaggagtaaaagcacaaaaggtaccatttattctaggaatagcgggatcagttgcggtaggtaagagtacaactgctcgcttattacaaagcttattaagtgaagtctatccagataagaaagttcagcttattacaacggatggtttcttatatcctaatcgagaattgaaaagacgtaacttaatggaaagaaaaggattcccagagagttatgatatgagaagactattgcgttttgtaaatgacgttaagaataatttacctgctaaagcaccagtatattcacataaagtctatgatattgtaaaaggacaatatgaaacagtggaaagtccagatattttaatcgttgaagggattaatgttttacaattgccaactaaccaacaaatctatgtgagtgatttctttgatttttcaatttatgtagatgctgaagaaagtttaattgaagaatggtatctggaaagatttgagactttgttagatacagcttttaaggatcctacgaactattattatccttatgcaattggtgaccgaaaacaagcaattaagatggctaaaaatatttggaaaacaataaatcttaagaacttacgggaattcatcctaccaacacgtaatcgagctgatttgatcatgcataagacgaataatcatgtagtaaatgagttatttttgagaaaatactaa

SEQ ID NO: 1280 - DNA, 486 bp, Unknownn
  isolated from dental, unidentified
atggaaatcgaagtaggaaatttcattactgcgattgaaaacgaggattatcacaaggagacaatcacagctagagcctcagacgtagacagcatgggagtagctgatgttatggtaccggtgattgataaatttgaaagttctattaaaaataataaattaactcaaattgagttagttattgattatgcagatggcccagtttttgttagactagaatccggaataattaatttaccatatagcaatattgataaggttgataatttctttaatggattggaagaaaaggtaccagtagtagtgaatttaatagttgaatcacctaaattgaatgcatcaggattcaggatagacaccttaggaagtgtcgatgaatttctcgcaaatccagaaaattatgaagcaaagattgcaggaaatattgccgaaaaaattgcagtaattgaaagtgcagaaatttctgaagaagatacaaataattaa

SEQ ID NO: 1281 - DNA, 1062 bp, Unknownn
  isolated from dental, unidentified
tgcaaggaaaatgcctcagccagaaaaagtcagatttggacagaaaaggtcaaattgtgtggagtgacgtttatggatgtatgtttcaatcaaatactcggaattttaaagaagtactgggcagataaagatggtacagcgggatatgatgtggctagaaaagtcatcagccttataacgactgagaaattgcaagagtttaaatccgatacaacttacaaaactattttcgcaactggtccatcaaaaatagcaactgccagaatacttaacaatttagccggagtaaataagtttgcggactacatagaagaaaatatctccgaagatggtagaagtaatcttgcccaagacctcaaaaagcttactggagtgcctatggatagggggacagttgggcgggtatgctataacttattggttgattctctgaaagctggcaaccatctaaaaaataataaaaataaaaaatccccactcaaaaaaagtgaggagaaaaagatcgatgtgcgtagtggcattcaccaatatataagctatgtgcgtgataaagaagaaattgaagttgatggggtttcttttaaagtgtcagcacatttaatgaatgatgaattagaagtagtgcgtaccttaccgtattgtcatgctctgtttgaagcatactcggcaaaaggaaaacaaaagattactgccgaaaatatagaagatagtgagtataagagctactttgaaagagagaaagagtggtttaacgaagcggcctggtatgaacgatctttaagagatacagtggttgattttgataatcagtatgacttattgaaacaagatgtctatgaaggtattgaacccgtttatcatgatgaagacttcggtactgatggtatgaagagattaaaaaaggttcatcaacaagtggttgttttgcaacttgacagatcaaatttgaaaaatatcgataacattcttggaaacgacacaaaggagggattatgccatgttttggttaatgatggaaaaataaaatcgtgggtaaaggtggattatgatgaagttatttaa

SEQ ID NO: 1282 - DNA, 1179 bp, Unknownn
  isolated from dental, unidentified
atggaatttgagaaatccgaaattctaaagaatctaccaaagcaattctttgctaatttggtaatcaaagttaacaaaaaaattgcagaaggagtagatgttatcaatctaggacaaggtaatcctgataaacaaactcctgaatatatcgtcaagagcacacaaaaatgggtagctagtccgcaaagtcacaagtactcattgtttcgtggacagccagaatttaaacaaactgtggcagacttctatcaagaaaagtatcaaactacattcgacccagaaaaagaagtcgcagttcttggtggatctaaaactggcttagtcgaactaccactagcattgatgaatcctggcgatgtatttttattacctgatcctggttatccagattattggtctggagctacacttggacaggttacttttgagaaagttccgcttttgaaagagaataatttcttaccagatttgaaatctattcctgaagaacttgctagaaaggctaaattcttctatattaactaccctaataatccaacgggtgcgaccgcaactcgagaattttacgaagaattagttgcttgggcaaagaaatatgaagtaggtatcatcagcgattttgcatatggtgcaattggttttgatggagagcgaccattaagttttatggagattccgggagctaaggatgttggtatcgaattttataccttctctaagacttttaacatggcaggctggcgagttgcttttgcggtaggaaatgctgatatcattgatgctttaaatcttatccaagatcatttatttgtaagtatctttccagctctacaatatgcagggattgatgctttgaaagctccagaacgcgatgctgagatcaataagattgtagatcgttacgaaactagaagaaatgcgttcatccaagctgctgaaaaaatcggatggaaagcttttgtacctaagggaacgttctacgcttggatggaagtaccaaagggatatagtagtgaagaatttgcagatctgcttttaaatgaagctggagtagcagtagctcctgggaatggttttggcgaatatggggaaggttatgtacgaattggtttgttaatcgaaccagaacgtttagaagaagcagttgatagaatcgcaaaacttaatttatttaaatag

SEQ ID NO: 1283 - DNA, 1074 bp, Unknownn
  isolated from dental, unidentified
atgaagaaaaaaagaagtttacgaaataaatttacagggaaaaagcgctgggtaatagttggtggagttgtagtattattggtagctggagtagctgtacattctgcaatttcagataaaaattcaagtgaagcttcaaaatatcgcgttgctaaagtgtcacaacaaactagctttacgttaacaggaagtgttgagccagttcaaaaggaaattttagatactcctagtggtgatatccaaagtattaatgttaagaatggtgagcacgttgagcaaggacaagctatcctaactacacacaatgcggataagcaagattcggttgtggaagttcaaggtgaaattgataaatctcaaagagcgatgaattcgcaacaacaaagtattaataatattaagaagcaaatgagcagtgtgggatcaggtaatgatggatatagtgaattacaaggacaattaactgaagcgcaaaatgcttatgctgatgcccaagcaagtgtaaatgctgcaagaaataagttaaatactttatctagtaaggttaaccaaactttaacagctccatatgctggatatgtcgaaatagatacatccaaacaaaatcaaccagttgttactttatattctgatgatagacaagtttcagctcaaatttcagaatatgactataacaaggttaaattaggtggaaatattcaggttaaggcagtagctactaataaggttcaagaaacacaaatatcatatttgtcagaagtaccaacaaaagatagcaagggcaataatactaaatatgatttaaatgctaaagtggatgccaagaaattcatgttaggtcaaactgttaaaatgtcagtagtacaaaagggaataaaaattcctaaagctgctgtaatagatggaaaagtatacgttgtaaataaagctggaaaagcccaagcaactaaagtgtcaggcaaagaagttaatagctattttattgtagatcaaggccttgtagatagcgataagatagttactaatccagataaagacctaaaaaataatgagcaggtagaaaataatgattag

SEQ ID NO: 1284 - DNA, 642 bp, Unknownn
  isolated from dental, unidentified
atggctaagatatttgtagttggtggctctggtagagtggcatcagaactaattaagaatttaattaatgatggtaatcaagtatttgcaagttcacgtcatcctgagaaaattattaagttagataatgttgttccagttaagttagatttgcatagtgatgttagtgcttggtctgaagtttttaaaggcatggatgttatttactttgtagctggatctagaggtaaagatttgctacaaacggatgcaatgggagctgtcaaaacgatgcaagcagctgagaacgttggtgttaaaagatatataatgttgagttctttgtatgctttacagcctgaaaaatggtcacaatatgaatcattggcagcgttgactgattataatatcgcaaaattctttgcagataattatttagtcaatgataccaaattggactatacagttgttcagccagcatcactaactgaagaaacaggtactggaagagtatcttttaatgaaataataagtaatactaatccaattccagatgttgctaaagtattggcagaggtaatcaaacataacaatacgattggtaaagttattatgatgtgtagtgggtataacccaattgaaacagcattaaaagacatttag

SEQ ID NO: 1285 - DNA, 891 bp, Unknownn
  isolated from dental, unidentified
atgaaatttacgtggaataaagaaagtgacaagaaaatgacactcaaaaaatttttaaagaataagggtgtcagtcatcgaactttaagtagtttaaaaaaaggaaatggaaaagttttagtagatggcaaaaaaaagtcattatttattgaagttggtaaaggaaaaataactttgattttaccaccagaaaaatcagatgaaaatgtcaaaatgagtaaggaaccgctagatattatttatgaggatagcaattggctagtggtagataaaccacctttactttcaagtgttccaggtcctagtaatcgtaccgataccttagttaatcgggttaaatttcatctatggcaacaaaaatcaaaagacttagttccgcatgtaattactcgtttagatagagatacaagtggcttagttcttgtagctaagcatcgttttgctcaaggattgattaacaaacaggttgaagaacatagtatagataaaaggtacttggcagtgatcgaaggaattattacagaaaagcatggcataatagataaaccgcttggacctagagaaaatggaatcggacaaatggtaactgacacaggaaagattgccaagactgagtactgggttagagaatacttaggagacaaagctactttagttgaatgtaagctacatacaggtaggacacatcaaataagagctcactttagtagtattaatcatgctttggtaggcgatgagctatatggtggcagattggattggggactagaaagacaagcactccatgcatatcaactagcttatgtagatctatttactcaagaagaaaagttatttaagagcgagatgccaaaagatttagaaaatttgatagttagattgaaaaattaa

SEQ ID NO: 1286 - DNA, 654 bp, Unknownn
  isolated from dental, unidentified
atggcaatacttagcttacaaaatgtaggatataaagttgatactagtgagatattgaaaaatataaatatagatatcaacgaaaatgaatttataacaatcaccggtccttcaggtggagggaaaagtactttactaaagataatagctactttactaactgcgacaactggagaaattttctttgatggaaaaaatcaagatgagtatgcgataactgaatatcgtcaacaagtatcatactgtttccaacaacctagtttatttggagagacagtatttgataatttgagttttccttatgagattcgtcaaaaagaatttgatgaaaaatctgcaattgaagctttgaaatctgtaaacttaccagaaacttatttacataaggatattaatagtttatctggtggtgagcgtcaacgagtagctttattaagaaatacgatgtttttaccaaaagttttgttgttagatgaagtaactgtaggtttggatgctcgttcaattgaaattgtgcatgaatttattgataagatttggaaacaaggagtaacaattctacaaattacacatcatgaaggagaaattaaacaagctaataaaataatttgggtagaggaagggatgattaaagatgtcacaactaagcgttaa

SEQ ID NO: 1287 - DNA, 450 bp, Unknownn
  isolated from dental, unidentified
gtgagtattacgaaagatgaagtccaagcattaacgtcaagattagatttattgattgctaaaggtgctagagaatacaaagattggaatcaaaaacatgggttaactgattatcgtagtgtgattttatatgagttacttttacatacgagattaactcaaaaacaaattgtagaaagaactaatctccctaaacaatcaattaataaaggaatcttacaactaagagatgaaggttatcttactttagaacaagatgaaaaggataatcgagtaaaatattgttttttaacagaggaaggtgaggagtatgcgagggtaaaaatccaaccattactagatattgaagaaaaaattattatgaaaatgggaaaaaagaaaatagaacaattaaatgaattactagaagaatggaatttaaatttcaaaaaatacaaagatgaagaatga

SEQ ID NO: 1288 - DNA, 399 bp, Unknownn
  isolated from dental, unidentified
atggttacactttatacatcaccaagctgcacatcctgtcgtaaggctcgtgcatggctagaagaacataatattccatttgaagaaagaaatattttttctaatcctttgaatgttgatgaaattaaacaaattctacaaatgacagaagatggaactgaagagattatctctaaacgttctaagatttttcaagatttagatattgatttagatgagttaccattacaaaaactttatacattaattcaaaagaatccaggtttgcttagaagacctatcataatggatagtaagagacttcaagttggatataatgaagacgaaatcagaagattcttaccaagagatgttagagctttagaattacaaagagcacaagcattggtggatctgtaa

SEQ ID NO: 1289 - DNA, 1698 bp, Unknownn
  isolated from dental, unidentified
atgtacagtctcttagctatcataatttttgtatgtaagtcgatatttttaagaaataaaaagcaaacattaatatcattaagtattttattactagaaatattattaatttttatttttatatatttcttactcccatcgagaaacttactctcattgttactaggaaatgccattttcggtggaattttcttaattttaaatctatttattggaaattttgatgatgatattcgccgaggaaaattatgggttaataaatctttttcaattggattatcagtagttatgattacacttttgatagcagttggcggtgaactacattcaatactatcagttaagccaacttataattcaatttcagtcaaaaaagtcagttccaaacaagctccaacatttaaacgtggtgagactcctgtagccttagcacctaaaactgttttgaatcgagtaagaaaagcagtttctgatttaccaaatagtcagtactacaaaattgccggaactgtgcaagcacaatatattcatggtaaagcagtctatattatccccgttgaataccaaggattctttgcgatgatgaaagcaaaaaatattcctggatattttatgattgatgcaactagtcaaaatgcgacaccaaaatttatcaaaaaaccgtacaaatatactacaagtgcctatttcaaaagagatgccgaaagacaactatatcgaaataatccacaatggttgaaattaggtgatggcggcgcacagctagaaattgacaataatggaaatccttattgggtagaaacagtctataaatccgaatttctaagccacagaattaactacaaaaaactaagagtcattgttatggatgctgttacaggaaaaactaaaacatacaaattatctaatttgccaaaatttgtcgatgaaggtatcacttcagatgttgcagcagaaataaacagtaattatggtagttacaagcacggattttggaatcgtttcttgggtaaaacagatatggaagaaccaactaataatggcccagaagacggcgtaacttcaatattcaatgaaaatggaaccattagctatttcacagactttactaaccctaatactaaatctgattccgctttagggtactccatgattaatgctcgtacaggtgaattaacttattacaaaactaatggaatcatggatagttctggtgcaaagagtaacgctaaccaaaattacaaagctcaacaatggacagctaacatgcctatcctatataacgttgatggacgaccaacatggatcatgactattttagataaaacacacgcaatcagaggatattattatctcgatgctgaagatcaatctatttacggaacaggctcctccccaattagtgccctagatgattttagacaagcattagtaaacagtggagctaaagcatcaaatacacctaatagtaacctaaagcagattacaggaacagtagatagagtagcaatagtatccaataaaaacaaagtaatgtttactctcaaagatagtcaagttgtttacaccatcgatactgatgattttgccaaagctaacttgcttagaagtggtgacaacatcagtttcaaagctaacgttgttaatggacaaagtattgggaacgtaacaaaatttaccaaccataacttgaagtaa

SEQ ID NO: 1290 - DNA, 1413 bp, Unknownn
  isolated from dental, unidentified
atgttgcaattgtataatacattaactaatcaaaaagaaagatttgaaccattaaatcctggaaaagtgacaatgtatgtctgtggaccaacagtatataactatattcatattggtaatgctagaagtgcggttgcttttgatacaatcagacgttatttagaatatcgtggctttgaagtaaactatgtttcgaattttacagacgttgacgataaaatcattaaagcaagtcaagaaatgaatctttcggttaaagaaataaccgaaaaatttattaacgcgttttatgaagatacaagtgttttgaatataaagaaagctacattaaatcctcgagtaatggataatatggacgatattatcaagtttattgaagttttagtgcaaaaaggatatgcatatgaatctgctggagatgtatattataagactagaaagtttaaagattatggtaaactatctggacaattaatagatgatctagaacaaggtgctagtagccgggtcgacgatatcgaccaagataaaaaacaagatccattagatttcgctctttggaaaaaagcaaagcaaggagaaatatcttgggattctccttggggacaaggacgtccagggtggcatattgaatgttcagtaatgtctactaaatatttaggagatacaatagatattcatgctggaggacaagatttagaattcccacaccatgaaaatgagattgcacaaagtgaagcaaagactggcaaaaaatttgctagatattggttacataatggatttgtaacaattggtgaagaagatcaaaaaatgagtaaatctttaggaaattttgtaaccgtacatgatttactaaaggaagtaaaccctcaagttattagattctttatgtcaacaacacaatatcgtcgacctatccgatatagttctgctaatttaaacgaagcgaaagttaatctaaataaactacaaacagcttatgaaaacttaagttatcgtttaaaagatagtgtagaaggaaatgataaagaagtagaagctaattttgctaatcttgaaaaagattttgttaaagttatggatgatgattttaatgtacaaaatgggatttctgttgtttatgaaatggctaaacaactaaatgtctattcagaaaaagaaaaggtatatactgatactattaataacttaattaacacttataagaaagtcgtagaaatttttggtataagttttaatgaagaaaaagaattgttagatgatacgattgagaaacttatccaagaaagaaatgaagcaagaaaaaataagaacttcaaacgtagcgatgaaataagagatctactaaaagaacaaggaataattttagaagatacagcacaaggtacaaggtggaagagaaatgattaa

SEQ ID NO: 1291 - DNA, 1641 bp, Unknownn
  isolated from dental, unidentified
atgggaggaatttatatggcaacgccacaagaaattttaagaaatccatttttaaataaaggtacaggcttctctaaagaagaaagagaagaattaggcttagtaggattattgccaagtcacgttcaaacaatcgaagaacaagctgaacgtatctatgaacagtatagctcaaagacatcaagattggaaaaaagaatttacttaatgtccttatttaatactaatagaacattattcttttatctaatgggacaacatttaagagaatttatgccaattgtttatgatccagtagttgctgaatcaatcgaaggatacaatcatttatttatgcgtcctcaagaagcagcatttatttcaatcgataaatctgaatcaattgaaacaactttgaaaaatgcagctgatggtcgtgacattcgcttaattgtagttactgatgctgaaggaattttaggtattggtgactggggtgttgatggtgttgatattgctattggtaaattaatggtttacacagctgcagcaggtattaacccagcacaagttttaccagtttctattgatgcaggtactaacaacaaagaattattgaatgatccattgtacttaggtaacaaacatgaacgtgtctatggtgaaaagtactacgaattaattgataaatttgtagctgcagttcaaaaattattcccagaatcaatgttacattttgaagactttggtcgttctaatgcggacgttattttaaataagtataaagataaaatcttaacattcaatgatgatattcaaggtacgggtattgtttgtttggcgggtgtcttaggtgctttaaacatttcaaaacaaaaattcacagatcaaaaattcttaacttttggtgctggaacagctggaattgggattgctcgtttaatgtttgatgaaatgaagcgtcaaggcttgagtgaagaagaagctaagaaacacttctatcttgttgataaacaaggattattatttgacgatacagaaggattaactgaaggtcaaaaagcatttgttcgttcacgcgatgaatttgaaaatgctgatgaattaacaaacttagaagctgttgtaaaagcagttcatcctacagttatgattggtacttcaactcaaccaggtgcgtttactgaaagtgtaatcaaagaaatggctgcacatacagaacgtccaatcattttcccaatttctaacccaactaagttgattgaagcacatgcagatgacttgattaagtggactgaaggtcgtgctttagttgcaacaggtattccatcagatgatgttgaatataatggggtaacttataagattggtcaagctaacaacgctttgatttatccaggtgtatgttttggtgcaatggcagcaagttctaaagtgttgaatgaagaaatgatttcccaagcaagtcatgctttaggtggaattgttgatcctgatgaaccaggtgcaccagttttaccaccaattgataagttacaagaatttacaacaacagttgctgaaactgtagctcaatcagttattgatcaaggtttgtctaaagaaaatgtgacagatgctaaaaaagctgtagctaatatgaaatgggaaccacgctattaa

SEQ ID NO: 1292 - DNA, 1068 bp, Unknownn
  isolated from dental, unidentified
gtgaatttaggaggtctctttgacttagatgctctagaagaaaagattgcagaaaatgaagcaaggatggcagaaccaggattttgggatgaccaagaaaaagcacaagaagttattgccgaaaataatgatttaaaggcaaaatttgagacatttcatgaactggcggaatctatttcagatttagaagtgtcgttagagttattacaagaaattccagatgatgaagaattacaagcagatttagaagaaaattatcaacatgctgaaaaattgttacaatcataccaattaaatatgttgttaagtgaaaagtatgataagaataatgctattttagaaattcatcctggagcaggtggtacagaatctcaagactggggatcaatgctactaagaatgtatacacgctgggctagtcaacatgattttaaagttgaaactgtagattatcaaccaggtgatgatgctggtataaaaagtgtaacgcttatgatagaaggaaaaaatgcttatggttatctacgaagtgaacgaggagttcatagactggtacgtatttcaccatttgattctgctggaagacgtcatacctcgtttgcatctgttaatgttatgccagaacttgatgattctgttgaagttgagttaagacctgaagatataaaaatggaggtctttcgtgctagtggagcaggtggacagcatattaataaaacttcttcagctgttagacttattcatataccaacgggaatagttgtttcaagtcaggcacaacgttctcaatttcaaaatagagcaactgcagaaaatatgttacgtgctaagttgtatcaattggagatggaagaaaaagaaaaacaacgtgctgctattcaaggggaacaattagatattggttggggttcccagattagatcatatgtctttcatccatactcaatggtcaaagatcatcgtacagattatgaaactggaaatattcaagcagtcatggatggagatttagatccatttatcaatgcttatttacaatggaagctgcaacaagctaatccacaataa

SEQ ID NO: 1293 - DNA, 1275 bp, Unknownn
  isolated from dental, unidentified
atgaagaaaaaactatttctaatatttggaccactagtattagcagcagtcttattggcagtagttttagtaacaccatttaactttaccaaaccagattctgaagaaattcatgaagcttctttgtcacaatcaaataatattttcaaaggaactgctgtaaaaaaagcagcctttgaacaaaattatgtacctttcatgggttcttcagaattatcccgtatggatgccttccatccagcatcaatggctttgagatatcatcgagattatcaaccatttttactgggagcagctggttcacaatcattaacacaattctggggaatgcaaggtgttaataatgaattaaaaaataaaaaagttgttttcattatttctccacaatggtttgttaagcaagggataaatcctgctgctttttctatgtactattcaaatttagaagctgttacttggttaagacaagcaaataattctaaaatggatagatatgctgcgcaaagattgttaaaaatacaaaaaaatcattcagattcttttttgaaagattgtattgaacaaattgctaatggtaaaaaactttcggctactcaaaaaacttatcttgatttgaaatataatcagttaactcatgaagatcaatttttctcaactctttctttaaaaaatagggttaagaaaattaagaaagctagtaagaaactaccagctaaagaagacaacgcagaacttgaatctttagcaactaagttaggtgagaaagcaactactaacaatgattttggtatttctaataagttttggaatcgagagctaaaagataagtataaacgtttaaaaggtgaacaaagtaactttgactacgtatcttcaccagaatttggagatttccaattggtattgaaccaattcgctgaaaataataatgatgttctctttataattccaccagttaatgaaaaatggtctagctatacaggattatcaaagagtatgcttcgtcaatttgataagaaggtcacttaccaattacgtgaacaaggatttaataatattcttgatttaagtaatgatggtggcaagccatactttatgcaagatactatccacttaggttggcatggttggttaaccgtggataaatcagttaaaccatttttagatggtaaagataaagttaataaaaataataattacaaaattaataactatttctacagtgatcaatggcaaaaagctgaaggtcaagaattaaacaatattattaaataa

SEQ ID NO: 1294 - DNA, 1206 bp, Unknownn
  isolated from dental, unidentified
atgaaagaagttttagttttaggtgctggctatgcgggcttaaaagcagttagaaatcttcaaaaagaagtaggagacaacgctcatattactttagttgatatgaatgactatcattatgaagctacagaattgcacgaagttgctgcaggttctgtagacaagaacaagattacatatccaattaaagatgttttgaataacaaggttaaatttattcaagatgaagtagttaaagtagatgctgataagaagactgttgaattgaagaattcaggtcaattacgctatgactactgtgtattagctttaggttttgtatctgaaacatttggcattaaaggtgctttagataatgctttacaaatgacagatattgaccaagctgttgctattcatgaacacatcgttgaaactatgaagaagtatcgtgaaacacaagacaaggaatacttgaacattgttgtttgtggtgctggtttcacaggtatcgaattagcaggtgctttagttgatgaacgtccaaaatatgctaaacttgcaggtgtagacgaatctgaaatttctatcacaattgttgaagctgcaactaagttattaccaatgtttagtgaaaatcttgcaaactacggtgtatcattagttaagagtttaggtgttaagatcatgacaggttgcatgattaaagaaatccaagatggtcgtgtaatgtacgcaacacaagataacgaagaacttcaagcagttccaggtaagacaattatttggacaactggtgttagtggtagtcccgttatgggtgaatctggtttcaaggaacgtcgtggtcgtgtaattgttaatgataacttacttgatccagatcatgatgatttatacatcattggtgacgtatctgctcttatggataaggcaacagatcgtccatacccaacaacagctcaaattgctacacgtatgggtgcttatgttggacatgcaattgctcaacgtttgaagggtgaagttccagaaccatttagttacaactccttaggtacagttgcttctgttggtaacacacatgcctttggtcttgtaggtaagaaagaatacaaagggttcccagcttcattcgtcaagaagatgattatgaacaaatcattagctgatattggtggggcaaaagaattatttgctaaaggtcgtttcgacttatatcactag

SEQ ID NO: 1295 - DNA, 1266 bp, Oribacterium sp.
  isolated from dental, Oribacterium sp.
atggaaggttttaaaaaatattataaaaaaagttggtctgaacggcttgagatacttaaaaaacaagaaattttatcacaggaagatattgatagattaaagtcacaagcaatagatgttagtctaggggaaactcaaattgagaattttataacacagtatttattaccagaaggattagctttaaattatgtgattaatggtaaagaatatttgattcctatggtaactgaagaaccttccgtgatagcagcaagtagccatggggcaggtattgtaaaaaagtcgggaggatttaaagcatctgtaaagcaaagattgatgttaggacaagtcattgttgaaaaaattgaagatgttgataaattcgaagatgatattttagaaaatgaagctgaattgttagaaatcgccaaccaagctcatccatctattgttagacgcggtggaggagcaagatggataagagtacgtaaattagataagagtattgtctcgatagatttagcagtagatgttcaagaagctatgggagctaacatgttaaatacaatgcttgaagcaattgcagctacgattagagagaagtacgaacaagatgtagttatgagtatcctatctaattatgcaactgaatgtctagcaacggctatatgtgatattccagttgcttcattgactaaaaatggaatgtcaggagaaaagattgctgagaaaattgcccaagcaagctatattgcacaaatcgatccgtatcgtgctacaacacataataagggaattatgaatggaattgatggagtagttatcgcaagtggtaatgattggcgcgcaattgaagctggagctcatgcatatgctgccaaagatggtaactatcgaggtttaagcacttggaaagttattggagacacattgcatggtgaaattactttaccactaccacttggatctgttgggggatcaatagggatcgttcctttagtaaaggttaaccataaattgttagaaatagagaatgcaattgaattagaaaaagttgttgcatcagtagggttaggtcaaaatttagctgcattatatgctttggtaacagaaggaattcaaaagggacatatgcgtctacagttgaaatcattggcaagttcaattggggcaactgaaaaagaaataccattggttgtatctaaattagaaaagttaaataagcgagatatgagtacagctaaagaaattttggataatttaagaaatgaggggaaataa

SEQ ID NO: 1296 - DNA, 480 bp, Unknownn
  isolated from dental, unidentified
atggcatatcgtacaccaccgtttatcacaccatttgcgattttatcggcggtattagctttaggtgcaactaacgtggcagttaacactgcgactggaacttctgaagggaagcctaaggtagaaagggtgtctacgtcaacagtttcttcaagttttagttcaaattcagaacaagataattctaagatgtcatcaagtcaaagtgatgacaagaaacatgatagtagttcatatgataatagtgaaaatgatcaaaatcaagatactaactctactactgatgatggcaatacaaatggcaataataaatcttattcaagttctactaaaaccactgataatacaactggtggaacaacgacaaataataataatactaacagtaatgatacaactactgatagtaataatacgacaggaaatacaacaactaacaataacacaactggcggaacaacaacgaataataatcagtaa

SEQ ID NO: 1297 - DNA, 699 bp, Actinomyces graevenitzii
  isolated from dental, Actinomyces graevenitzii
tcactaatggctaagaaaaaaagtaaaaagtatttagaagctgctaagcaagttgaagaaggcaagttatacaatgcttctgaagcatttggcttagtaaagaagattgattttgcaaactttgatgctacaatcgaagttgctttcaacttaaacgttgatacaaaacaagctgatcaacaattacgtggtgctatggttttaccaaatggtactggtaaagatcaaacagttgttgtatttgctaaaggtgcaaaagcacaagaagctaaggatgcaggtgcagacgttgttggtgacgacgacttagttgctcgtatccaagacggttggttggactttgatgttgctattgcaacaccagatatgatggcacaagttggtcgtttaggtcgtgtattgggacctaaaggcttaatgccaaaccctaagactggtacagttacaatggatgtaacaaaggctgttacagatgctaagtctggacaagttacataccgtacagaccgtgacggtaacgtacatgttccattgggtaaagtatcatttacagaagaagcacttgaaggtaacttcaaagctgtttatgatgtaattgctaaggctcgtcctgcatctgttaagggtgtttacatcaagcatgtttctgttgcttctacatttggaccaagtgttacattagatacaacagcactttaa

SEQ ID NO: 1298 - DNA, 2574 bp, Unknownn
  isolated from dental, unidentified
atgaaaaaagttaaggattttatcaaacaaaaatccacaattttacaattaatgtttgtagcttcagtattaatattagttttagtggaaattagtaaaattattagagatgttgactggaatcaggttagtgatggcttgcttagtcagtcaattttttcaattattatgatgctaattctaggaatgttttctgttactccaatgctgatttatgatatttcgataacttcttttttatcagaaaagtttaattggaaatatattttaaagagtggttggataacaaatactttcactaatattgcaggttttggggggatattaggagctacattaagggcgagtttttatggtaaaaaatctagtaaaaaacaggttttgtatgctatatctaagattgctctatttttattagcaggattatcaatatattgctgggtatcgttatttataatctttggtttacatataggttcagggttaactaaatattggatttggttagtcggtggaggtctgtattttccattgttatttagcattactaaattcaaaaacaatgccttctttggtgatcttacgttaaaaaaagaactatttttaataatgggttcttgtttggaatgggcaggtgcaggtctattcttcatatatattggattagttttaggggtaaaattcaatatacttgaaatatttgctttgtatattattgcgtccgtttttggggttatatcaatggttcctggtggattaggttcatttgatgtttttattatcttaggaatggaaagtataggcataggtaatgccgatgtaattgtatggttgctatttttccgtatattttactatattgtaccattttttgtaggtactgttttatttgtgcatactctaggtaataaagtgaatgagtacttcgatggtattccaagtgcattattacaaaaaacggctcatatattaattacaatttttatgtatgcatctggcataataatgttaatagaagcagctgttccaagttttgctttttctaactttattctggtcaagttatatccgttaacatttttattcttacatcaaatgacagatgtgatatttgctttcttgctaattgcaatgggtagaggctttgaatctagagttaaaaaatcattttggccaacgataatagttttaggaataggaattgttaatactttatggagggtttatactccaggtttagcatggtttttaatctttattatggcttgtgtgatcctctcaagaaaagaactttatcgagaacaattacgttattcatttggaaaaatgtttgtagatggtggaatatttacagtaacatttttgttgtatttgttagttggattcttgaattttagaccaataggacataaaagtatcccagtaccagaagttttaatttttcaaggacagcaaatatggttgtcaggttttatgggaatgattttagctggcataataatgttaataattataactagctttacatcagatactgatccgtttagaaagatgaatttcgataaaaagagaattaaaaaaattatagataattattctggcaatgaagttagtcatttagcctttttaagagataaaaatatttattattacagagttaatggtgaagatataatgtatttcatgtatcgcaggaaaaatgacaagttaatttttatgggagaacctgtgggaaatatggattatttaaaagatgccattaaggaactaatgacacaagcagattactatggctatgaattagttttctatgaaataaattctaaattaaccatgttgttacatgatttaggctttgactttataaagaatggtgaagaaggatatgtaactttgaaggacttttcactgtcaggtaagaaaaaacgtggtgagagggcattaatcaacaaattcgagcgtgaaggatatacttttgaaatgatagaacctccgttttctaaagagttgattcaagagttaaaacaagtttctgacagttggttagatggtcagttagagaagggcttttcattgggtttttttgatgaatattacctaaatcaagctaatataagtattattaaagatgctgataataaaatagttgcatttgcttcaatgatgcctatggatgataagactttatcaatagacttgatgagacatagtaagcaagctccttctggaataatggataaaattttcattaccttatttgagtacggtaaagaaaatggctatgaacgttttgatatgggaatggcaccattagctaatgtagggacttctcagtatagttttattgaagaaagagctgcacattttatttatgagtatggatattcattttatggtttccaaggcttaagagattacaaggataaatatgttagctattggttacctaagtatactgcttatagaaagagaagttcaattgtctctacaatgctagaagtaacaagcgttgttaatagtaagagaagagaacaatttagaagagagatttcactttcaagattctggtcataa

SEQ ID NO: 1299 - DNA, 597 bp, Unknownn
  isolated from dental, unidentified
atgcacaagagaaagaaggtaaataatatggctaagaaagtagcggtattaattgcagatggttgtgaagagatagaagcactaactcctgtcgatgttttacgtcgtgccggaattcaatgtgatatggtaggattagacagtttagacgtgatgggtgctcatcaaattgcattaaaatgcgataaagttttagatgattcattattagattatgatttagtaactttacctggaggaatgggtggagcaactagattaagagatagtgaaaagttacaagctttaatggttaagcgtgctggacaaggtaagtggaatgctgcaatgtgtgctgcaccaatggcactagctaagtatggattacttaaaggtcatgattatactatgttccctggtatgcaccaagaacatggcgatgcagagggtagattccatgaagacatggtagtggtcgatgaagcagctcgtttagtaactagtcgtgggccagcaacagctatgccatactcatttaagttagcagaagttttaggagtcgatacaagcgaacttcgtgaagcgatgctttataatttcttattagatcaaaaataa

SEQ ID NO: 1300 - DNA, 555 bp, Unknownn
  isolated from dental, unidentified
atgttaaaaatcaatgttcgtggtgaaaatattgaagttacaggagcaatccgtgaatacgttgaaaagagattagcaaaattagagaagttctttgataatactgctgattcaacggctcacgtaaacttaaaggtgtactcagacaagactgcaaaggtagaagtaacaattccattgccatatcttgttttgagagcagaagaaacctcacctgatatgtatgcaagtattgatcttgttacagataaacttgaacgccaaattagaaaatacaagactaaagtaaatcgtaagtctcgtgaaaaaggctttaagaattttgaatttgcacctgttgcagatgaaaaagaagaagtagaagataagaagtttgaaatcgttcgtactaagcgtctatctttgaaaccaatggacagcgaagaagctgtattacaaatggacatgttaggtcatgatttcttcatttatgaagatgcagaaaatggtggtataaatattgtatatcgtcgtcgcgatggccgttatggtttaattgaagctagtgaagactaa

SEQ ID NO: 1301 - DNA, 948 bp, Unknownn
  isolated from dental, unidentified
atggaagaaaaaaagttattagatttttcaataaatgaaaatatggatatttttgttttgattaaaagtgctgaagtaagagtggcgaaaaacgggaaaaagtttattgcctttaattttgctgataaatcaggtgaaataagtgctaaattctggaatgcaactgaaaaagaaatcgaagaatttaaagaaggaaaagttgtcagattaaaaggaaaaagagagaattatcaagataatccgcaaattaagatatttaatttaagaattgctacagaaaatgaacctaacaaacctgaatattatttacaaactgcaccagaatcaattaaaaaaattgaagaagaaattaataatacattttttgaaattactaatcctaaatggaatagaatagtgagatatttgctaaataaatatcatgatagtttcttttcatttcctgcggctaagaaaaatcatcatgctttttctggaggattagcatttcatacagtatctatgttgaggttagctaaagcgattgccaaggaatatgatgtattaaatgagtcattgttatatgcaggagttcttcttcatgacttggggaaagtaaaagagctatctggaccgatagcaactaaatatacactagaaggtaacatgatagggcacattgtaattgttgacgaagaaattgtaaaagcgtgtgagatattgcagatagattataatagcgaagaagtaattttgctaagacatatgatattatcacaccatggcttgttagaatatgggtcaccggtcagaccacatattatggaagctgaggtattacatcaaatcgatcaacttgatgcatcgattcaaatgatgaagagttcattaagtcatacggaatctggtgaattttctgaacgtatttttggccttgatggtcgtaatttctataaacctaaagaataa

SEQ ID NO: 1302 - DNA, 1500 bp, Unknownn
  isolated from dental, unidentified
ttgtttttaggaggaagaattttgaaatttggcgaattaggattagataaaagtttgttaaaggctgtaaagagaagtggttttgaagaagctactcctattcaagcagaaacgataccacttgttttagctggtaatgatgtaattggacaagcacagacaggtaccggtaaaactgcagcctttggtttgccagtattacaacaattagatttggatttgagacaaattcaagcagtaataatctcaccaactcgtgaattagcaattcaaacacaagaagaactttttcatttaggaaaagaaaaaagagctaaggtccaagttgtgtatggcggagctgacattagacgtcaaattaagcaacttgaacaacacacaccacatattttagtaggaacaccaggacgattacttgatcatattcaaagaggaacaattaacttggctcatgttaaacatttgattttagatgaagctgatgaaatgctagacatgggattcttggatgatattgaaaagattatccaagcagtaccagctgaacgtcaaactttattattctcagcaactatgcctaaagaaatcttgaagattggcgaaaaatttatggttaatccacaaattgtaaaaatcaaagctaaagagttaacaacagatttagttgatcaatattttgtaaaaacaaaagagtttgaaaaatttgatattatgactagattaattgatgttcaagctcctgaattaacaattgtttttggtagaactaaacgtcgtgttgatgaactttctcgtggtttagaagcacgtggttacaatgcagctggcattcatggtgatttgactcaacaacgtcgtatgaacgtattacgtaagtttaaaaatggagatttagatatcttagtagcaactgatgtcgcagcccgtggtttagacatctcaggagttactcatgtttacaactatgatattccacaagatcctgaaagttatgttcaccgtattggtagaactggtcgtgcgggacaccatggaacttccgtaacatttgttacacctaacgaaatggattacctacgtgttatcgagaaattaactaagaaacgcatggatccattgaagccaccaactcaagatgaagcatttattggacaagtttcaagtgctttagatgatattaaagatttaatagctgatacagatacagaacgctatgaagcacaagcacaagcactattggaacaatatgatgcagttgaagtagtagcagcctttttgaataatatgactaagaaggatgcttctgacgttcctgttaagattacaccagaaaaaccactacctcgccgtaaaaaaggtcgtcgtaacggaaattatcgtcgcggtaatgataactttaagcgtagtaaaagatttaataagcacgatagaaataatcgtgataataagcgcagaagtggcaaaaaaaatagatttactattagaacaaagaaagcttaa

SEQ ID NO: 1303 - DNA, 1257 bp, Unknownn
  isolated from dental, unidentified
atgaaagaaaacgtaaatttattagttgtaggttctggtggacgcgaacatgcaatttgtaaagcattattgaaaagcgagaaagttgctaaagtttactgtgcaccaggtaatccaggaatgacttttgatggcattgaagttgtagcaatagatgagttggacttcgatgcgttaaagggttttgtctacgataatgatatagaatggacttttgtaggtcctgaagatgctttagttgcaggaattgttgattcctttagagaagataatctaaagatttttggtccagacaaacgtgcagcacaattagaaggatcaaaaaattatgcgatggaatttatggataagtatcatattccaactgctaaatttaaaacctatactacctcagatgaagcaatcgcagggttgaaagaatttgacgaacctgtagttattaaagaagacggattagcagcaggtaaaggtgttgtaatagctcaatcctatcaagaagctgaagatgaaattcgattgatgtttagaaaaggtcagaaaaaagtagtacttgaagaattcttggttggaaatgaatactctatgttcttagtattaagtgataagggctatcgaattttaccaatggctcaagatcataaaagagcatacgataatgatgaaggtcccaatacaggtggtatgggtgcatatagtcctttaccacagttatctgatgcagaataccaagcaatgattacagatattgtagaaccaacagtgaagggactagaagctggggattatcattatcatggaattttgtatataggtatgataatgacaaaggaaggtcctaaagttattgaatataatgttcgtttaggagatccagaaactcaagtagtcttaccccgtgtagaaagtgattttgctgagttgatagatgtagctattaatgataaacaattgccagaattgagaatttcagacaaagcatacttaaatgtagtagttgcaggagcaggctatcctaagcaagcagtgaaaggacaagctttacctaagttggaaagtcaaaaagatatatacaccatttatgcaaatgttaagattgaagatgaggttgtatatggtaatggtggtagaattttatcaatcgtaggtgaggcatctacaattgaagaagcacataaattagtttacaagtatttggaaaactacaagtggaatgactgtttctatcgtcatgatataggtgtaaaagcttttaaataa

SEQ ID NO: 1304 - DNA, 1032 bp, Unknownn
  isolated from dental, unidentified
atggataaaaaagataatataattttagcttttgaatctagttgtgatgagacaagtgtagcagtagtaaaaaatggaaatgaaatcttgtcaaatatagttgcaactcaagtggctagtcatcaaagatttggtggggttgttccagaagttgcttcaagacatcacattgaacagataacatattgcatacaagatgctcttgatgaagctaatgtgaattatgaggacttggatgcagtagcagtgacttatggtccagggttagtgggggctttattagtaggtgtagctgctgctaaagccattgcatttgcacataatttaccattaattccagtaaatcatatggctggacatatctatgctgcaagatttataggagagataaaatttccggctttagctttattagtatcaggaggacatacggaattagtatatatgcctgaggaaaataaattccaaataattggcgaaactcgtgacgatgcagccggggaagcttttgataaagtaggtagagtaatgggaatgaagtatccgtctggtaaggaaattgatgaattggctaaaactggggaagatacttttaattttccaagagcgatggagaaagaagataactttgattttagtttcagtggtttgaagagtgcgtttattaatactgtacatcatgctagtcaaattggagaaaagcttgataaagcagatttagctacaagtttcgaacaaagcgtagttgatgtattaagtagtaaaactgtcaaagcattgaaacattttaaggtaaaacaattgattcttgctggaggcgtagctgctaatcaaggattaagaataaggttagataaggaattaacagcatttaaagatgtagaattgttgaaagcacctttgaaattatgtggtgataatgcagcaatgataggtgctgctggatatgtggcttttaagcatggtactcgagctgacatgacattgaatgctgaaccaagtctagaatttgaatggatgttagaaaaataa

SEQ ID NO: 1305 - DNA, 1356 bp, Unknownn; identical to SEQ ID NO: 428
  isolated from dental, unidentified

SEQ ID NO: 1306 - DNA, 747 bp, Unknownn
  isolated from dental, unidentified
atgatagaaagtggggagaaaatggctgaattagtctataaaaatattatcagtgatttaaaagaaaaaatatttgctggtaagtttactgatatgaaactaccagatgaacgttcattagctgaacaatacaatgttagtcgtagttcggtcaaacgtgctcttaacaaaatgtccaatgagggtattatttttaaaaagcgtggatcaggtacctttattaatcccttgtacttaaaaaatgaatctatttttaattatgaggaaggatctaacttaggaatttctgataatttcagattaaaaggaaagaaacctcaaaccaaaattttagattttcaagtaatcaaaccaacttcagagttacaaagagatttattcttatcccctgaagattttgtgtataaaattatccgtcttcgtctttttgaagatgaaccttttatgattgaaacaggatatattcctattaaaatcttacctaagctcagtcgcactcagcttgaaagttcaattttttcttacattcaatctgaacttaaccaaactgctagcaaatcattcatgtcaatttatgctgagccttcaactttagaagatcaaaatttactcaagcttaaagaaaatgaacctgtcagtgtgatggagggtatcttctttttagacaacggtactccatttgaattttcacaaatgcgactacattttaaataccttaaatttaatacttttatcaacctagattaa

SEQ ID NO: 1307 - DNA, 882 bp, Unknownn
  isolated from dental, unidentified
atgccttttgtgaaacagccagtaaagattggttcaacctacatgactctcaataataacttttataaaaccattaatgaggaagtaaaaaaacaagttagccaaaatggtgacatcttatacactcgtgatccgggcttaagtgtttctaaacaatgccaacagatttatgactttattgacaaaaaggtagacgtcatcttaatcaatcctgtgaatggtgaaagtaaacaaatccaacatgctttaaaaattgcccatgataaaggtataaaaattgtcgttgtagacagtcagttgagcaattcttcttttgttaatgccaatgttgtttctgataattttaaagctggcgtattagatgcaaagtatatgatgaaaaattctccccaggctaaaattttagttctgcgtcattggaatgctttgtctgtaaaagaacgatatcgaggctttgttagcgaaattaaagataaccctaactatcagattacagaaaatcttgaaactctgggtcagactgatgttgctttaaaaaatgtacaagaactgctaaaagtcgatcctgataaatttgacattattatggcaatggatgatcaaagtgctgttggggcattagccgctatggacgccctaaatcttcacaacaaaattatggtatatggaatcgatggttcaactaatatgaagcatctactactaagtaatcctaatgcacaggcaacagtagcccaatctcctattaaattaggccagaaatcgatccaagtctgctataagcttgtcaaaggaaaaaaagtttccaaagatgttgttgtaccagtcttcttactgaccaagaaaaatatcaatgattatgatgtatcggggtggcaatga

SEQ ID NO: 1308 - DNA, 804 bp, Unknownn
  isolated from dental, unidentified
ttggaagatcaaggaatgaaaatcagcgttttagcaagcggaagtactggtaatgctacatatattgaaacacctaagagtaaagtactagtagatgcaggtttatctgggaaaaagatcgaagaattgatgaattcaattggtagaactttgaaggatgtagatagcttattagtaacgcatgaacatagcgatcatatcaagggtgtaggtgttttggccagaagatatggcatgaatatttacgctaatcaaggaacttgggacgcaatgagtgcgaaaattggcaaagttcctttggagcaaaagcatatttttgatatggggaagactttgagtattggcgatgttgatattgaaagttttggtgtatcacacgatgccgctgaacctcaattttatgagttacatcacggaaaatcttcatttgcgattgttacagatactggctatgtcccagatagtgtagctggtgtgattaataatgctgaagcttatctatttgaatgtaatcatgatacagaaatgttacggatgggaccatactcctggtcattgaaacaaagaattatgagtgatacagggcacttgtcgaatgatgatggggctgcagctttgatggatgttttgggaaataatactaagaaaatattcttgggacatctaagtcaggaaaataatgttaaggcattagcgcatgtcacagtagaagatatcatgaaagaacacgatttagcggttggtcatgactttgaaatttgtgatacagatcctaaacaagccactccattaatccaattataa

SEQ ID NO: 1309 - DNA, 2136 bp, Unknownn
  isolated from dental, unidentified
atgttcaagaacaaatttttcataaaaaagctaaatggtataaaacacagaggtatgaatagaatgaagaaaaaattattcattacgattttatcaatgttagttttgataatttcgtggtgtacacaagttaatgcagatgacatgaagagttatacgcaaccatttcaaaattcaacacaaactctttcaggaaaatctgtatcagataatacatattttacaaaaattgattactgggatgttaagaaagcaactttaaacttgagttaccaagtttcacaaattgctgatgatcaaacatctgacattacagtatcaattaatggggttaaattttactcatttagacctgaaataaaagatggtgttcaaactaagcaaattgatattcctctaaacttaattaaaggggcaaataatcttaaaatttacggacaaattttaaataagtccgacaaatcaacggttagtgtacagacacctgctaattggttaacaatttatgaagagtcaaatgttaacttccaatataatttaaagcaaccagattattatttgaagtctttctataatcatttttcaggggcagatactatttcatttggacaatctgttattgcagttcctcaacaacctagtgatgctgaattgtcagctgcaacttatgctttaacaggggtaaatagaacaatcgcaacagatacagacaaagttagaattttaccatacaatgatggtagaattaaggatgcagattaccgtgttattatcgctaaatatgataatttacctaagaattataagagtaaattctcagtagataaattgaaaaatcgtggttgtttaagattagtgtatagtaagaataaatatacattgataataacagctttagatgatgaaatgttgcaaaaagcaactcgttttatggctaatacagaattaatgacagaaactaaaaagccagttaagtatgtaagctctaagactgcaacttatatgtcaagcttacattacgatggcagttaccaattgactaatcaaggagcaactttaactggaagtggacatcacgaagaaacattctttgttgctttaccagctagtcaaagcaactcctatggtagtaaggtaaaattgagtttgaagtattcaaagaacttgaattttaataactctttagcaactgtatatatcaataaccgcaacattggtagctataagttaactaaagataatgctgataatgatgaactaaccttcaatattcctaataatatgaaaataggtagtggtttttctgtcagagtagcttttgatttagaaccaagtcaaattactaagtcagataatagtgaaacaccttgggcagcaatcaatactaactcaaagatttttgttaagtctattgaaaaaaacgacatcctattttcaaattatccaagtttattcattagaaacaatacttatagtaacttagcagttgttaaacctagaaagatgacaacaaatgattttgaagcattatctaatattttcaatttgattggtatctatgctaagagcaatactggaaaaattgaattctatagtcaacaacctgatgatgaaacattaaagaacagcaatgtaatcgtattgggaacacctagtcaaaattctatgattaagaacttaaatgacaaactttatttccaatacaataagaaatatacaagttttatttctaatgaaaaattgagtatcgaatatgattacggtaagacaatgggtacagctcaattattgcgctcgccttacaatgataagagaggtatgttagttgtaacaggtattacatctaaagacgtttatctagcatcaacacaaattaattatcaaaagaccattgttgaacatggtggcgatgcaattgtggtggataatgataataatatttataattatcgtttcaagaagaaagctgatttagataaaaaggtatctttgaagcaaacaattcacaaaaataccaagttgatcatttacttagtaattgctttaatctttgttgctttgctagctgcagcaatctttatggttctatggaaaaataatctgttaagaaaggataaaaataatgagaagaaatga

SEQ ID NO: 1310 - DNA, 1662 bp, Unknownn
  isolated from dental, unidentified
gataagaatgtttttattatagacgatgcttcttatatttctgatgaagaaagtaataagggaaacttacactttggttctggaaaactattaacggacttattgacttctactcaaatttttgaaaaaggtaatgtcaaaataatatttattggcgatgaatatcgattattaccaattagagatactagtgctaaggctttaaagcaaacttattttgaagagttaggcttaaatactatgaaatacgaattgaaaactcagtatcgtatgcatggggaactagctagaggtatagataaatatgccgaattgattactagtgtagaaaatcatcaaaaaataataccttatgaatttaaaaatactggtaatgttagaaatattgatgaagctgattggagtaaggaagaaaagaaacaaaagattgctgggcaatttaatcgtgacaataagagaaataaggtagtagtaacttattcaactagggcagcccaagaatataataaattgatccgtagaaaacttcaaaatatggaagatgcgccaattagtagtggcgatttagtagtcttttctaaaaaccaatatgatttacttgtaatggatgctgcaggtaatgagtttaatgaggactttttcactggagatattgcggaaataatcgcaacctatgatcgaaagtcaagtaatgtaagagttaataaccaagatgtaactttgtcttatgcaaaggttaaatatcgtttggaacgaacaggaaaagagtatgtgagctacttattagaaaatgttctaaattcagacgattctcaactttcatcagatgagaggacagcactgttttacgatgctgaagaacgtataggaattacagaaactccagaagaacatcgccgccatattaaaagtaataatgaatactgggaagcagccgtaaagaaattagccaatattggagaaagtggattatctgtatcagataaggataggataagagaacttttgagaaagcatccgatttgtgatcctaaaaatgaatgtgaaaggtatcaactattagacaagatttatcaggataaattttataatagcattcaagtgaaatatgcttatgcgatgactggtcacaaagttcaaggaaatgaatggaacgatgtatatgtagattttactgacagaaatggattagatgaatctagtttacgctggacttatacagctttatcaagagcgataaagaatgtattagtatttaacgcaaccagcttatttggtaactttgatatctcaaatgaatttattggtaaaaagaagaatcttgaaaaagaaagagaaatggcaactaagattgaagagtatcaatttaatgatgaaaagattgctcgcttagtagataaggtggaagaaatttctgaaaataatggtttagttgttactaatatcgatgatagaaattttgaaaaacaatattttgttttgatttatctaagtgatgttgaaaataataactatgttatgcaagcatattacaatagtcggaaattttggactaaagcaacacttcgtagcaaggtagaaatagcagagaaattagagtcgattggaacagaatttagaaagataaatccaaattttagaggaagtgcggacaatgaatga

SEQ ID NO: 1311 - DNA, 849 bp, Selenomonas sputigena
  isolated from dental, Selenomonas sputigena
atgagtttgacagatggaaatataattgaaattgataatttatctttcaaatatgctcgacaaaataaatacattctaaaaaatttaactttaaatataaaggacggtcaatggatagctttaattgggcataatggtagtgggaaatccacattagctcgactaatagatggactgctaaaggctgaatctggcagtataaaagttgatggctatgaaatgaatgaaaaaaatatttgggatattagaaaaaaaataggaatggtattccaaaatcccgataatcagtttgttggcgcggatgttgaaagtgatatagcgtttggtttggaaaatcaaggagtacctagagaagaaatggtatcgcgtgtatccgatgctttgaaagttgtcggaatggagaaatttgctacacatgaaccggcaagattatctggtggacaaaagcaaagagtagcaattgctggagtattagcattgagacctaaaataattatccttgatgaagctacaagtatgcttgatccagaaggaagaaaaggtttgattactcttatcaaagatttaaaagatgagtataagttcactgttatttctattacgcatgatattgatgaagctactttagcagatagagttattgttctcgatgacggtaaaataattgatgatggtaagccagaatctatttttataaagaatgatgaattattaaatattggattagatattccttttgctgagaaaattagaagagaacttacaaaaaagggtgtagatattccaaataaatattttacagaagaggaaatggtcgattggttatgtcaattcaagcaaaaaaattaa

SEQ ID NO: 1312 - DNA, 762 bp, Unknownn
  isolated from dental, unidentified
atggaaatggaaaaaataaatgaaaatactattcgtgtagtattagatgatgaagatttaacagctcggggaataaaattcttggatctgctaggaaaccagaaagagattgagagtttcttttatgaaattttagatgaagtagatgttgaacatgagtttagggaaaatgatgcagtaacatttcaattagtacctaataaagaaagtggtctagagatatttatcactaaagtaaatcctgatgatatcacagatcaagatggagaaaaagaaactaaaaatgagaatgaaactgtagaagacacagaggatgtaaaaaaggatatagattcctctagtgatgagttgttgaatttaattaaaaatagtatcgaaaattcacggaatattgctgaaaatagagattatagtcgtagatctaaaatagatgatgacgaggttattcagtatttaaatgacgatacaaaaaagaaatatgtgtttgtagtagaattttcaacatttgaagattttgttcaattagcgcatgttttaagaattgaaggtggagtttctaacctgtattcttaccaagaaaaatactatcttgaattggtattgtttgatgataactattctgaagaatctgcaaaggatttaatttcactctcttttgaatatggaaagaattctaagatttctccggttcttttaaaagaaagaggaaaattagtgatggggcagacagcgttagagttagctcggtattattttaaataa

SEQ ID NO: 1313 - DNA, 468 bp, Unknownn
  isolated from dental, unidentified
atggcaaaaatttatcttgcggctccatttttcagtgacggccaacacgaacgtatcaatcaagtaaaagaagctcttgaaactaataagactgtatctagtatttttgtacctgaagaacattcatatgaacatgctgaatttgggtcactagaatggcaaaaagctacttttactcttgatatcaataatatttacactgctgatgctgtagttgcaattattgattataagaaagaagagagtgacaacgaagctgattctggtacagcttttgaaattggccttgcttttggtactaatacacctgtcattgtagttcaattcgatgctgaaaaggaattgaatctcatgatttctcaagctcttacagcttactttgacgcaagcaaaggtgaattatctgatttagcaaattatgatttcaatgaattaatgcctaaattggctaatcgtccagttatctaa

SEQ ID NO: 1314 - DNA, 897 bp, Unknownn
  isolated from dental, unidentified
atgacttatcaaaacgaaaaaattagtcttaaagatttaatttttattactatcggttgttctttatacgcttttggcttagttactgtaaatattgccaataaccttgctgaaggtggagcaacaggtattaccttaattattagatattggctacatatcgatcctgcatattcaattattttacttaatattcctttaatttggattggttatcgttatctaggaaagaaagctttaatatatactatctacggaactactatgttatcaatttggacttggctttggcaaaggattcctattgatatcaatattcatcacgacttgttccttgctggtgttttagctggtttaattggtggtactggttctggattggtttatcgttttggaggaactactggtggtaccgatatagttgctcggatttttgaaaagaaacgtggcattgttatgggaaaaacattacttgccttagatgttatcgttttaacttgttctttaagttatctagacttacgccaaatgatgtacactttacttggttcatacgtttttgcccaagttgttaacttcattcaagaaggtgcctatgctgcacgaggggttattattataactaatcatccaacagagattgctaatgatataattcagaaaatggaacgtggtgtcagctatcttaaaattgaaggtgctttttctggacaagaacgaaaagcattatactgtgtcgttagtcctaatgaactaaatacattaaaaggatacatcaatcatcatgatagtgaggcatttgtctctatttttgaagtttctgaggcaatgggcgacggatttagttttaatgccccaagtcgttcactattgaagtacattaaaaagggaggataa

SEQ ID NO: 1315 - DNA, 993 bp, Unknownn
  isolated from dental, unidentified
atggaggaaagtagaatggaaatgcttaaagtacatggttctggtaatgattttttcattcttgatgaagataatcttgaagagcctttaacagaagaagaacttattcaattagcacaaaaggtttgtgatcgcgatacaggattacatggtggtgctgacggtgtcttatatgtccaagctggtcatgaaggcacagatggcagaatgcgtgttataaatgctgatggtagtgaagcaagtatgtgtggaaatggtattagaactgttgctcgctacttaagcgaaaagaaaaatttagcagaatttaaaattcaaacgatgcatgctgatcttgaagtgaagaaagctgataaactagcagaaaaggttccagcatttgatgcagaaatttcaccagttagttttgatgcacaagatttactaatgcatgtaggcaaagaaaaattaattgatgattatattccagagttatcagaaacaattaaattttctgcagtagcagttcctaatccacatttgattgcatttgttgatcatgaaacattgatgggtgaagaattaggaagaattgctagttatttaaataacggaaataatccaattttccctgatggtgtaaatgtaagttttgttgaaattctagaaccaggcaagatctttgttcgtacatttgaacgtggggtaggttttacaaatgcgtgtggtacagcgatgtcagcttcaagtttgatgtatgtcctactacattctgaccaaattgactttgaaaagttgattacagttattaatcctggtggtatggtaagaacaatggttcataaacgcgaaaatggtgactattggatgtcattgattggtaatgcgacagaagtggctaaggttaatatttctcaagcagatgcaatcaatggtaactttgataatttcacatggaatgaaactggtgagcaagcagcttatgaggcatttattgctcaacttcacagatag

SEQ ID NO: 1316 - DNA, 1020 bp, Unknownn
  isolated from dental, unidentified
gtgattagattggatttaattattccaaaggattatgatcctaaattatcaatccgcgaaacccaagaagcaattcgttatattcgcgaaacattccaagatgaatttggcaaggaaatgggcttaaatcgtgtttcagctccaatgtatgtcgaaaagagttcagggattaatgataatttgaatgggtatgaaaaaccagtatcttttactatgaaagatatgcctggcgaaaccatcgaagttgtccattctttggctaaatggaaacgtatggccttgaagaaatatggcttcggcttacatgaaggtttatatactaatatgaacgctattcgcaaggatgaagatttggataatttccattctagttatgttgatcaatgggattgggaaaaagtcatttccaaagatgaacgcaatgaaaaaacattaaaagaaacagttgaattaatctttaaagttgtcaagcatatggaacacgaagtatggtacaaattccctaatgctgtttaccatttgcctgataagattcattttataacttcacaagaattggaagacaaatatccagagttagaagatgctaaagatcgtgaaaatgccatctgtaaagaactaggttgtgtctttgtgatgcaaattggtgatgttctaaagagtggtaagcgtcatgatggtagagctcctgactatgatgattggaaattaaatggtgacatcttattctggtatgaaccattacaatgtgctttagaattatcaagtatgggtattcgtgttgatgaagattctatggtggaacagttgaagaagacaggcgatgaagatcgtttgaaattacaatatcataagatgattttgaacaaagaattaccatacacaattggtggaggaattggacaatctcgcttatgtatgttacttctaggtaaagcacatgttggggaagtacaagcaagtatttggccagatgaaatgcttaaaaaatgtgaagaaaatggtattcatattttgtag

SEQ ID NO: 1317 - DNA, 1308 bp, Unknownn
  isolated from dental, unidentified
atgattaatcaggcaaacacagcttttgttctcatttcgacaatattggtattttttatgacccccggtttggcatttttctatggaggattggtttctaaaaagaatgttgttaataccatgttttctgtttttgttattagtggtttagcgattctactctttgtttctgtaggttatgtaatttgttttggtaaagatgtatctgggatatttggttggggacatagtttctttctaagtagatatgaattaacgaagatgtattctaaaagtttaggtattgataatggtacatatctagtatttcaaatgatgttttcgattattaccccagcactttttgttggagctgttgttgggaggatgagatttaactttttgatcttgtttgtatcattatggtcaatttttgtatattatccaatggtacatatggtttggagtcctgatggtttattagggaaaattgggatgctagattttgctggtggaacagttgtacatattaatgcaggtataactgcattggtgctatctatatttttaggacctagaattaaatataatattgaaaacagcgaacactacaatttaccttgggtattacttggaacaagtatactttggatagggtggtatggttttaatgttggttcagctttaggaatagataaagtggcaattcaagctttcttaacaactacggtttccactggtgcttccttaatagcgtggatgatattggatcttaaatttcattccaaaccatcgttagtggggatttgtacaggagcattatgtggtttagttgggataactccggcagcagcatatgtttcaactttaggagcaatcataataggagttttgtgtagtattgtaagttttatttttgtagaaaaaataaagcccaaactaaaatatgatgatcctctagatgcttttggatgtcatggaatttcggggattttaggttcgattttaacaggcgtgtttgcaaataaagcaataaactcaaacatttctgagagtggattattatatggtggggtgcacttgtttttaattcaagttttaggaactgtttgtacaattatttttgtaatcattttatctacgattttagtagtttgttgtaaaaaattagttaaaatgagagttacaagtgaagaagaattgattggtttagataaagttgaacataatgaaaaagtagattcttatgtgaagagcgatgcctctgatgttagaaaatatcgtgctgaatttagaggacaactatctaagtttgaaaaaagaagataa

SEQ ID NO: 1318 - DNA, 1260 bp, Unknownn
  isolated from dental, unidentified
gtgatacctgttattattgccggtttagaaaatgactatgaaaatttcgaatataaaatggatgaactttcatctttagcctacgctaataatatggaagttatcgtttctgtaaagcaaaaattagaacatccaattgctgctacttactttggtaaaggaaaggctgaggaaattcgtcatgtgggagaaattaatgatattgacactttaattgtaaatgcagagctaacccctactcagttacgtaacctcgaagatattaccgggcttcaagttattgatagaacagccttaattctagagatatttgcttctcgagctcaaacaaaagaagctaaacttcaagttcaaatcgcaaaattacaatatcaattacctagattaagaacttctagtatcaaccgtatggaccaacaaactgctggtaatactggcggtggttataccaaccgtggttccggagaaacaaaattagaacttaataaacgtgttattgaaaaaaggattagcaatctttccaaagaactcaaagaaatagagagcgtgcatgaaaatcaacgtcgtgcaagagaacgttctagcattaaaactgttgctctagttggttatacaaatgccggaaaatcaactactatgaatggactattaaaactactggaacaacctactaataaggaagtttttgaaaaagacatgctttttgctactcttgacacttctattagaaaaattaaattacccgataacaaggaatttttcttaagtgatactgttggtttcgtttctgacttgcctcatcaattggttaaagcattccgtactaccctttccgaagctaatcaagctgacttattgattcaagttattgatggtagtgatgaacacgcaaaagatatgattgaaacaactaaacaaaccctggatgaaatcggagttaaagatatccctatgatatatgcctataacaaatccgatttaacaagtacaccttacccaagttctgttggtaatcaattttactatagcgctaaagataaaaagtctattgaaatgttaatcaacttaatcaaagaaaatttatttcaggactatgttactcatacttacttaattccattttctgagggacgctacttagaaacaattaacaagcaagcaaatattttaaaaactgactatcttgctgagggtactaaaataacagctgaatcaacgcctattatggcacaaaaacttaagcaattcattatagactaa

SEQ ID NO: 1319 - DNA, 753 bp, Unknownn
  isolated from dental, unidentified
atgaagatagatattttaagtttatttccagaaatgtttggccctttgacagaatcaattgttggtaaggcagtagaaaaagatattttagacatagaagtaacaaattttagggattttactactaataaacaaaatcatgtagatgattatccatacggtggaggagctggaatgctgttgcaagcacagccaatctacgatgctttagataatattgaagagaaaaatggtaacttaggtagagttattttacttgatccagctggaagaaaatttgatcagagtgttgctgaagagctatctaaagaagatcatttaacttttatatgtgggcattatgaaggatatgatgagagaatacgagcaaaggttacagatgaaatttcattaggtgattttgtccttactggtggcgaactcggtgcaatggtagttattgatgctaccgtaagattgttaccagatgtcttgggaaacaatgaatcggcttcaggtgattctttttcaatgggattgttggaatatcctcaatatacaagaccatctaattttagaggaatggaagtcccagaagttttattgagtgggaatcatcaaaagattgctgaatggagaaaaaaagaatctttaagaagaacttatcaaagaaggccggatttgctggaagattatgaattttctgataaggaaaaagaatggttaagagaatttgaacgggataaggatgtgaaaattcatggaaaaggctaa

SEQ ID NO: 1320 - DNA, 1371 bp, Selenomonas sputigena
  isolated from dental, Selenomonas sputigena
gtggcaagaaatatcgctgatacaattaatcctaaaacaagattagctgtatcaataattttattactttcaacgtttattagtttgatgagtcaaacgatgatggttacagcattaccagtaattcaaaatcaaatgaatcagtcattaacaacagttcaatggttaacaactggatatacattgctgatagggattgtgactccattatcatcaaatatgtatgataaattttcaaatcgtagtgtttttttgggaacgataggaacttttgtcattgggacattaataggatgtttggcaactaatttttggttattactattggcacgtttagttcaagcttgtgccggtgggattttaatgtcttttcagatgacaacaatgatttcaatttatcctcctgaaaaaagaggaacaattattggaatgtctggattggtaattgcttttggcccagcaattggtcctactttagcaggatttattttaaacttactaggttggagatatttatttattttaatcctaccaatcatggaattaatttggataataggatactttgtttttccaaattactctgaacctctggacattaagattgattacttatctgtagttttatctttacttggttcaagtttagctttaataggaataactattgttcaaacacagtggatgctaggattagcaatgttggtagtaggtgcaattattttatacttttttgtaaagagacagctgaatttaaaacaacctatgcttaatgttagaataatcaaactatactcttttagaatgatggttctagtgggaatctgtgcatttatggtattgctaggtatggaacaaatggtatcaatttatgcacaaaatgtcagtcatgtaagcagtatgactgctggtatgattcttttaccaggtgcaatagctaatgcactaacagcttctatcgttggacgagcatatgaccaatatggagcaaaatggttggtaatttcaggtggaattttgatgttaatttcagcaattccatttgttattatatctaaagatacaccaatatggataatgacagtcttctatatgattcgtatggtgggaaatgccttagtattctcaccagctatttctgagtcattcagaggagtagcaccacgtgaaatcagtcatgcaacagcactgaataatactttgcgtcaagtatcaggtgctgtttcagttacaatgttgattgttattagttcaattccacattcctttgttttaggtatgagaatttccatgtgggtaacagttgttttagtcttactaatgttggcggtatttatatcttatataaaaaatcgtaatagtcgtagataa

SEQ ID NO: 1321 - DNA, 1791 bp, Unknownn
  isolated from dental, unidentified
atgcaagaagcaaagaagaaaacttcacttaaagcgaaggttcaaaagttaggtacatcgctatctagtatggttatgccaaacattgctgctattattgcttggggtttaatcacagcgatttttatggaacaaggttggttccctaatgcacatatcgctaaattgattactccaatgttaacttatttattgccattattaataggttatgttggtggacgtatggtgtacgaagaacgcggggctgttgttggtgccatcgctacaatgggggtagttgtaggtgctaaggttccaatgttcttaggggctatgatcatgggacctcttggtggttggtgcattaagaaatttgaccaattattccaagataagatcagatcaggttttgaaatgatttataacaacttctctagtggtatcttgggaatgttgttagctattttaggaacttatgtagttaacccattagttgttgcaggtagcaacttcatgagtaaaggtgttgacttcatcatctctattcacatgttgccattagctaatatctttattgaaccagctaaggtattgttcttaaacaacgctattggtaatggtatcttggttccattaggtattcaacaagcatcaactgctggtaaatcagtattgttcttacttgaatctaacccaggtccaggtcttggtattttgttagcattcatgttctttggaaaaggatctgctaaaggttctgcaccaggtgctgcaattattcacttctttggtggtattcatgaaatttactttccatacattttgatgaaaccagcattgattttagctgcaattgccggtggtgtatcaggtacatttacattccaacttttaggagctggtttgaaagctgctgcatctcctggttcaattattgctattctgttaatgactcctaagggatcatatctagctgtattatcaggtgtgttcgtagctgcagtagtatcattcttggttgcttctgttatcttgaaacatgataagtcaactggcgacgatttagcagaaaaacaagctgaaatggaagctatgaaagctgaatctaaaggtaaagaaatgccatcaagtcaagcagcacaagattctgttgatagttacgcagatgttaagaagattatctttgcatgtgatgccggaatgggttcatctgcaatgggtgcttctttattacgtgacaaggttaagaaggctggtatcaaagatatttctgttacaaacacagctgtgaaccgtctaaaagatgaacaaggattattagttgttacacaagaagaattagctgaacgtgcattacaaagaacaccaagcgcaatgcatgtatctgtagataacttcttgagcagtccaaaatacgatgaaattgttgcaaacttaaaggctctatctcaaattcaagataaaccacaagcaacagaaaatacagtaaaaactgcagaagcaggcgacttaggtaatgtagactttactaaggttgaagaagtaaacttcattcgtcatgaccaacacattggtacagtaacaatggctacaagcttgttcagtgatagcatgaagaaagctaacaagcaaacaccaattaaagctgtaagaatcaacgaacttgaagattctgataagcacttagtaatcgtaacagcagctgctaagaagaatttggcagttcgttacacagacattcaaactgtagttgtagatgatttattaacagacaagaagttacaagatgttgtagctaaattgaaataa

SEQ ID NO: 1322 - DNA, 1368 bp, Unknownn
  isolated from dental, unidentified
atgtctaagaaaacacatcttgctcgtaaaatggaaactcgtcacatccggatgatttctttaggtggagttattggaactggattatttttaagttcgggttacaccatccatcaagccgggccaattggtactatcattgcctacttaattggagctttaattgtttactcggtgatgttatgtcttggcgaactgtcagtagcaatgccttatactggtgctttccatgtttatgccaaaaagtatatcggcgaaggtactggctttactgtcgcaatcttatattggttaacctggacgattgctctgggctcagaatttacagctgctggactcatcatgcaagaatggtttcctcatactcccgtttggatttggagtgctatttttattatattaatatttctttccaatgcctattcagttaaagttttcgctgaaagtgaattttggttctctgcaattaaggttttttcaattgtagcctttatcttactcggtgtcctagcaatggttggaattattcctttaaatggtttcacccacgctcctggcatcagcaatctatataaaaacggtatttttcctaatggatttagtggcgtttttacaactatgttaactgtcaattttgctttttctggtactgaactaattgccattacagctggcgaagcaaaggaacctgataaaactattcctaaggctattcacacaactctttggagattggttatatttttcattggaagtattgttattatggccgctcttatcccttaccaaaaagctggagttacgcaaagtccatttgtttatgttttaaaaatgatgggtattccttatgccgctgatattatgaattttgtcgttctaactgccattatttctgcagctaattctggattatatgcatcaactcgtatgctctggtcattaggaaatgaaggaacaatccctaagaatatctcaaaaactaataaaaacggtatccctgtcatcgcactatgtttgagtatgcttggtggactgttagcactgctttcaagtatttttgcagcagatactatctacctagtcttggtttctgtttctggattagccgttgtaattgtttggacagctattgccttagcggaactcaatttccgaaaacaatttttaaaatccggacattctttatctgagttaaaatacaagacaccttggtatcctgttattccactgttcgctttaattaccagcattttatcttgtgtgttaatttggttcgatcctaatcaacgtgtcgctttatactgcacaattccttttgttttaacctgttatttagtacactatgtgtatagaaagtgtgcaaattaa

SEQ ID NO: 1323 - DNA, 1176 bp, Unknownn
  isolated from dental, unidentified
atggtagatttaacaaaatatatgaagaaagaattagaattagttaagccatctgaaattttggcatttgctcaatatagtagtaaaattccggatattacaaaatttacagtaggggaaccagactttaatacaccagagcatattaaagaagctgctattgcaggggttaaagccaaccattctcactatgctccttcaaatggaacacttggtttaagaaaagctgcagctaatttcttaaaagaaagatatggattggaatataatccggaaaatgaagtgattgtaacaaatggtgcaactgaagctatttatacagctttaacttcagtattgaatcctggggacaaagttgtagtaccaactccaattttcccattatatattgcagatgctttattagtaggtgcagaaccaattcttgttgatacatctaagaatggatttaaattatcagctgacatgttaaaaggagtgttagatgaacatggcgatgatgtcagagtagtagtcttaaattatccttctaatccaactggtgttacatatagtcaaaaagaattggatgaactagcggatgttatacgtgataaaccaatttttgctttgtgcgatgaaatatatagcgaattatgttatgaccaggaacatgcttcactagctaaaagtttacgtgaacaagcaattgtattgaatggtgtatcaaagtcacatgcaatgacagggtatcgaattggtattatgactgcacctgcagagataacaaaagaattatctaagattcatcaatttacaattactacaacaactgcgattgctcaagatgcagcccaagaagcctttgaaaatggctttaatggtagtcaagaaatgaagaaagaatatcaagcaagacgtgattatctatattcaaacttaactaaattaggatttgaatgtgctaagcctcaaggagcgttctatattttcgcaaaaattccagctggtttagaacaagatgataagaagtttatttatgacttagccgaaaaagcaaaagtagcagtaactgctggctctttcttcggtaaaggtggagaacactatatccgtttaagctatgcaacaagtatggaagaaataaaaaaaggcgtggctcgaattgccaagtatgttgaagaagaaagtaaataa

SEQ ID NO: 1324 - DNA, 2034 bp, Unknownn
  isolated from dental, unidentified
gtgaaacgtttgttggaaaaagaattttggcagataccagaatttttaagaaataaacatttgcgaataatagcagttttcttacttatactctccttagtctgtgcaacattggcatttattgttaatgcctggttaggtataattgtctttctgctgattttattgacaataggattgtcttttataacattaaaacaagttatgcaagataccacacattatatatctgatttatcgtataaaattaagcgaagtgagcaagaggcattgttgaaaatgccaataggaattctaatgctcaatgattcagcagaagttgtttgggttaatccaactatgcaaaagttatttgggcaagaagaaatattaggtaaaaagttaacagaggctgatgaagaattagctaaagtgatcaatgataatatgtcgaataaagatagcgttgagattaaatggcaagataaaagatttaatatgttagtacaaagtgatattaacgttgtttatcttttagatattacacactatgctgaaatccagaaacaatacgatgattctcgattagttatcggacaaatttttattgataactatgatgaagttacccaatcaatgaatgatactaatatttccaatttaagtaattatataacgaatgagttatcatcatgggctagtcaaatgggaatgtttctaaagatgattgatgaagatcattatttcgttttagcatatacaaaatcattaacacaaatggaaaaagaaaaattcaaattattagatcgtattagggaaagaacatctaagcaaaattttccagttactttgagtataggattagcctatggtggtactgatttagctaaactttctcgattatcgcaaagtaatttggatttagcactaggacgaggtggagatcaggtagttgtaagaggagtagatgattctcaagcccgcttttatggtggtaagacgaatccaatggagaagagaactcgtgtaagagcaagaatgatttctcaagcattacaagaattaatgagtcaatcagatgatatttttgtaatgggacatgctagaccagatatggattcgataggagcatgtttgggaattagacgaattgcaaagatgaatggtaagcaatgttggcttgtgttggacacagataatttgcattcagatatccaaagattgctagatgaaattgataactatccagatatcaaggaaagcatcatttctcctgaagaagctttacagaaagcaaccaagaaaagcttattattgatgctagacttgtctaaaccttcaatttcaatgagtcctgaattatatgatcaactcaagaatcgagttattattattgatcaccatcgtcgaggtgaagaattccctgaaaatccgatgttggtatatattgaaccttatgctagttctacatgtgagttaataacagaaatgtttgaatatcaatcacgctatagtgatgatccaataaataaattagaagcaacagctatgctgacgggaattattattgatacgaagtcattctcattaagaacgggaactagaacatttgatgctgctagttatcttcgttcagtaggtgctgactcgcaaatgtcgcaacattttatgaaagaaaatgtacaaagtttcttgcaacgaaatcatttgattgatagagtggaatttgtagggaatggaaatgctgttgtagttggtgaaaatgatcgtgcctatgatccggtaactgctgcacaagctgccgattctttattaactgttagtggggtgcaagcttcgtatgtagtgactcaccgttctgaagatattattgggatttcagctcgaagtaatggagagactaatgttcaaattattatggaaaaaatgggaggcggaggacatttatctaatgccgctactcaaattgaagatagagatattttggatgttaggaagcaactacttgatttaattgcacaaacagaagaaaataatacagaggaaactgattag

SEQ ID NO: 1325 - DNA, 1512 bp, Unknownn; identical to SEQ ID NO: 246
  isolated from dental, unidentified

SEQ ID NO: 1326 - DNA, 1551 bp, Unknownn
  isolated from dental, unidentified
atggaagtcttaaaaagtgtagttaattacattttaaatttaggtggaccagtatttgttccgttggtaatgctgataattgcacttatcgcaggattatcttttaagaaatcaattattgcctcaattacattaggtgttgccttttctggaatgaatttagttgttaattacatgcaagaaattatatctcctgctggtaaagcaatgtctaaagccataggtgttactttaaatgctgttgatgctggttggacaggagtagctgctattacctggtcatataaagttgcattcctatttttcccactattactagctatcaactttataatgttgacttttaattggacaactactttaaatgttgatatgtggaatgtatggaataagatattcacttatgtaatcgtttactatttcacaggaagcatgcttattggatttttagtttcaagtattcaaattattttcgaattaaaagcaggtgatgtatggcaaagacacatagaggatatgactggaatgccaggggttacagtgcctcattttattacactattcgcagtaattttaaatcctttaaataaattacttgactttattcctgtatttaacaaaccatttgactcagaagctattcaaaaaaagattggtatcttcggagaaaataaagtaatgggatttattatcggtatattattgggatttggagctggatatggtttatccaagtctttgatgttagctgtagaagctgcaactgcaatgacattattcccaatgatctctaaattatttatggaagcattgaatccgattgctgacgcaatggggaacttcatgaagaaacactttaaagatagacaagtatatattggattagattggcctatcttggctggacgaagtgaattatgggttacagtaattcttttggttccagtagaacttttatatgctatcatcctaccacataataatgtactaccttttgctggaattattaatctttcttttgtagttgctgcattattggttacaggtgctaacttattgagaatgctagtattaggtttgataacaactcctattttcttatatggtggcacatactttgctccaatgataactaaattggcgcgttcaactaatagtttcaaagttccagctggtcaacaattatcatggtctacatttgaaggcccagattttagattattctttggtcaagctttcacaggtaaatggtgggcaatattagcagtagttatttgggtattaggattcatttggttatatttagatcaaaagaaaattccattacctagtcaaagatatcaagtagctattccaaacgttggaaacagtagtgatgaaaataagcaagtaactgttgaacaaaatgattataaagatattaatttagacgattttaatggtgctaattttagtaatactaaaaaagtagcacaaaataatgaaggcgattacaagaatatctcattagatgattttgatggaatgaattttggaaatagaaaaaggtga

SEQ ID NO: 1327 - DNA, 1278 bp, Unknownn
  isolated from dental, unidentified
atgaaaaagaataaagtttttcgactttctttaggttggcaaatcattttaggcttagtcatcggtgtcattctcggtgtcgtttttgctgataataagaagtttattgcttttgccaacggtttaggttcaactttcatcaatatgatttcaatgattgttcttcctattgttgtctctagtttaattgttggaatctctaatatgggagatattaaaaaattaggtaaaattggcttaaagacattaatctattttgaagttttatctacaattgcatttattgttgggatggttatttctaatttttctcatcttggatatatgcttgatctaagtcaattatctcatgttgatatttctacttacgtaaagactgctaaatctgctgctcataatggtttaggttcaatacttatgtctattgttccttctaacttttttgacgcattagctacaggacaaatgctacctgttattttcttctcatccctatttggtttaggaattgctgcaattggtgaaaaaggtaaaatattaattactttcttacaagccgttgctgaagttatgttcaaaataactggttggattatgcattttgctccacttggtgttgctggtttaattggtgctactgttgcccaactaggtctagcttcattaaaaccattggcactctttatcgtaatggcatatattactatgatattctttattttagtggtattaggtatcacttctcgtatttttggtttcagaatcatggatcaattaatagttgttaaagatgaactaattttagctttcacaactgctagttcagaagttaccctacctcgtttgatgcaaaagacacaaaaacttggtgttgaccaagctattagttcatttgttattccaactggttatacatttaaccttgatggttcagcaatttatcaatcacttgctgctatctttttagctcaagcatatcatgttcacttatcaattagtcaacaaattactttgcttttagttttaatgattacttctaaaggtatggctggtgttccaggagcttcattcgttgttttattagcaaccgtatcttcaattggtgttccagtctctggcttagctttaatcgctggtatcgatcgtcttgtcgatatgggacgtactgcagttaacgttgcaggtaatgttactgctactctagttattggtaaatctgaaaacgaatttgatcaagctaagcatgatgcttatgtagcaagttttagaaataaatag

SEQ ID NO: 1328 - DNA, 525 bp, Unknownn
  isolated from dental, unidentified
atgtattcagaaaataaacgtaatttcgatgtgtttagtttggtcataggtattttgctaatattcttaggaggatattccttatatcgtccagatacgacactggcttttatctcaatcatgatggggatgatagccattatcaaaggaatttatgaattatggttcagacgtggaatatcattttggctaggagaaaaatctggttggctcttagtcatgggtattttagatattattttaggccttatattcatttttaagatcgcagttggtgcaagttttatagcagtgatttttgcggtttggtttatttttgatgcaataactcaacttgcaacagctaatttctttaagagactagataagggatattattgggtaattgtcattttaagcattttgtccttaatcctggggataatgctattgtttaacccaatgttatcagctctaacaattgtatggattatttccatatacttgattacgattggaattttaaaaattattcaagcattctaa

SEQ ID NO: 1329 - DNA, 1980 bp, Unknownn
  isolated from dental, unidentified
atggctaaaattcacgaactttcagaaattttggctaatcaaattgcggccggagaagtagttgaaaggccggcatctgttgtaaaagagctagttgaaaattctattgatgctggggcaaagcagattgatataattattgaagatgccggattaaaatcaattcagattattgatgacgggaatggaattgaagctgaagatgttgaaacagccttcaaacgtcatgcaacaagtaagattatcgacagaaaagacttgtttaaagttcatacattgggttttagaggagaagctttaccaagtattgcttctgtttcagatgtggtgatggaaacagctgtatctggtcgagcaggaactaaaattcatattaaaggtggagaagtgcttgaaaaaacactaagtgcaagtcgtgaaggtactactatcacggtttcggatttattttataatacacctgcgagattaaagtatttgaaatctgttcaaacagagttgtcatatattagtgacattgtaaatagattagctttgagtcatactgatgtagcactttcattaacaaacaacggacgccaattgttgcaatctgcagggaatggaaacttgcaacaaacaataggtgcaatttatggagttcaaaatgctcgtcaaatggtaaagtttgaggatgctaatctagattttaaaataagtggatatacttctttacctaagttaacaagagcgtcaagaaattatatcagtttgttggtaaatggacgttatgttaagaactttcaacttactaaagcagtaattgaagggtatggttcaaaattaatgacgggtcgttatccgataacggtcttgtcaatagaattagatcctactctagtagatgttaatgttcatcctacaaagcaagaaataaaaattagtaaggaagatgaattagttacatttattcagaagactatttttgaaagaattggtcaagaaaatctaattcctgatggattgcaaaatattaaaagtaaaactaaggaaaaattagactttgagcaattaaaagtaggactaaatgaagcttctaaacaatatcaaactaaacagcatcgaacaggaataacatcagaagtgacagcagcattagttggagaaaaactgactaaagatgagagtcaaactcaaaataatgaaaagataaaggaagaaactaaagtagagcttagtccgataattattaaagataaacaagatttaaaatcttatagagtaaaagagtgggatgaaaaatatcaatctcggaataaagaaactgaagttacatctatagcagaagaaaacagatcagtggatgacgaaagaaaagatacccagagatttccgactttacgctacattggacagatgcatgggactttcttatttgctgaaggtgaagagggactatacattgtagatcaacatgctgcacaagagcgtgtaaaatatgagtattatcgtgaagagataggaaaagtatctccaactcaacaaaatttattagtaccaattgttttaacgtatccaacaactgatgcattgattatcgatgaaaatatggataaattgaaagaattaggtatatatttagaagattttggacaaaatacttatattattagagaacatcctacttggtttaaagaaggacaagaagagtcaattattcgtgagatgatagactatttcttaaaagataggaagttaagtatcgctaaatttagagaaaaaaccgcaattatgatgagttgtaaaagatcgattaaagcaaaccatcatctagatgataagcaagctaaatcgattttagaacagttaaagacttgtgaaaatccttttaactgtccacatggccgtccagtattggtaaagctttccaataaagatctggagcacatgtttaaacgaattcaagaccctcatcatactggaattttagaagaagattag

SEQ ID NO: 1330 - DNA, 2631 bp, Unknownn
  isolated from dental, unidentified
atgcctcagaaaacaaagcaaacaccaatgatggaacaatatatgcagataaaaaagcaatatccggatgcctttttgttctatcgtttgggtgacttttatgaaatgttttatgatgatgcaattaaaggatctcaaattttagaattgacattgacacaacgcaataaaaaagcagttgatccaattccaatgtgtggtgtacctcatcatgctgcacaaaattatatagatattttagtagataaaggttataaggttgctatttgtgaacaagttgaagatcctaagcaagctaaagggatggtaaagcgtgaggtcattcagctggtaacaccggggacaataattgatgagtccgcaggtgaagctaaggaaaataattatttaacagctttacattttgaaaataatcaatatggttttgcatatgttgatttatcaactggtgaacttaaagtatctgtgttaaatacaattgacacaatattaaatgagttaatcagtcttagaacgaaagaaattgtggttgactcaagtgtaaacgatgaagttttaaatcaaattaagaatcttaagattttaatttctgaacaaaatgatacagaagatagttcagaagtaagttttgctagtcaagatgttgagaatagtgtcgaagttgaagtaattaaacatttaattacctatctgaaaattactcaaaaacgtgctttatcacatttacagcgagcagtacattatgagccatcacaatatttaaagatggattatcatgcaaaaagaaatttagaattattaagaaatcttcgtactcagaaaaaatcaggaacgttattgtggttgctggattcaactaaaactgcaatgggcggtcgtctattaaagcaatggattgacagacctttgattaatttaaaagaaatagaagctagacaatcaatggttgagaatttattaacccactattttgaaagaagtggacttcaggaagaattagttaatgtctatgacttagaaagattagcgggaaaagttgcatttggtagtgttaacggtcgggatttaatccaacttagaacatcattggaacatattccacaaattagatatattattcaagaattaaataatgatagtacatttgatgaaatttttgacaaattggatccaattgaagatattgcagatttgattgaacaagcaattgaagacgaaccaccaatttctgtaactgatggtaatttgataaagcctggatatagccaagagttagatgaatacgtagatgctatgaaaaatggcaaagcatggttagcagaactagaagctaaagaacgtcaagcaactggaataaataatttaaagataggattcaacagagtttttggatactacattgaagtttctaagggaaatttgagtaaattgcctgaagatagatatcaacgtaagcaaacattaactaatgctgaaagatttatcactcctgaattaaaagaaaaagaatcactaattttaggagcagaaagtaaagctaaagagctagaatacaagatttttactggtattcgtgatcaaataaaagatgagattcagcgtatccaggaattagcaggtgctgtagctgcattagatgttttgcaaagttttgctactgtaagtgagcagggacattttgtaaaaccagaattaactactgacaatcatagtttagatattaaggatggttggcatccagtggttgagaaagttatgggtaagcagagttatattccaaatgacattaaaatggatgatgatctagatgtacttttgataacagggcctaatatgtctggtaaaagtacgtatatgcgacaattagctttaactgtagttatcgcacagattggatgttttgtacctgctaaatctgctaagatgccaatatttgaccaaatttttacacgtattggagcggcagatgatttaatttctggtgaatcaacatttatggtagaaatgaaagaaacaaatgttgctttaatgaatgcaactagaaatagtttgctattgtttgatgaaattggtcgaggaactgctacttatgatggcatggctttagctcaagcaatcattgagtatgtacacaataatatccatgctaaaaccttattctctactcactaccatgaattaacaatcctggatgaaagtttggataaattacaaaatgtccatgtaggtgcaatagaaaaaaatggtgagttgattttcttgcataaaatgcaggaaggtccagctgataaatcatatgggattcatgttgctaagctagctggtatgccagataaacttttaaagcgtgctgacagtattttaaataagttagagagtgagaatgattttactgtagaatcaacagaaagttacactgaagaaaagcatattgaagaaaaaaatgaaaatgaaacttcggagattcaagaaaaacagttgtcgttgttccaacccgaagcagtaagtttagattctaatcaaagtaaaatacttaaagagattaagaatgctaatttaatgggaatgacaccaatggatgtaatgaatattgttttcaaatggcaaaaagaactcaataagaaaggttag

SEQ ID NO: 1331 - DNA, 1008 bp, Unknownn
  isolated from dental, unidentified
atggtgttcggaatcggaacgaaaaacataggaattgatttaggaacagcaaatacaattgtgtatgaagaaggtaagggtattgttttacgtgaaccttctgtcgtagctaaaaacacaaaaacaggagaggtcgtttccgttggttcagaagccagagatatgattggtcgtactcctgaaagtattgtagctattagaccaatgaaagatggtgttattgctgattacgatacaacagtatcaatgatgcaatattacatccaaaaggctttaggaaacaaagctaacaagccttacgtaatggtatgtgttcctagtggtgtaacagaagtagaaaaaagagctgtcatagatgcaactcgagtagctggtgctagagatgcttatacaattgaagaaccttttgctgctgcaataggtgctggattacctgttatggacccaactggtaatatggttgttgatatcggtggtggtactactgatgtagcaacaatttctttaggtgggattgtatcaagtcgttctattagaatggctggtgataagattgatgaagcaattatttcttacgtacgtaaaaacttcaatcttttaattggtgaacgtacagctgaacaattaaaaatggacgtagcatctgcatcagttgaagctgctaaagatattgaaagtcaaagtattcgtggtcgtgatttagtatcaggattgcctcaaacagttgaaattgaagctgttgatgtagctaaagcaattcaagaagttgttcaagaaattattgtagcaatcaaagaaacattagaagaaacttctccagaaattgctgctgatgttatcgatcacggaattgtccttactggtggtggagctttattgaaacatttacctgaagttatttcagaagcaactaaagttccagtatttgtggcatctgaacctttagattgtgttgctattggaacaggtgaatcattgaagagtatcgaagtcatgaaagacaaataa

SEQ ID NO: 1332 - DNA, 1440 bp, Unknownn
  isolated from dental, unidentified
atgttagatcaaaagaaacattatatgagctggccagttattgctttgctcgactttgttacaattattagttttgaaaatatattctatccttttcaaaatcaaggattatctgttgttatttcatggattttcttactttttacttatgttattccttatgcattaattgctacacaattaggtttaacttttgataatcaagatggtggtcttgcttcttggattcgtcgtggtactcatagtgatttattcggatacattacttcctggatgtattggacgcaaacaattccatacttagtggacgtttcaaactctgttattgtttctataagttggattattttaggtaataatactttaggacatcacatgtctacgtttactttcggaatgttaacttttgttattattttattattcattatcttcgaaaatgttttccgtgattccctagaagtactttccatcattggtggtggtgcgatgttcttgatttcaatgctttttgttttcatgactgtatgggcattaacacacggtgcacatattgctacacaaccatttaatcttcatgcatttaagccaaactttagcttacactacttctctacaactggtttattaatcttcgctatgtctggtgctgaattagctgctccatacattaacaagatgcgtaatcctaaacgagattttcctaaagctatgtggatgttagctttgatgactgctttcttaaccatctttggtactttatcattggctgtcttctttaacgctaaccacattcctaacgactttaagatgaatggtccatactatgcattcaaacttttaggtgaacaagttggtatgggtaagagcttaatgtatgtctttgctgtagttcaattgatgtttatgctagctcaattagctattttaattgatgctgctagtcgtgtattcgctagtgatactgctgctaaatacatgcctagttggcttatcaagaagaataaagctggacgtccagtacatagttatactttaactgctggaatcagtttgttacttcttcttttaagtggtactttaccaaatatcaactccatctataactggttgttgaacttaaatggtattgtttcaccatataagacagctttagtattcgttgcattcctagctattcgttggcaagaagaacaatttaagtccgattacgtttatattaaaaatagaactggtgctttaattgttggtttctggtgcttcatcttcacctttgtctgcgcaacaatgggattcatcccacaagatgctgctcctggaactaaagcatttgatcaccaattatttatgaactttgtaactgttggattcttagttgtacttggtttcttattaccatggttacgcaagctagaattaaagagagctgcaaaaaaataa

SEQ ID NO: 1333 - DNA, 1326 bp, Unknownn
  isolated from dental, unidentified
atggaaaaaattgtagttcgtggtggaaataagttagaaggagaagtagaaattgaaggagctaaaaatgcagttcttcctatcttagctgcagcaatcttgcccagcgaaggaagaacgattctaactaatgttccaatgctatctgatgtatatactatgaataatgtaatcagatttttaaacgttaaggttggctttgatgaaaatgaaaaatcagttgaaatagacgcaactggtaaattatcatatgatgcaccattcaagtatgtttctaaaatgagagcatcgattgttgtgttaggaccattattagcacgattaggcaaagctagagtagcaatgcctggaggatgtgctataggttctcgtccaatagacttacatttaaaaggattagaattgttaggagctaaaattgagcaacataatggttacatagatgcacataccgatggaagattggtgggagcaaatatttatttagattttccaagtgttggtgctactcaaaatattatgatggctgctactctagctaagggcacaactattattgaaaatgttgcaagagagccagaaattgtagatttggctaatgttttaaataagatgggagctaaagtttacggagcgggtactgaaaaaatcaaaattataggtgtagaaagtttacacggaactgaacatgctattattcaagatagaatagaagctggaacatttatggttgctagtgctttaacccaaggaaatgttttaattaaagaagcaattgcagaacataatatcccattgatttctaaactagaggaaatgggtgtaaaagttatcgaagaaaatgaaggcattcgaataataggacctgaaaaattgaaaccaactacagttaaaactttacctcatccgggttttcctacggatatgcaaccacaaatttcaattttgcaactagctgctgagggaacaagtattttaactgaaactgtgtttgaaaatagattcatgcatttagaagaattgagaagaatgaatgctgattttaaagtagaagggaattcggtagttcttcatgggccaactgatttcaatggtgccgaggtagctgctactgatttaagagctgcagctgcgttagttttagcaggattagttgcgaaaaatattactcaagttactaatctaaagtatcttgacagaggatattatcatttccatcaaaaattagcttctttaggtgctgatattaagagaattgatgatattactgatagatcatttgaaataaaaaaggaaaaattaaaaaacgtcaataacttacaataa

SEQ ID NO: 1334 - DNA, 846 bp, Unknownn
  isolated from dental, unidentified
atgaagcaagttggatactacaatggtactatcgctgatttaaatgaacttaaggtgcctgctactgatcgtgcactttattttggtgatggttgctacgatgcaactacatttaagaacaatgttgcatttgccttagaagatcatcttgatcgtttttataatagttgtcgcctactagagatcgactttcctttaaatcgcgatgaacttaaagaaaagctttacgctgttattgatgctaacgaagttgatactggtatcctttattggcaaacttcacgtggttctggtttacgtaaccatattttcccagaagatagccaacctaatttattaatttttactgctccttatggtttagttccatttgatactgaatataaacttatatctcgcgaagacactcgcttcttacattgcaatattaagactttgaacttacttccaaacgttattgcaagtcaaaaggctaatgaaagtcattgccaagaagtagtcttccatcgcggtgacagagttacagaatgtgcacactctaacatcttaattctaaaagatggcgttctttgctccccacctagagataatttaatcttgccaggaattactttgaaacatctcttgcaattagcaaaagaaaataatattcctacttccgaagcaccatttactatggacgatcttagaaatgctgatgaagttattgttagttcttcagcttgtctaggtattcgtgcagtcgagcttgatggtcagcctgttggtggaaaagatggaaagactttaaagctcttgcaagatgcttatgctaagaaatataatgcagaaactgtaagtcgttaa

SEQ ID NO: 1335 - DNA, 828 bp, Unknownn
  isolated from dental, unidentified
atgaaaaaagaacgtgtagatgtactattagttaaacagggattattttctacaagagaacaagctaaaagggctgtaatggctggcgaaattttaggagagaacgaagaaagattagataaacccggaatgaaaatttctgtagatactgagttacattttaaggggacaaaaatgccttatgtaagtagaggcggtttaaaactcgaaaaagcacttaaggtatttaaagttgatgcaaaaaataaaactatgttagacataggatcgtctactggaggatttacagatgtagctctacaaaaaggggccaaattaagctatgctttagatgtaggaactaatcaattagcttggaagttgcgtcaagatgacagagttgttgttatggagaatacaaatttcagatacagtaaattagaagattttactaaaggacaaccagatttagctacaatagatgtttcttttatttctttacagttaatattaccaactttacatgagattattcaaaataatggtgatgtaatagctttaattaagccccaatttgaagctggaaaagaaaaagttggaaaacatggaattgtaagagatccaaaggttcatctagaagtactaaataaaatcataagttttgcagctgaagaaaattacgatgttgttgaattagatttttcacctatcactggtggggaaggaaatattgaatttttagttcatctggtatctaaggaaagtgttggaaatatttcgcctagtgtaaatcctgagttaattgtgaaacaagctcatgctacattagatattaaaaagaaagcataa

SEQ ID NO: 1336 - DNA, 1206 bp, Unknownn
  isolated from dental, unidentified
atgaaatcaaaaaatattattaaaattgtaacaggaactattatagccaccactattattagtcccgttgttcctgttatacagaatatttctgtacttgcagatacaactaattcaaattctagtaactcaaatacacacactctaaattctgcatacgtagtctacgggtctggagtctcatcagatatctactcaagtttaaatgatgttttacaaacagattcttcatttaaaactatgacggcaacagcagacgattaccgtaaatatattaataataatagtaatacaactaacgctgctatgattagttctgttgctatcgctcctggtgatccagggtctggagttaaagttaatataaagaattataatggtgaaaataatatcactgaggttactgctcagcaatatgctatggttgctcaaatggctggtgtaactgatgtaagtattgtcgtcactgctaaccgagctgtatctggtgaatctgctttaacaggtgtttataaagctttagctactgacggtgtaaatatcaattctgaaaacacttctgctgcaaataacgttttagatgctactcaatctgctattgatgctaataaagatgataaaagttatcctggaaaattaatggcagctgtaggtgatgtttcaaaacaaattgctcagcaaaaacaagatgattctagtaacttagcgactaaacaagacatccaagatatgttaaataaagctctagaaaaacgtggcatagccgatacaactaatcaaactcagattacacaaattgttaatgctttagtagtatttcaaaatgctcctatttcatcaagtaaaacttacgtaaatactgttgatgatacgattaataatgtaaaaaactcaactggtaacttgatgaataaagcaaaaaattgggctaatagtgaaaaatttggtcaaacagctgaagaagctaagggctggttcgctaaattcactgattggataaaaggtatttttggacaaaaatctgataattccacagacacagatactaacactaacgaatcaagtaatacgatttcatcctctgacacttctagtgttgtagatgatagctccagtaacgaaaatactgatacaaataattctgagaattggtggacacaatttaccaattggataaagggattatttggacaaaacaataactaa

SEQ ID NO: 1337 - DNA, 573 bp, Unknownn
  isolated from dental, unidentified
atgttaattttgggcattttagtagtaatagtgattattgctttaatatggagatatttttcacacttagtaaatccaactgatactaaggtagaaggtgtgatcaataattctttaatactatatttctcacctgctggaaaaactaagcgtttagctcatttggttcaacaagaaactaatgcagatattattgaaatcgaaggtgtaaaagaatatagcggtgatgataaagcacgtgcttttcgtgaatggataacaggtgctacaccagaagtgaagaacaagcttgataatattgataagtacgatatggtttacttggcttatcctatctggtacgatactgctccaatgattatgaagcaagttattaaaaagcataattttagtaacaagtatgtagtccctgtagtatcgcttaataaggcttctcaaggcagtggacgcagtatacgtttaattaggcatcacgcacctcgagcaaaggtattacctcgtttattgttacaagacgacggtaaagatttgcaacgaattcaagaatatttgaagcaaattaatatgaaataa

SEQ ID NO: 1338 - DNA, 747 bp, Unknownn
  isolated from dental, unidentified
atgttacgtttagaaaatgtgaataaaacttttggtggtaatttagctttaaaagatattacgacaacatttgaaaataatcagactacagttttagtaggtccatctggttcaggaaagtcaacaatgttacgctcattgaatttacttgagatgcctgagagtgggaaatattattttgatgatttagagctggactttaagaagggaatttctaaaaaagagattttagaagttcgtcgtgaaacagaaatggtttttcaaaattacaacctttttccacatttaacagttttgaagaacattattgaaggaccagttcatgtgttaaaagaggataaggaatcagcaactaaaagagcttatgaattactcaaaaaagttggcttggcagataaagcagatgcctatccgcaacaactttcaggtggacaagctcaacgtgtggcgattgctagatcattagcgatgaatcctagatatatcctactagatgaaccaactagtgcgttggatccggagttagaattagaagttttaaaagtattgttacagttagctaaagaaaaacaatcgttgataatagttacacataatttggctttcgcacagaaagttgcggataaaatcttgtttgttgaagatggacaaatattgttccaaggtcctaaagatgactttttcaattcagataatcagagaataaagaactttttatccgcgatgacgttaagtaacttagattaa

SEQ ID NO: 1339 - DNA, 915 bp, Unknownn
  isolated from dental, unidentified
atgagaaaggaagtaggatattttttgacgacaaaagggcgcataaagcaatcactaagtggatattatgatgttttagtagaagataaagagtatagaacaagagcaagagggaattttaggaaaaagaaaatgacaccagtagttggtgattgggtagactttaaaattgacgacaatggtgatggatatatattaaaaatttatcctcgtaagaatcagttggtgagaccgcctatagctaacatagatacagctattgttgtttcggcgtgtgtagagccagatttttctccaaatttattagatagacagttagtaatgttagaaagtaataatgtaagaccagttttatttttttcaaaagcagatttgttaaaccaagaacaaagagaaaaatttgaatcttactttaattattatagtaagtattattcgtgctatatttcatttgaaaatgaaaacagacaaaatgtattaaataatttgatgtgtgatttaactaatgaaatagtggttgtgatgggacaaactggagcaggtaagtctactttacttaatgatttaaagccagatttaaatttagaaacaggtaagatttctaaagcattaagtagaggaaaacatacgacaagaaaagtaactttattagatattaatggtgtaatgattgctgatacaccagggttctcatcatttgagttattaaatataacaaaagatacattaccattaatgtatccagattttgttaaatatcaagataattgtaaatttagaggatgcttacatttaaaagaacctaaatgtgctgttaaagatgcagtaaataagggtgagattttggaaaatagatacattaattatgtacagtttcaagatatgttagctaataaaaaggttaggtataaatga

SEQ ID NO: 1340 - DNA, 2265 bp, Unknownn
  isolated from dental, unidentified
atgaagagaatatttgaagttgatccatggaaagttatttctcatgaactaaagcctgaagataaacgattacaagaaagtatgacaagtattggtaacgaatatatgggtatgcgtgggatgtttgaagaaaaatattctggcgatacacataaaggtatctatttaggtggagtttggttccctgataagacagttgttggttggtggaaaaatggttacccacattattttggtaaagttataaacgctgtggactttgtatctgttgatattaaagtaaatggtgaatccattgacttagctaaagatagttattctgattatgaagttagtcttgatatgaagaaaggtattttaactcgtagctatgtagttgataaagatggagctaaggtaaaggtaacatctactcgttttgtaagtattgcatttaaagaactatatgctaataaattaacttttgaaaatctgggctcagaacctgtaactttagaagttgattctgtaattgatgcagatgtatacaatgaagatgcgaattatgatgaacaattctggaatgttttgagtaaacaagtatctgctaaagatggaagattagttgcacaaacaattccaaacaattttggtacacctcaatttactactgagatggcaatgcatcatgttactgacatggaagctaaaggcttaggtaaagaagaagacaagcaagttgttaatacttttgctaaagaattggcagctaatgaacaagtaacatttgaaaaacgtgtaattgttacaacatctcgtgactatgcagatgagaaagacttagatgaagcaacaagtaaattattagattcacaagcagaaaagacatttagtgaattattaactgcccatgaagaagcatgggataagagatgggaaaaagctgacgttaagattgaaggcagtgacgaagcacaacaaggtattcgtttcaacttattccaactattctcaacatactatggcgatgatgctcgactaaacattggaccaaaaggctttactggtgaaaagtatggtggtgcaacttactgggatacagaagcatttgctgttccactttacttagcattggctgataaagaagttactcataatcttcttgaataccgtcataatcaattaccaggtgcataccataacgcacaagaacaaggtctaaaaggtgctttatatccaatggtaacgtttaatggtattgaatgccataatgaatgggaaattacttttgaagaaattcatcgtaatggtacaattgcatatgctatttacaactatacacgttatactggcgatgaagaatatgtgacacatgatggatttgatgttttgacaggtattgcacgtttctgggcagatagggtgcattactcacaacgtaagggattatacatgattcatggtgtaacaggtcctaatgaatatgaaaacaatgtaaataataactggtatacaaacatgcttgctaaatggtgcttaaattacactaatgaaattgcagataaggtttctgatgaaaaattagctgaattaggacttactgaagaagaacgtaacaagtggcatgaaattgcagataatatgtatctaccagaagacaaggaattaggaatctttgtacaacatgatacattcttagataaagatttaacaccagtagctgatattcctgctgatcaattaccattaaaccaaaattggtcatgggataagattttaagatcaccatatatcaagcaaggtgatgtaatgcaaggaatttggtactttatcgataaattcccagaagatgttaagaaacgcaactttgaattctacgaaccattaacagtacatgaatctagtttatctccttctgtacacgcaattattgctgctgatttgcacaaagaagataaagctgtagaaatgtattctagaactgcacgtcttgatttagataactacaacaatgatactaatgatggattgcatatcacatcaatgactggttcttggttagctattgttcaaggatttgctggtatgagagtaattgatgatgaacttcaattctcaccatttgtaccaaaagattgggaaggttataacttccgtattaacttccgtgacagattacttgaagttactgtaaataaagaaggttcatctattaaattgctaaaaggcgatgatttaacaattaagttaaatggtgaatctttgacattaacaacagaaaagtag

SEQ ID NO: 1341 - DNA, 771 bp, Unknownn
  isolated from dental, unidentified
gtggaaatatttgattcgcatacacatattaattcgcatgaatttgataatgatattcctgacgtaatagaaagagccaaggcacttgatgtcactgaaatgttggttattggatatgatgatgacagtagaaaaaaattacaagaaattattcaagaatatcctcatatttatggtgcggtagggtgtcatcctgaagatgcattaaattacaatgcagagtatgaacaagaattaagaaaatatttggaattagaaaagtttgttgctgtgggagaaataggtttggattattaccatgattcccctaaaaaagtacaacatgaagtatttgaaaagcaaatagctttggcccaagaacttaatttaccaataagtgtgcacaatcgcgatgcatttgaagattgttatgcaattttaaagaatatgaatattcaaaaaaatggcggaattatgcacagctttaatggtgatgccatttgggctgagaaatttttggacttaggcatggaattgtcatatagtggagtagtgactttcaagagtgccaaggatgttcaagaatcaatgatgatgacaccattggagcatatgttagttgaaactgatgcaccttacttaactccaatgccatatagaaatagaatgaatgaaccagcaatgacaagatatacacttgaatttattgcagaaaaaagaggaatttcaagtgaagaattagctgaaataacaagaaaaaatacagaaagagttttaaagattaatgaatga

SEQ ID NO: 1342 - DNA, 846 bp, Unknownn
  isolated from dental, unidentified
atgaaatatggtattacagcagcaactggtcattttggtcaagtagcagttaaggaattagtaggtttggtaggagcagacaatgttgtcgcaatcgtacgtaatttagaaaaagctaagcaattgctttctgatgatattgaaattcgtcaaggtgattatgatgataagaatagtttagtttcagcttttgaaggattagataaggtattatttatttcatctcaaccaggtggtaaaattatacgtttggaacaacatacaaatgtagtagatgctttgaaggaaactaaagtagactttgttgcatatacaagtttcccacatgctgatcaagcaaagtcagcattagccagtgatcacaccgcaactgaaaaattaatcgtagaaagtggcattaaacattcattcttgcgtaacaactggtatttagaaaacgaagctggtttcttaaatggagaagatattgtatatgctgctggtgatggtaaagtaggttgggcattggaacgtgaatatgcagaaggtgcagtaaaagtacttgttagcgatgaaacaaaagatgtctatgaatttgctggtgcaagtagaagctatgcagatttagctaaggctgtcggcgaagtttacggtaaggaaatcgcagtaacaaatgttgctagtgatgactataaggcaggtttagaaaaagctggtctagacgaaaatacaattggattcattttaatgattcaagatctaatcaagcaaggtgaacttacagaagaaacttctgatttggtagatgtattgggtcatgaattgaaagctttgccagaagcaattaaagaagttattggtcgctaa

SEQ ID NO: 1343 - DNA, 1578 bp, Unknownn
  isolated from dental, unidentified
atggataaaaaacaattagaagaatcagttaataatcgtcgtacatttgcgattatttctcacccggatgctggtaagactacgataactgaacaattattactttttggtggagttgtaagaaaagcaggaactgttaaagctaaaaaaagtggaaattttgctaagtctgactggatggaaattgaaaagaaacgtggaatttctgtaacaagttcggtaatgcaatttgactatgctgggaaaagagtaaacattcttgatacacctgggcacgaagatttttccgaagatacatatcgtactttgatggcggttgactcagctgtcatggttattgactcagctaagggtattgaaccacaaacaaagaaattattccaagtttgtcgtatgagaggtattccaatttttacttttattaataagttggatcgcgatggtagagaaccattagatttaacagcagaattggaagacgttttgggaattgaatcctatgctatgaactggccaattggtatgggaaaaggcttgaaaggattatatgatatttataatcatcgcattgaattgtaccgttctgaagatgaaggccaagcctttttagaattggacgataatggtgaaataaaaggagacaacccattaaaagatgaaagtatctataaacaagttttagaagaaatagaacttattgaaggtgcaggtagtgaatttgatgaagaaaaaatcgctaaaggtgaattgacaccagtattttttggctctgcactgacaaactttggtgttaagacattcttagatgcatacttaaaatacgctccaaagcctgcagcacataaaacagaagatggttcagaagtagagccagatagaaaagatttctctggatttatcttcaagattcaagccaacatgaatccaaatcatcgtgaccgtattgcttttgttagaatctgttccggtgaatttgatagaggaatggatgtgttcctagaaagaacaggcaagaaactaagattatctaattcaactcagtttatggctgatacacgtgaaacattggaaacagctgttgctggggatattattggtttatatgatactggtaacttccaaattggtgattcaatttatacaggtaaaaaagccgttaaatttgagaaactaccacaatttacaccggaattatttatgcgtgtaactgctaagaatgttatgaaacaaaaatctttccataaaggaattcaacaattagtacaagaaggagctgttcagctctaccaaagttatagtactggagattatattttaggtgctgtagggcaacttcaatttgaagtgttccaatttagaatggcaaatgaatataactctgaagttgttatgactccgatgggacataagattgcacgctggattgatccagaacaattagatgaaaagatgtctagttcacgaaatcttttagttaaggatagagctggtatgccattattcttattcgaaaatgaattcgctgaaagatggtttatggataaatatccagatgtcaaattaacagctaaattataa

SEQ ID NO: 1344 - DNA, 1404 bp, Unknownn
  isolated from dental, unidentified
atgattagtgaagatataaaagacattggtggccaatataaatatggctttaaagatgacattgaaccaatttatacaactggtgaaggtcttagtgaagaagttgtaagaaatatttctaaagctaaaaatgaacctgaatggatgctagatattagattggctgcttatgaaaagtacaagactttgaagatggctaattttggaccagatttgtcagagttggacttagatcatattaattattttagacgtgatactgatacggtagctagaaagtgggaagatgtaccacaagaaattaaagatacatttgatcgtttgggtgtaccagaagctgaacgtaaatatttagctggttcttctgctcaatatgaatcagaagttgtttaccataatatgaaagaagactttgccaaaaaaggtatcatatttatggatacagattctgcagttcaagaatatccagaattagtaaagaaatattttggaaagttaatcccagcagatgataataaaatggcagctcttaatacagctgtttggtctgggggaacatttatttatgtacctaagggagtaaaggttgaaacacctattcaaagttacttccgaattaatgccggaaattcaggacaatttgaaagaacactaatcattgtcgatgaaggtgctagtgttaactatgtagaaggttgtacagctcctaattattcacaagattccttacatgcggcagttgttgaagtaaatgttttgagggatgcttattgccgttatacaacaatccaaaactggtccaacaacgtatatagtttggaaacaaaacgtgccagagctttggaaaatgctactatggaatgggtagatgggaatcttggttccaaggtaactatgaaatatccaagtatctatttagatggcgaaggggcacatggaaatatgttatctattgcatttgcgggcaaaggtattgactctgatactggtgcaagaatgattcataatgctaagaatacatattcgtcaactgtatcaaaatctctctgtaaagatggaggaattgctgactatcgtgggtatgtaaggtttaatagagatagtgatggttcgtttgcgcacgttgaatgtgacactatcattatggatgatgagtcttcaagtgatacaattccatttaatgaagtattaaatagtaatgtatcaatggaacatgaagctaaagtttcgaaaatttcagaagatcagctttactatttgatgagtagaggtatttctgaagaaaaggctactgaaatgattattatgggatttgttgaaccatttactaaagaactaccaatggaatatgcagtcgaattgaatagattgattgagtatcaaatggatggtagtgtaggttaa

SEQ ID NO: 1345 - DNA, 1236 bp, Unknownn
  isolated from dental, unidentified
atgacaattccaaattttaaagaaaaactacaaaaatatgctgaattaattgttaaagttggtgtaaatgtccaaccaaaccaaccagttgtattatacattaacgttgaacaacaagaattagctcacttaattgttaaagaagcatatgctgctggggcaagtgaagttatgattaagtggtcagatacatttacttctcgtcaatttttagaatttgctaatcaagaacgtcttgaaaatattcctgactatcttgtaaaagaagctgaatatattgctgataataaagctgcacgtatttctgttatctctgaagatcctgatgcttttaacggattagatcataatcgtgtatctacattccaaaaagctaatggtaaagctttaaatgttgtacgaaaagccactcaaaataacgatttaagctggactgttgttggtgcagctggtgttaaatgggctgaaaaagttttccctgatttaaagggtgatgcagcagttgacaaattgtgggaagaaatttttaaaactacacgcatcgatcaagaagatcctattgctgcttggaagaaacatgatgaaactttacgtactaaagctgattggttaaataaagagcaatttaaagctcttcattacacatcgccaattactgatattactgttggacttccaaagaatcatatttgggaaggtgctggcagttataacgctgctggaattgagtttatggcaaatatgccaactgaagaagtcttcacagcacctgatgctcgtcacattgacggttatgtcggttcaactaaacctttgagctatgctggtaatatcattgaaaatatgcactttgaatttgaaaatggcaaagttactaaagtcacagctgataaaggacaaaatattttagaagaacttatcaaaactgacgatggtgctacttcattaggagaagtttcattggttccagatccatcaccaatttcacaatctggtattactttctttaatactttatttgatgaaaatgcaagcaatcacatggctttaggtgctgcttatcctttctcaattcaaggcggtactaaaatgttggacgaagaattaaaggaacacggcatcaatattagtcaaactcatgtcgacttcatgatgggctcagctgatatggatattgatggtatcaaagaagatggtactgttattcctatttttagaaacggtgactgggcataa

SEQ ID NO: 1346 - DNA, 585 bp, Unknownn
  isolated from dental, unidentified
ttgaatagcgaaagaaaagaaaggcgggaagtacaacttgcaaaaaaggctgaaactatcgaagcagcagcaagtgaagtattagtaattaacgagacccgaataaaaattgatgggagaccttatgatttagttgagaattatcatgaaggttttaacgcagaacgattaggtgagagatttagccaaattttgactaaatatgattatattgtaggtgattggggatatgatcaattaagattacgtggtttttatgagattggtagcaagaaaggatcaccttatcaaagtatagagaggctagatgattacttatatgaatattgtaattttggttgttcctactttattcttcataatcttgaagtgcagacaccagagccaatacctgctaatattaggaagaagagttcaaagagaaaatcacaatctagttctaagaaacataactctaaaaataatgtattcacaaatgaaaagagatataatatacgatcacagaaaaataagaaaaatgctcatttgaagtctgtatcaaagaaaaatacaaagcatagacattttacaattaggcaaaaatag

SEQ ID NO: 1347 - DNA, 1038 bp, Unknownn
  isolated from dental, unidentified
atgttttgtggttatttcttaattaataccgtaaattatttaatagagcgaggttttattatgccagtttttgattatgaagatatccaattagttccaaataaatgtattgttaagagtagatctgaagtaaatacaaaagttaaatttggacctatgacttttaaaatacctgtagtccctgctaatatgcagactattattgatgaaaatcttgctgtttggttagctaagaacggttatttctatattatgcaccgtttttatgaaaatgaacgtgttgattttgttaaaaatatgcatgataaaggtctttttgcttcaatttctgttggagtgaaacctgctgaatatgatttgatcgacgaattatctcaaaaaaatttagttcctgaatatatcactattgatattgctcatggacattcagataccgtcattaatatgattaaacacattaaacataaattacctggtgttttcgttatcgctggaaatgttggtacacctgaagctgttcgtgaattagaaaatgctggagctgacgctactaaagttggaattggaccaggtaaagcttgtatcactaaattaaaaactggctttggaactggtggatggcaattagctgctattcgtgcatgcgctaaggctgctagcaaaccaatcgttgctgacggtggtattagaaataatggtgatattgccaaatcaattcgctttggtgcttcaatgtgtatgattggctccctttttgccggacatgatgaaactcctggtgatattattgaaaaagatggcaagaagttcaaaacttattttggatctgcttctcaatatcaaaaaggcgaatataaaaatgtcgaaggtaaaaaattacttctaccatataaaggaaaaatagccgatacacttcgtgaaatgcaagaggatttacaatctgctatttcttatgctggtggtaaagaattattagctcttagaaaagttgactatgtaattgttaaaaattctatctacaacggtgatatgttgtaa

SEQ ID NO: 1348 - DNA, 1512 bp, Unknownn
  isolated from dental, unidentified
atgagcattaaggctgaggaaatcagtgctctgattaaacaacaattagcaaattatcaagatgagcttactgttgatgaagttggtactgttacttatgttggtgacggaattgctcgtgctaatggtttagacaatgcgcttgctggcgaattggttgaatttgatgatggtacttacggtatggctcaaaaccttgaatctaatgatgtaggtatcattattttaggttcttttaagggaattcgtgaaggagatactgttaaacgtacaggtcgaatcatggaagttccagttggtgaagagctaattggtcgagttgtaaacccattaggacaacctattgatggtttaggtgaaattaaaacaaataaaacacgtccagttgaaagaaaagctccaggtgttatggaacgtcaatcagttacagaaccattacaaacaggtttgaaagctattgatgcattagttccaattggtcgtggacaacgtgaattagttattggtgatagaaagactggtaagacatcagttgctatcgatacgatcataaatcaaaaagatcaagatatgatctgtatttatgtagctattggtcaaaaggactcaacagttcgtacgtctgtagaaactttacgtaaatttggtgctatggattatacaattgttgtttctgctggcccatcatcaccagcaccattattgtacctagctccttatgctggtgctgctatgggtgaagaatttatgttcaatggtaagcatgttttgatagtatatgatgatctttcaaagcaagctgatgcttaccgtgaattatctttgattctaagaagaccacctggtcgtgaagcttatcctggtgatgttttctacttacattcacgtttattagagcgtgctgctaagttaagtgacgaattaggtggaggatcaatgacggcattgccgtttattgaaacaaaagcaggggacgtttctgcttatattccaactaatgttatttctatcacagatggtcagattttcttagacagtgatcgtttctattcaggtattcgtccagctattgatgctggtacatctgtttcacgtgttggtggtaacgcacaagttaaagctatgaagaaagttgctggtactttacgtacagacttggcatcttatagtgaattagaatcatttgctcaatttggttctgatttagatgaagcaacacaagcaaaattgaatcgtggacgtcgtacagttgaagtactaaaacaaccacttcataaaccacttcctgttgaaaaacaagtattgatattatacgcattaacacacggattcttagatccagttaaagttgatgatattttaccatatcaagatggtttatttgattattttgatgcaaatcataaagatttacttgacgaaatagcaaatacaggtaaactacctgaaactgaaaaattagatgctgcaatcaaagaatatgcagctacattccaagctagcgaaaaataa

SEQ ID NO: 1349 - DNA, 1287 bp, Unknownn
  isolated from dental, unidentified
atggaaactatcaatatcggtattttaggtttaggtacagtaggtagtggtgttgttaggattttacaaagtcacgcagataaaatctcaagcattactggcagaaagttaaaggtaaaaacggtagttgtacgtgatatgactaagaaaaggacagttgatttagatggggtaaccttgactgatgattttgaaatgttgatcaatgacgattcgattcaaatggtagtggaagtaatgggaacagtagaaaaagcacgtgaatatattaagcgtcttttagaagctggcaagcacgttgttacagcaaataaagatttgattgcgacatacggcccagaacttacaaaactagccaaggaaaagaaatgtgatcttttctacgaagcaagtgtagctggtgggattccaatcttacgaacaatcgtcaattcatttgcggctgaccaaattgtatcagttaagggaattgttaatggaacgacaaactatattttgacacagatgaatcaaaataatattgcttatgaggaagcgttaaaagatgcacaagaattaggttttgcagaagcagatccaactaatgatgtcgaaggaatcgatgctgcatataagatgataattctgacacagtttgcttttggaaaagatataactttagacgatgtgaagattgaaggaatttccaagatacaattatcagatatcaaagaagctaaacgtttaggatataatattaagcttttaggtgtggcagaaaaggtcaatgaccacattactgtatcagttggacctgtattagtacctcaaactcatccattagcaactgttattaatgaaaataacgctgtttttgttacaggtgttgcagtgggtgaaacaatgttttatggtccaggtgcaggcgaacttccaactgccaacagtgtgttaagtgacattattagtgtaactaaaaatattgtaatgggaattacaggcaacagttttaatgattattcacatgagattaaactagcaactccagacgaagtgaagaatccatattatatctcattaattgttccagacaagacaggggaaatgttaaaattaacagaattgtttactaatgtagaagcaagtttcaagttaattacacaaacagaagctaatgaaggctttgctaaaatctcaattgttactcatgcaatgacagaagctcagttattgaagattgaagaaggtcttaagcaagaaaaagacgtagaacttctagcagcatataaagttttagaaaaggggtag

SEQ ID NO: 1350 - DNA, 1977 bp, Unknownn
  isolated from dental, unidentified
atggcgatgaattttgatgataatgaagaattagtaaataagcaagttgacatgaatgcttattcgcataacttattaaaagaaaaatatcctacgaaacaagatgtgattaccgaaattatgaacttggaagcaattttgcatcttccaaagggaactgaacactttgtaagtgatttgcatggggagtatacagcatttgatcacgttttaagaaatggttctgggagtattaaacagaaaattcaagattacttttcagatagaatgacagaacaaacgatgcaagattttgctttgctaatctactatcctgaagatgaattggctctagtaaagaaaaaattacgtacagaaaatgagctacaacaatggtacttagataacatttcccacttattagaatttttagaattatcaggaagcaagtatacgcgctcaaaggttcgtaaagcactaaatcctaattttgtatacataacagaagaattattatataacgatccacaagaatttaataagagaagttatattaatcaacttttgaagaatattttgaaattagatcaagcaggtaaatttattattgctacctgttacacaattcaaagattagtagtagatcacttacatgttctgggcgatgtttacgataggggagaagaaccagacaaaattatggatagattgatgaattatcattctgtcgatatgcaatggggaaatcatgatttactatggctagatgcaatggcaggctcaaaactatgtatgttgaatttattgagaatttgtgcaagatataataacttgaacatcatagaagatgcttatgggattaacttacgtcacctttcgagatttgctgaggagcaatatgaggataatcctcaatttagacctaaattgactaatggtgatgggtatagattcaacggcgaaaagctacaaatcacgcaaattcatcaagctgttgcgatgatgcaatttaagcttgaagggaaagttatagctagaagaccagaattggaaatggatgatcgagatttacttaataagatagattacaagaaaaatgtaattagtttaaatggtaaagaatatccgttacaaaatacttgtttcaacactgtagaccctaaaaatcctagtgaattaacagatgaagaaaatgcgattgtagatgaattattaatttccattcaacattctacaaaattaaaacgtcatctagattttatgatgaataaaggtagtatgtaccgtacatataatggcaatctcttattccatggatgtattcctgcagatgaagaaggaaatttctgtagcttgaagattggtagtaaagaatattctggcaaaaaattgtttgatttttctgaaaaaatgattcgaaaagcttactctaatccaaatgtaaaagatgattttgccactgattttatgtggtatttatggcaaggagctctttccccactgttcggtaagaaatctatgactacttttgaacgttattttattgcagataaagcttgtcatgaagaagtaaagaatccatattataaattaagggaaaataaggatttctgcatcaaaattttacaagaatttggatttactggcgatgatactaatcatattatcaatggtcacactccagttaaaaggggacataatgcaatctgcgcagagggttatatgttggtaattgatggaggatactccaaagcctatcagccaacaacagggatcgctggatatacattattgtataattcatatggcttgcaactagtttcgcatcaaccatttacttcaaaacaagatgctattagaagcgggaaagatatcgtttcaacggttcgagtggtaaagcatgaattacaacgaaaatcggttgcggatactgatattggtgaaaatattaaagaaaaaattagagttttgtataatttattgagaaattatgattag

SEQ ID NO: 1351 - DNA, 1854 bp, Unknownn
  isolated from dental, unidentified
atgagaagattaaaaagaagccgatacattacgggatttgacggtattcgaacgctggcagttattgcagttattttctatcatttgtttccttacgcaatgcaaggcggcttgatgggagtttctatattcttcgttatttctggatatttaataactgatttgttgttacaagaatgggaacaaaatcgaaaaattgatgtcaaagctttttatattaggcgtatgaaaaggttgtatccaggattgataacaatgttagttggaacgatagcgtatataactttgtttcaaaaagagttattggctcatattcgaatggtttttctgacaaatttgacatcaatatataattggtatcaaattcatacgggtcaatcatattttgataaatttgcgattcagtctccttttacacatttatggtcgttatctattgaaggacaattctatttgttttggcctttattgattatattaatgtgtaaatacttacctaagaaaaatgttagattctttctgttaataggattgagtttactatcagctttagaaatgatgcttttatttaaggtaggtagtgatccttcacgtgtttactacggaacagatacacgtgtattttcgatattaataggtgcagctttagcaattgtttggccaagtagcaagttaagtcaaaagcttcctaatgagagtcgacgaattcttaacataacaggtattgtgtgtgctttattagtaatattatcattctttaaaatgaatggtgaaaaagcttttgtatatcatggtgggatgtacttattttcaataatctctgcaatacttgtcgcaacagtagcacatccgggagctaatatgaatacctggtttactaatccagtttttgcatggataggtaagcgtagttatggaatttatatttatcagtatccagtgatggttttctttgagtcaaaagttaagaatattgctgcacatccttggttatacggactaatagaaatagcaataatacttgctataagtgaattatcttatcgatatattgagatacctttgaaaaaatttgattacagtcaaactctaatcaaagttaaacaagtctttaaacgagataaatcacatttaaattccaaaattggtgtagctgtgggagtaattgtatttttgattgctggtgctggtttagtgcaacagccaactaagaaaccacaggataatgctttggcaaaacaaattaaagaaaacaacgccaaagttaaaaagagaaattctgagttaaagagtggtaaaaagcaatcaactgaacaagtttcctcatcttcgagttctgaagtgaagaagtatcagttaactgccgctcaagctgataaggcaagaaatatgaagattacagcagtaggagattctgtattagctgatggagctagttcattacaggaaattttccctaatatgtatatcgatgctaaagttggtagacagtcagctgaagcagcaaagatagtacaacaattagcacaaactggaaaattggaacagacagtgttgataagtgaaggaacaaatggtgcttttatgggacatgaaattcaagatattatggatgctgctggtaaagatcgccaagtatattggattaatgttcatgtaccaacaagacgttggcaagatcaagtaaatcaagatttggcatcagctagcaagaaatataagaatttacatataattgattggtttagctatagccaaaatcatgctgattggttctataatgataatgttcatcctaatccacatggcttggaatattatggcagttttgttgctaaaaaaatagttaaataa

SEQ ID NO: 1352 - DNA, 1092 bp, Unknownn
  isolated from dental, unidentified
atgtatagaattatagcatctctatttgcaacaatgattctatcagctattttgactccgtttataagattgttagcatttaaagtaggagctgttgacaatccaaatgctcgtcgtgtaaataaggttcctatgccgacaatgggtggattagctatttttctagcatttaatgtgactaattttcttttattgagaaagcaatacccaatcgaacaattgtgggcattattgttagcagaatgtataattttagctactggaataatagatgatatttatgaattaaaacctagacaaaaaatatatggaataactttagcagctttagtagtattttttattgctaaaattaaaatgacaactattacattgccatttttaggtacagtaactttagggtggttaagtttaccaataacactaatatggattttagcaattactaatgcagttaatttaattgatggattagatggattagcaactggagtagcaattattgctttatctaccagtgcagttacagggtatttctttttaaatgtaactaatacttttatatcaataatgatgtttacgttagtagcagcattgataggatttttgccatataattttcatcctgctaagatatatttaggtgatacgggatctttatttataggtttcatgatctcggtttttgcattatatggtttgaagaatgcgacatttattacaataataattccagttattattttaggagtaccaataactgatactgtttatgcaattttacgaagaattttaaataaaaaaccaatttcacaagctgataagcatcatttgcatcatagactaatgcaaatgggattgagtcatagacaaaccgtattagttatttatggaatagcattgattttttcatctatttcattgctatatcctatttctagtttttggggttctgttttattgacggtggccacactattgggattagaaattttcgttgaggttattggattagttggtgaatcacgacgtccattattgaattttattaaaaaaatagttctcttgtctgaaaataaaatagaaaaataa

SEQ ID NO: 1353 - DNA, 1608 bp, Unknownn
  isolated from dental, unidentified
atggaaaaaatgacggaaaaacaaagaatattctgcagtatatacccatatacgacaaaatatatagaggcttttaataatgaatattccgataataatttgagagatgaagttattgattatttaaataaggtaattcataagtttagcaatagtagtgtttctcaaagcatagatataaatatttgtttagtttctaatggaaaagaacagtcagaagtttttttagatatcttatataaactcattaaagtgctcaatcctagttttggtgataagacttatattatgcctgatcaatatgaatatctggaaagtgtagaaaataatgcatttataataattcaagatgctaagtctgcctttggtggagatttacctgaagatagacgcggatataagatcgattataaaaactatataatggaaatacttgaaagagctgatagtcaaaaagtaatcttgttagaagatacggaagaaaatattagctatataaattctttagaagaagtgaaaaacaatcttactaattatttcgtaattagagatttgacaattgaagaagctatcaattatggcaagagtctcctatataatcaaggtctaagtttagaagatgatattttatatggaaatgtattaaagtcatatgtgcaaaaaagcaagcatttgaccaagcgtgttgttgaactttttaataaaaagatattaaatagttttgctaaaaacagtagaatgtcgaatgtaattgacaaaaaatcaatcttggatgccacaagtgtatataatcctaagttagttaaacaaatcttggatgaattagatagtctacaaggattggataatgtgaagcaacaaattcatgagatttgtgaggcagtggaagtttcacaggcaaatattggaaatatggaattatctagaagacatcatatgatttttgaaggaccacctggaactggtaaaacgacagttgctagaatagttgcacgtttattctatgcactaggaattttagaaaatacaactgtagttgaaactaaacgtaatgaattagaaggtaaatgggttggtgatttaagtggaaaaatcaatgaaaaagtagattctgctttaggtggagtacttttcattgatgaagcccatcaactttataataaagaagatccttatgacaaagggaaacaagttattcaggcatttgtacctcgactagaaaatgacggggaaaagtttatcgcaattatcgcaggatatactaaagaaatggaagaatttttgaaatttgatccaggattggcttcccgttttcaacataaaataatttttgaatcatataagccccaggttgtagctcaaatagtagttaatattttgaagaagaacaaaatagagtttaatgaaaaatatgtaaaagcagtggcaattaatctgtatgatcaaattccagatgataaaaagtctaatgcacgttgggcaagaaactatgctcaaaaattgatagaaaagcaattgagttattgtgctaagcatccacaatttcctagaaatagattgtttaatgaagtcctaagagatagtgttaattggcaaatagggggttag

SEQ ID NO: 1354 - DNA, 555 bp, Unknownn
  isolated from dental, unidentified
atggaaaaaattattgataatttaatatcaaaagataacttatttaaaactttagaaaatcgttttaataaaaatatttatcgccatcctaatataaaatgggatgaaatcgcgtctttattagaaaatgattccgagaagatttctagcttatcctaccttgaaactagtgggggagaacctgatgttactgagatcaataaccagattgtttttattgatttttgtaaagaatctcctaaagaacgcagaagcttgtgctacgacaaatctgctcgtgttaatagaaaaaaattcccacctgtttctagtgcttatgaaatttgtaagcaatggcaagtggatctattaaccgaagacgactatcatgtactgcaagaaatccaagctgtcgatcttaaaacttctagttggttatttacacctgataacattcgccaacttggtggtgcaatttttggtgatcgacgttatgatacaactttcatttatcacaatggtgcagattcctactatgctagtcgcggctttagggctaaattaattttaaaataa

SEQ ID NO: 1355 - DNA, 2223 bp, Unknownn
  isolated from dental, unidentified
atgtttttgtcaggaatgaatgataaacaatcagaagcagttttatgtacagaaggaccattattaataatggcaggagctggtagtgggaagactcgtgtgttaactcaccgtgtagcatacttaattgaagaaaaaggcgtaaatccttggaacatactagctatcacctttacaaacaaagcagctcgtgaaatgagagaacgtgtaaataatttaatgggtgaaggtgcagaagatatatgggtatctacattccatgctttatgtgtacgaattttacggagagacgcagaaaaaataggctttaatagatcatttacaattgcaagtacaagtgagcaaagaactttaatgaaacaggttcttaatgatttaaatattgatactaaaaaatatgatccacgtgcaatcttaagtgtaatttcaaatgccaaaaatgacctattagatcctaaagattatgcccaacaagctaatggaccatttgaagaaattgtaagtaaagcatattttgaatatcaaaatcagcttgcaaataaccaagcaatggattttgatgatttaatcatgcaaactattagattattcaacgaatcaccagaaacattggaattttatcaacgtaaattccactatattcatgttgatgaatatcaagatactaacgaagctcaatatgaattagttaataagttagctcgtaaatatcgcaatttatgtgttgtaggtgatgcagatcaaagtatttatggttggcgtggtgcaaacatggaaaatatcatgaactttgaagaagattacccagatgcaacagtaattaaattggaacaaaattatcgttctacaaaaaatattttagcagctgctaataatgtgattgagaataacgtaaatcgtaaagataagactttatggacagataataagcaaggtgacaagatccattattatcgtgcaaataacgctaatgaagaagcttattatgtagttaaaaaaattcaagaacaaattagaaataatggacgtcattatggagattttgctattttatatcgtactaatgcacagtcacgtataatcgaagaaactttcgtgaaaaccaatataccatataaattagttggagcgcataaattctatgatcgcaaggaaataatggacactttagcttatttacgtttagtaactaatccagctgattctatgagttttgaaagaatagtaaatgaaccaaaacgtagtatcggctcagtaactgttggaaaattaagaacattctctcaaattcatggtatgtcaatgttagaagcttccaagagtgctgctttagcaggggtatctgccaaggcaagtaatgaattagaaaagtttgctgagatgatagaacagttacatgaatatcaaaaggcacataatgttactgaagttacagaaagaattctagatgtaacgggttataaagctaacttacaaagagaagatactttagaaaaccgtaatcgtttagaaaacttggaagaatttttaacggttactaagcaatttgatcaagattgggaacctgaagatgaagaaagtgatccatttgttgatttcttagctgatttagctttagtttcagatcaagatagtgtagaagaagaaccagatgaagtcacattaatgacattacatgcagcaaaagggctagaattcccagttgtatttttgatgggattagaagaaggtattttcccactttctagagcagttatggatgaaaatgaacttgaagaagaacgcagactggcttatgtaggaataactcgtgctgaagaagaactttatttaactaactctatttctcgtatgttgtatggtaagagtcaaaataatccagcttctcgttttattgaagaaattgatgaagaattaatccaatcagataatcaaacggtagcaagtacaacattaacatccaagagaactagatctagagaagtgccatttagtaagaagcctaaatatcgtatgccagcaggaactgttgaacgccctaaagaaactggtgctgacaaacaaagctggaatataggagataagatttctcataaagcttggggaacaggaacaattgttaaggtctcaggcgatggcgaagatacagaactagatattgcttttgaaggtaaaggtattaaacgattattagcagcattcgcaccaattacaaagatataa

SEQ ID NO: 1356 - DNA, 687 bp, Unknownn
  isolated from dental, unidentified
atgaattgtttattatgcaacaacacagttgattttaaactaaacatcaaatggatactatcgttaaaaaaatataagcgggataatgtttgcaaaaggtgtagagaagaattgagaaaatgtaaaatagccaacgcttgtgaaggatgtgggagagaacaaaaaaagttgttattatgtaacgactgcattaagtggaaaaataataacaaaatcttattgaataataagtcgatatatacatatgataatttaattatcaaaaaatatttcgaaagatataagtttatgggagactattactggagaaaaatttttaacatagagtttaaaaattttataacgaataactatccctctaaagattggatatatattcctattccagtggacgaatatacaatgcaacatagaggtttcaatcaagtagaaggattaataggagatctaccttattcaagagttctgaagatgaagaaattaaaaagggataaaaagcagtcagaaaaaagtagaagtgagcgtttgaaaacacaacaaccatttgaatacataggtgataaactacaaggaaattatgtcataatagatgatgtttatacaacaggaagaactctatattatgctcaagaattactactaaaaaatggagctagtagagtatgttcagtaactttagcaagatga

SEQ ID NO: 1357 - DNA, 1233 bp, Unknownn; identical to SEQ ID NO: 367
  isolated from dental, unidentified

SEQ ID NO: 1358 - DNA, 783 bp, Unknownn
  isolated from dental, unidentified
atggcaagtgcagtgttagcttcaattggcattactggaatgatgcaaaataagcatatttctaaaactgcgatgactgaacataagagtgttcagaaggctactgtgcaacacaatacatttttttcaaaagtaagtgcagatacaatcaatcaaacagcaattaagggaataagcaatagtagctcaccatttccaaatgttagtgtaaatgatttacaaatttcttctggaatgggttggcgtagcataggtggagttcaataccaccaaggttgggatttaccagctgtacaaggtactccagttttagctactaataacggtgtggttagttatacaggctttcttccagatcaaggtaatgtagttatcgtatatttccaagaatctaatacagctgtatatttccaacatctagcatctatcacagtatctaaaggtcaacaagtaacaagtggccaacaagtgggtactgtcggaggaacaggtgcttctccagattacaatagttatgctcctcatttgcatattggagcttttaagaatgcttcaaactacattaataatgcatacccaatgccatcattaccaacaaattctgaaactgctgcagcaactgattttatttcaccagctgaaatgttcggtgttgatatgaatcagaataattggattgatgaacaaacaaatatgtatggttctaatagtgaacaacccgcatcaatctcagatggcaacaactttgtaacagttggacaagcattacaacaaatacaataa

SEQ ID NO: 1359 - DNA, 738 bp, Unknownn
  isolated from dental, unidentified
ttgattacattatcgggtattattggctctggcaagtcaagtttaacagaaattttagcgaaagaattagggactaaagcatactatgaaccagtaaaggataaccctgtattaccaattttttataagggaaatgaaattgctgctaaaaagcgtgctgaaggggataaggaagcaactaatccatatgcttacttgttacaaacattctttttaaatcgtcgttttgcgatgataaagaaagctatgcaagatgataataacattttggatcgttcaatctatgaagacgaaatctttatgcatatgaacactgaaatggggaatgcaactcaagtagaatatgatatctataagagtttattgcataacatgatggaagaattaccacttgcttcacacaaaaaatcacctgacttgatgatcacaatcaaagtttcatatgaaacaatgattaagagaattgaaaaacgtggtcgtgattatgaattaattgaaaaagatccttccttggtagattactatcaaagactattgaagcattacgatatctggatgaaggaatatgatgcttcgccacttttgatcattgacggtgataaatacgactttatggaaagtaaggaagatcgtgttcaagttctagaaactgtagaaaataaattactcgaattaggtaatattagtgaagaacaatttgaacatttcaaaaagaaacatcaagcatttttaaattaa

SEQ ID NO: 1360 - DNA, 921 bp, Unknownn
  isolated from dental, unidentified
atggctgaaaagaaagttacattaagtaaaaaagatcgaatggctgtttgttggcgttcaacattccttcaaggatcatggaactatgaacgtatgcagaatggtggctgggcttactcaatgattccagctttaaagaagttatatactactaaagaagaccgtgctgcagctttaaagcgtcacttggaattctttaatactcacccatatttagcagctcctattttaggtgttacattagctcttgaagaagatcgtgctaatggtgctccagttgatgatgttgctattaacggtgttaaagttggtatgatgggaccgttagctggtgttggtgatccggtattctggtttacagctcgtcctattattggtgctttaggtgcttccttagctatttcaggaaacattgttggacctattttattcttcgtactttggaatgttttacgtattgcattcttatggtatacacaagaatttggttaccgtgcaggttctaagatcacagacgacctttctggtggattattgcaaaaagttactcgtggtgctgccatgatgggtatgtttgttctaggtgctttaattgaacgttgggtaagtattaaatttacaccagttgtttcaaagactcctgttcaaaaaggtggttacattgactgggatcatattcctagtggtgctaaaggaatcaaggaagttctaactcaatggaatatgggtaagggcatgtccttagataagattaaagttacaacattgcaagataacttggatcaattgattcccggtttagcagctttacttctaacattcttatgtatgtggttattgaagaagaaagtttctccaattgttatcatcttgggaattttcattgtaggtattattgcacacgttattggtttaatgtaa

SEQ ID NO: 1361 - DNA, 792 bp, Unknownn
  isolated from dental, unidentified
atggtagttgtattgtcagggtgtactccaaccactaaggtagatgctagtagcacgggattttgggatcattatattgtatggaatttcattcgtgctattcaaggattaagtcatatttttggaaatagctatggctggggaattgtaatttttacaattattgttcgtatcatcatcttgccgctaatgatttatcaaatgaagagtatgcgacaaacgatggaattgcaacccaaattaaaagcattgcaaggaaaatatcctggaaaagatatggaatcaagacaaatgttggctaaggaacagcaaaaattatattctgaagctggaattaatccttttgcaagtatgcttcctttaattgtacagatgccaattttgtttgctttgtaccaagctatttttagatcagatgttttgaagtcaggtacattcttttggatgcagttgggagataaagacccatattatatcttaccaattttagctgcaatttttacttggctaacttctaaattgaactcaatggcgcaacctgaacaaaatacaataacaacggtaatgacatggtctatgccgattatgatttttgtatttgcattgaatgttcctgctgcactttctttatattgggtaattactaatttattttcagcaggacaaacgttacttatcaataatcctttcaaaattagaaaggaacgtgaagaaaaagagcgtaaagagaaggctcgtcaacgtaaattggctaaagctaagcgtaaggcctacaagagtaaacgtaaatag

SEQ ID NO: 1362 - DNA, 1422 bp, Unknownn
  isolated from dental, unidentified
atgagcaaaccacaaattggtgttgttggtatggctgttatgggtaaaaacctagccttaaacattgaaagtcgtggatacagtgttgctatctataacagaacaggatcaaaaactgaaaaggtagttgctgatcatcctgataagaatttagtacctagttatacgattgaagattttgttaattctttagaaacacctcgtcgaattattttgatggttaaagcgggtgctccaacagatgcaacaattaagtcattattgcctcatttagataaaggtgatgttttaattgacggtggaaatacattcttccaagaaactatgcgtcgtaatgaagaactagataattctggtattaactttatcggtatgggtgtatctggtggagaaaagggtgcgctagaaggcccttctttgatgccaggtggacaaaaagaagcatatgatttagtagaaccaattttgaagaaaatagctgctaaggctgaagatggtgaagcatgtgtaacttacgttggacctaacggagcaggtcactatgttaagatggttcataacggtattgaatacggtgatatggaacttattgctgaaagctataacttaatgcgtaacttactaggtttatcaaatgatgaaatttctgacgtatttaatgaatggaaagatggcgagttgaagagttatttaattgatataactgctgatattttaactcgtaaagatgatttgggtacgggtaaaccaattgtagatgttattttagatcgcgctggcaacaagggtactggtaagtggagctctcaaagtgctttagaattaggagtaccacaatcattaattacagaatctgtatatgctcgttatatttcagcaatgaaagatgaacgtgtggctgctagtcaagttctacctaatccggaatttgatttaggtgacgtagacaagaaagaattagtagaaaaaattcgtcgtgcattatactttagtaagattatgagttatgctcaaggttttgaacaattaagagtagcatctgaaaattacaactggaacctaaattatggcgatatggctaagatttggcgtgaaggttgcattattcgtgctcaattcttacaaaagattactaatgcatatgaaaagaatcctgaattaaagaatttgatgttagacgattacttcaagaaaatcgttgaagaatatcaaaatgatgtccgtgatattgctgctttagcaattaaagcaggtgttgcttgcccaggattttctagtgctatcacatattatgatcaatatagatctgcacatcttcctgcaaatattattcaagcacaacgtgattactttggggcacatacttatgaacgtactgatcgtgaaggtgtttaccattacgaatggtatcatgaagaataa

SEQ ID NO: 1363 - DNA, 606 bp, Unknownn
  isolated from dental, unidentified
atgaactcagaaataacaaagtatctacaagaattaaaaaaatatttaagacgtttagatgatagtgagatcaaagatattgaggatttctacacagaatatttagaagatgcaggggtacaaacacgtgcagaaattgaagaaaaagttggaacacctagacaattaagtctacgaatattagcagattattcattgaaggatgatggtaaggaaagtggtggcattttacctaagacaaatatcaagactgcttggttaatcatcttggcattacttgcgacaccagcaactttaattataggggtagccttactaggagttttagtagcagcaattggtgtagcttttgcagtagcagtaacgattattgctttagctggagcagctatctttataactctaactagcttatatgtaggaatattcctattgtttacaaaattaggagtgggactattttatcttggaataggaattattggtattggagcattaatggttattctaccaataatttacttgataatagtaacagttgtaaaaatggtagcgaacttcattcgatatatttacagacgtttcaacaaaaagggggttagatag

SEQ ID NO: 1364 - DNA, 2937 bp, Unknownn
  isolated from dental, unidentified
atgtataaggccggtaaaaactgggttgtagcacctttagtttttttaggattggcaataggagttaatgttcataatcctaaagttatggctgatacaaatgttcaaagtcaaacagataataacaataacaatcaaactaacaaacaagaagtaacattacaaacaacacaaaatacagaatcaaaggcagttgttaatcaagaaattagcagtcaacaagcaaatgttgaaagtaatcaaagtgtagaaactaatacaaatgaaattgcaaatactactcaacaatcttctacaaatcaagaagcaaaacaggttacaccggtaactgtacaagctcaaagtgcctctgtacaacaatcaacttcagcaaataataatgtaactacacaagtggcagaaaataaagtagctacggcacctactacaccagcaactacttctgaacaaagcaaaaacactcaagtagttaacaatggagaacaaagtaatgctactcaaagttcgactacacaaaagagtgaagaacctaaagtagaaacaccagtaaatactgctgataatgctagtcaaaagaatattgatggtaactggtatttagtagataacaatactggcaagaatttgacaggattccaagaaatcaaagatcaaaataaagtagtttattatgcaccaagcaatgcgcaaatgcaatttggttggcaaaatatcaatagtaataaatattattttgataaatttagtggtgcgatgactacaggtcaaagaaatattgacggtagttggtatctatttgatgaccaaggagtaatgcaaacaggactccaaaatttagcatcatatggtcagaataaagtggtatattatgcctcaaatggccaaatgcaatatggtcaacaagtagtagaaaaccactggcgtctgtttgataaatatagtggtgccatgttgacaggcttccaaaacttagcaccatatggacaaaacaaagtagtttattatgatgaaaaaggtagaatgcaatatggactaactcaagtaaatcaaaaggtatattacttagatagagttagtggtgaagttcgtaaaggtcaacaagtggtgggaaaccattggcatttatttgataagaatagtggcgctatgttaacaggtttccaaaatttagcaccatatggacaaaacaaagtagtttattatgatgaaaaaggtagaatgcaatatggactaactcaggtaaatcaaaagatgtattacttagatagagttagtggtgaagttcgtaaaggtcaacaagtagtagggaatcattggtatttattcgataaaaatagtggagcgatgcaaaccggcttccaaaacttagcaccatacggacaaaataagattgtatactataacaaagatggacaattacaatatggtcaacaagctattggaaatcactggtatttatttgataaaagtagtggagcaatgcaaaccggcttccaaaacttagcaccatacggacaaaataagacagtatactatgcctcaaatggccaaatgcaatatggtcaaaaacaaattggcggacattggtatttatttgataagagtagtggagcaatgcagataggtctccaaaacttagcaccatatggacagaataaagtagtatattatgcctcaaatggccaaatgcaatatggtcaacaagtagtaggaaaccattggtatttatttgatagatatagtggtgccatgttaacaggtttccaaaatttagcaccatatggtcaagataagactgtatattataacaaagatggacaattacaatatggtagtcaagttattaatggtaaaaagtattattttgataagtcttccggtaagatgtatacgggtgtagcatataaccctgatacaaaaacaattcaatattatgccttaaatggtcaaatgcaagttggtaaggtaaatatagccggtaaagtatataattttgacagtaatactggtaatttgttaatgcaaggattagtaacattagatggaaagaattacttattagattctaaccataaagtgttgacgggccaacaagtggtaggaaaccattggtatttatttagcaagtatgatgggtctatgcaaacaggtttccaaaacttagcaccatatggtcaaaataagacagtatattatgcctcaaatggtcaaatgcaatatggtcaaaaagccgtaggaaatcattggtatttgttcgataagagcagtggtgcaatgcaaacaggtttccaaaacttagcaccatatggccaaaacaagacagtgtattatgcctcaaatggccaaatgcaatatggttggcaaaatatcaatggtaaagactactattttgatactatttctggtgctatgaaaactggaacagttaatatcaatggtaagaactatacgtttaattcagatggtacattgaaaaaagatacatggggctggccatttccatctgtaggacaaggtagctttacaggagctcaattatttggtgtaaatccaggtggagaattccgtatgaatggattccatgacggattggactttggttcttatgatcacccaggttcttcagtccatgctgtacacagtggtgttgttacacaaattggttatattgctggtttggaaaactacgttgttgttcaatcagacgaatatagctttgtttaccaggaagcattcagtaatcgtggtaatattaaggtgcatgttggtcaacaaattaatacaggtgacgtaattggttaccgtgacacatcacacttacacttaggtataactcgtgaaaagaatattatgagagctattgccaattcatttaacaataatggtacatggttgaacccattagagttaattaggaatggtattgctaatcagtaa

SEQ ID NO: 1365 - DNA, 3747 bp, Unknownn
  isolated from dental, unidentified
atggcgaatggatttaagtttacacctgctcaacagaaagcaattgaagatacagggaaaaacattttagtagctgcttcagctggatctggtaaaacaagagtcttggttgaacgtgttattaataagatcaaacaaggagtaagcattgatgaattattagtggtaacttttacggaagctgcagctaaggaaatgaaagaaagaattcaaattgctttgcgtaaggaattatcaacggctgactctgaagaagaaaagcgtagatatctaactcagttatcaaaattaaatgtagctaatatctcaacattacacgcattttgcttacagataattaagcaatattactatgtaattaatctagatccaatgtttagaatgctaacagaagatactgaagttgcgttgttacaagaaaatgtatgggatgatttgcgtgaaaaatggtatagcaaaaaaagtccagaatttaaaaatttagtaatcaatttttctagcgaccgtaacgatgatggtctaagtgaattagtgatgaaaacttatcaattcgctaatgccaatcctaatccagaagaatggctaaataatttagtaaatgaatatgagttaggtgatcaacctttgatggaaagtaatttctatcaaaataagataaagcctaatattttagatcaaattcaattagctaaagacaatttaaaacaaggaatggatgaagctaataagatagggttagaaaaactctatcaaacatttgaacaagattgcgtaacaattgatgagttacaagattttgtagttggatgtaaggaatggaataatttaaaaacaactttacaaaatttcaagtttaaacgtgctaaatctgatagaggtctagatgatgatcagaaaaagcaaaaagaaagaattaacaagactttacgtgatggcagtaaaaagattatagaagatctaagtgttaaatattttgctttacctgaagatgagatcaaagagctaacccaaaaatccaaacaaattgttgaaactttaagtgaagttgtaaaggaatttggatcagaattcagtaaagaaaaacgtagaagacatgtacttgattttagtgacttggaacatttgacactacaaatcctaaacactgatactcctgatggtagacgagttaaggaaagattgaaaaacaagttcaaagaaatcatggttgatgagtaccaagatactaaccaactccaagaaacaattttaacaacgattgcccacaagaatcctggcaatatgttcatggtaggggatgtaaagcaatctatctatggtttccgtttggcagatccgggattatttttgaagaagtatcaaagctttgcaactgatgataacaatgacgagcgaatcattcttgcagaaaacttccgttcaatggaaaatgtaacagcatttactaacttaatattctctcaattgatggatgaaaaagtgggagaaatggcatatgatgaagatgctcgcctggtttatggagcaaaatattatccagaagaaacccctataaaagctgaagttttggtatatgaaagtgaagattctagtcaagaaagcgatgacgaacctgtaaatgaggacttttcaattgataataaagctcaaggccaaattgtcatgaccgccaagagaattaaagaattagttgaaaatggagaaaaaatctatgataagaaacaaggggctattaggccaatcgaataccgagatattgcaattttagctccaactcgtaagaataacttgattttgacagaagaatttaagcgtctaggagtaccaatttttgttcctgatgcacaaaattatttccaaacaactgaattaaaaataatgatgtcattcttacaaataattgataatccttaccaagatattcctttagtagcggtattacgttcgccaattgttgggttaaaagaaaatgaactagcctatctcagaattaatgataaaactggcgattacttccaagcagtagagagtttctacgataattttgaagtcgagaaagcttcagcatttgcccaaagcttgtatgaaaagatcgcgattttcttgaaacaattaactgaatttagaaatatggctcaacaaaatgagttagcaagtttaatttggaaaatctatgaagaaactggtttccttgattatgttggaggaatgccaggtggtttgcaacgtcaagctaacttacatgctttatatgaaagagctgcagaatatgaagaaatgagctttaaaggcttattccaatttgtacgtttcattaacaagatgcagactaaaaataaagatttgtcagaagctacaacgcaagtttctgatgatgcagttacagttatgactattcatggtagtaagggcttggaatttccggttgttttcttattggatgctactcacaaatttaatgtgggagatttgaataaaccatatttgttgaatgcagatgatggaataggaatttcttatcttgatcctgatactcgagtaaagacagatactttgatgaaagtaattgccggtgaacaagcattgaagaaattagcagctgaacaaatgagattgctatatgtagccttaacccgagcagaacagcaattatttatcgttggctcatataaagataaaaatgaagctttgagtaagtgggagaaagctacgcaaagtgagtcactagtcttaaatgcaggtgttagggcatcggttagaaacttcatggactggattggtatgtgtctaacaagaagtgagatctttaaagaagttgatgatacagtagatacaagggagccagcatatgtaggtgaattaccggtaaaatttgcagttaaattctatagtaatcaggatctacgtgaagaaaatattactttagatgagaatggtgaatcttggttaaaacaacagcttaagaagatagaaggacaagaacctttagaaattaatgacaagcaatatagaattattgataaaattctacaaagtaagtatcctaatgaatcattaactaaaacgactgcttaccaagctgtgtcggatttaaaacgagcttttgatgatccagataacaatatgatgcaaagcttggagattgattggcaagatcaagcaccacaaggaattaatagatatgtgcaaggtgagttgaaattacctaagtttatgacgacaaaagtaaaagtatcacctgcgcaagtaggtactgcaacacacttgctattacaaaaattaccacttgatgatgaagtaacgcttgaagaattgatgcaactactatcacagttggtagaagataaattgatcacatcagaagtggctaaggaaattaatttagatcaaattaagaatttctatgctagtgatttaggtaaaacagttctagagaataaagataaagtaaaacgagaattaccatttgcgatgatcatacctgccggaagattatttagtaatgtagataatgatgtggaacagccaattctagttcatggtattattgacggattaattgagctagatgatgaagttattacctttgactataagactgaccaccatacttccgaagataagttgattgaaaattaccgtggacaattaaacttatatgcaatggcggttgaaagtatgttgaataagaaagtttcacaaaaaatcatatactctttagatttaggaaaaagcattgttctttaa

SEQ ID NO: 1366 - DNA, 2418 bp, Unknownn
  isolated from dental, unidentified
atgtcatataagcatattgaaatagaaaaaaagtggcaaagatattgggaagaacacaaaacattcaaaacaactgaagatgatgataaaaagaattattatgccttagatatgtttccatatccatctgggcaaggacttcatgtaggtcatcctgaagggtatacagctacagatataatggctcgtatgaagagaatgcaaggatataatgttttacacccaatgggatgggatgcattcggtttacctgctgaacaatatgcgttgaatacaggaaactcaccacgtgaatttactaaaaaaaatgttaataattttagacgtcaaattaaatctttaggtttatcatatgattgggatcgagaggttaacacgacagatcctgcatattataaatggactcaatggatttttgaacaattatataaaaaaggtttagcctatgaagctgaagttccagttaactggagtccagatttaggaactgttgtagctaacgaagaagttattgatggtaaaactgaacgtggtggttttcctgttattagaaaaccaatgcgtcaatgggtattaaaaatcacggcttatgctgatcgcttaatagatgatttagacgatttggattggccagaagcaattaaagaacaacaacgtaattggattggtcgttcagttggtgcagcaataaactttcctgtttcaggagatgaaaatacaaagattgaggtattttctactcgtccagatacaatatttggtgttgcagctttagtattggcacctgaacatgaattggttaagcaattaacaactcctgaacatgaaaatgaggtagaagcatacatagaaaaaatatctcataaatcagatttagaaagaacagatttagctaaagataaaacaggtgtatttacaggtagttatgttgtaaatcctgtaagtggagaaaaattacctatttggattgctgattatgttttaaattcatatggaacgggtgcggtaatggttgttcctgcacatgatgaacgagatcatgaatttgctcaaaagtttgatttgcctatcgtacaagttatcgaaggtggagatgttcaaaaagaagcatatactggtgatggagttcatatcaattctgatttcctaaatggcatggataaagaagaagccattgatgctataaataactggctagaagaaaatggagtaggggaaaagaaagttaactatcgtttaagagattggttattctctagacaacgttactggggcgagcctattcctgtaattcattgggaagatggtgaaacaactttagttccagaggatgaattacctttatatttacctaaagcaacagatattaagccatcaggaactggtgaaagtccattagctaacttagatgattgggtaaatgttgttgatgaaaatggtagaaaaggacgtcgtgaaactaatactatgccacaatgggctggtagttcctggtacttcctacgttatatagatccacataacaatcatgaagtagcagattatgaaaaattaaaagaatggttacctgtaaacttgtatgttggtggtgctgaacacgctgtattacatttattgtatgctcgtttctggcataaattcttatatgatttaggtgtagttccaactaaagaaccattccaaaaattagtaaaccaaggaatgattttaggttctaatcatgaaaagatgtccaagtctaaaggaaatgtagttaatccagatgatattgttgaacaatatggagcagatacattacgcttatatgaaatgtttatggggcctttagatgcgtctatcccttggagtgaagaaggacttggtggcgcacataagttcatcaaccgtgtttggaatttattgattgatgaaaatgacaatttacgtgatagagtaactacaattaacaatcatgatttagataagatatataatgaaactgttaagaaagttacagaagactatgaggctatgcactttaatactgcaatttcccaattaatggtctttgttaataatgcttataaagcagattcattaccattggaatatgtagaaggcttagtaaaattgttatcaccagttgttcctcatattacagaagaattatggtctaagctaggtcatgtaggtagcatagcgtatgctaagtggccaacctatgatgaaagcaagttggttgaagatgttgtagaaattgttgttcaaattaacggtaaagtaagacaacatctacaagtatctaaagatgctagtcgtgaagaattacaagcactagctttgaacgacgaaagaataaaacaagaacttgcagataaagaagttaaaaaagttattgcagttcctggtaagttagtgtcaattgtagtagcaaaataa

SEQ ID NO: 1367 - DNA, 1335 bp, Unknownn
  isolated from dental, unidentified
atgagttatgttgatgacgtttattcaagagtagtagaacaaaatcctagtcagcctgagttccatcaagctgttaaagaagtattagaatcattaagaccagtaatcgaaagtgatgaagaaaagtatcgtaaagaagctttattggaaagattaacaactcctgaccgtcaaattctattcagagtaagttgggtagatgataatggacaagttcaagttaataatggttatcgtgttcaatttaataatgcaattgggccttataagggtggtcttcgtttacatccatcagtttacctaggtattattaagttcttagggtttgaacaagtatttaagaacgcattaacttcactaccaattggcggtgctaaaggtggttcggactttgatcctaaaggtaagtctgacagagaagttatggcattctgtcaaagtttcatgactgaactttataaatatgttggagctgatgttgacgtaccagctggtgatatcggaacaggtgctcgcgaagttggttacttatttggtcaatataagcgtctaaagtctacatatgaaggtgttctaactgggaaaggcttgacctttggtggttctttagctcgtactgaagcaactggttatggattactatatctagttgaagaattattaaaagatcatggtaaagacttgaaagataaagttgtgacagtttctggtgctggtaacgtagctatttatgcaattgaaaaggcacaacagttaggagctaaagttgtaacatgttctgactctaatggttgggtatatgacccagaaggaattgatgttgaactgttaaaagatgttaaagaagttaaacgtcaacgattaacagaatatgcagcacgaagagaaagtgctcaatatcatgaaggtcgtggggtatggtcagttaaagctgatgttgccttaccatgtgcaactcaaaatgagttaaatttagatgatgctaagaatttagttgctaatggtgtacttgctgtttgtgaaggtgcaaatatgccaactacattagacgcaacaaagtatcttcaagaaaacggggtactttttgttccaggtaaagcaagcaatgctggtggtgttgcagtgtcagccctggaaatgagtcaaaattcagaacgtctaagctggtcattcgaagaagtagatggcaagttaaaggatatcatggttaacatttatcataatattgatgaagctgctaagaaatatggtttagatggagactatgtagcaggtgcaaatattgctggcttcttaaaggtagcagaagcaatggaagcacaaggtgtagtttag

SEQ ID NO: 1368 - DNA, 963 bp, Shuttleworthia satelles
  isolated from dental, Shuttleworthia satelles
atgaaatttacagttgttggtgcaggtgcaatgggacttagatatggtgtattacttcaacaagcaggaaatgaagttgaatttgtagatgcttgggaaccacatgttaataaaatgaaagaacaaggtggcgtttatgttactagagataaggaaaatcgtcatttagttcctgtcaaagtatataccccagaagaatatcataatacagactctgatgttgttattttcttcctaaaacaaatgcaacttggtgaaatgcttgaaagatgttcccatttctttacagacaaacaatatgctttgactggcatgaacggtatgggtcatattgaaaaactactaaaatactttaaacctgaaaaagttttagcaggtactgcccttgttgcaacaattctaaaagcacctggagaagtagatttcgttggtaagcctggagctggatctatgaatttagctaactacacagaaaaacctgatgagatgacacataaagttgtcgctgaattagaaaaagctaatataaatcctactttgactacaaactttagaggtactcttatggctaaagttgtgtttaactcagtggtcaatacgctatgtactttatttgaaataactatgggagaatatgctaatttcgaaaaggcagatgaactatcccgtgcattaattgacgaagcttatgacgtttgtgagcgcgatggcgtaaaaatgctacaaactagagaagaagaattggctactgtcaactatgtaagtaaagttgctaatccactccattatccttcaatgtatcaagatatgagtaaaaatcgccctactgaagtagattacatcaacggatatttagtaaaacttggacgtaaacataattacgaagctaaaacacatgccttcttaacaaacttagttcatctagcagaacatactcgtcaagaaagattacgtgaaaaataa

SEQ ID NO: 1369 - DNA, 1518 bp, Unknownn
  isolated from dental, unidentified
atgggaatttcaactagcgataagccatatttagaaagaattgaagatgcaaaaagcgatcattttatgcaagctgccgtcgctaaggcccaagacgctcaatttattaaacgaacaaaagcaagacgtgaaatgggaaactggaatgaatggcgtgatttggctgaacaaattagacagcatgttttaaaatatcttcctgattatttagaagaattttcgcaaaatgttgaaaaacaaggtggacatgtattttttgctcaaaccgaggaagaagcacgtaattttattaaagaattagtaattgagaaaaaagcaaaaaatgtggttaaatccaagtcgatggttactactgaaattgacttagacaagactttattagatatagatggggttaatcttttagaaagtgacttagcagaatttattttgcaagaagataactgggatgagcctacacatattgtttttccaactttacataaaaaccgtgatcaagttcaagaagagtttaagaaattgggctataccggagacaatgatcctcaacatgaagctcgttttgttagaggatacttgcgcgactactttatgaaagctgattttggaataactggatgtaattttgccgtagctgataaaggcatcattaatttagatacaaacgaaggaaatgctgatttaacaatggctttacctaaaactcaagttgtagtaatggggatggaaagaattgttccatctatgaaagaagctgaagttttagataacatgcttgctcgttcagctgtaggacaaaaattaacaacatattgtactttttctggtaaaaaagtcgaaggtgaagttgatggacctgaagatttttgggtagttgttttagataatggacgttcagatgcattaggaactgaatttgaaccaattttgcaatgtattcgttgcggtgcctgcatgaatgtttgtccagtatatcgtcatattggtggtaaaggatatggatctatttatcctggaccattaggtaaagttttatcgcctattttaggtggttatgaagaatttgaagatttgccatatgcttgttctttgtgtgctgcatgtacagaaacttgtccagttaaaattccgctacataacttaattagaaaacatcgaattgtagagatggacaaaaagcatatggatcatagtatgactaacttaattatgaaagtaattggtatgggaacaggttctccattcttattccaatcagcattaaaaatggaacatgctggcttaggtatgtttggaaaagcaaaaaatgatcaagatgttgatggaacaatttatgaaaatggcaagattaagaagttaccgaaaattgcacctaaattggttaaaggatggtctgatatccgtgatattccagttccccctaagagtaaagataacttcagaaattggtataagaatcatcaaccagttgagtcagtagtaagtattagacaaaagggggaaaagggtgatgagtaa

SEQ ID NO: 1370 - DNA, 957 bp, Unknownn
  isolated from dental, unidentified
atgacaaatattgtatttatgggaacaccagcttttgctgcaccaattttagaaggaattattgaaaatggttataatattttagctgtggtcacacaacctgatagacctgttggaagaaagagagtactacatgcctcacctgtaaaagaagttgctttgaaatacggtataaaagtatttcaaccagtaaaattaagtggcagtgatgaaatgcaggaaataatagacttacaaccagatttaatagtaacagcagcatacggtcaatttttgccaacaaaattaattgaaagtgcaaaaattgctgcaattaatgttcatggatcattattgcctaaatatagaggcggtgctcctgtacaatattcaattatgaatggtgatgataagacaggtgtaactattatttatatggttaagaaaatggatgctggggatatgctagctcaagctgaattaaaaatagaatctacagatgatactggaactatttttgaaaaaatgagtattttaggaagagatgtgcttctagaaacattacctaaaattatttctggtaatgttgaagctgtaaaacaagatgaaaataaagttgttttttcacctaatatcaaaccagaagaagaaattttacacttaaatttagaagctaaagaaattgattggaagacgagagcattacgcccagcacctggagcttattttaaaaatttcaaaggaaagagaacgaagttatggagtattaaaccacttgaagaaaaaacagaattcgctccaggatacgttgtgaatgttgataagcatgagttaaaagtatctgcatataatgggactgtttattcaattattgaattacaaccggcaggtaaacaaaaaatggatataacttcatatttaaatggagttggacaaggattaaaaattggacaaaggataattgaagatgaagaataa

SEQ ID NO: 1371 - DNA, 726 bp, Unknownn
  isolated from dental, unidentified
atgacaccagaagaattccgtcaaagtttagcagaacaaggattgaatctaacagatgaacaaatgcaacagtttgagctgtattatgaatttttagttgaaaccaacaaaaatttgaatttaacagcaatcactgaaaaaaatgaagtgtatctaaaacatttctatgattctttattattagctttgacagtaaagaatttacaaacagaagagttaagtttatgcgatgtcggagcaggagcaggcttcccatctttaccagtcaaaatagcatttccacaattgaagattacaatagttgattcattaaataagagaattaaatttttacaagaattaactcaaaaactaaatttacaagatgttcattttcatcatgcacgtgctgaagaatttggtggtaaacgaagtgttcaccgcgaacgctatgatcttgtaacagctagagcagtggctagaatgtctgtattatcagaattatgcttaccactagctaaagttggtggaagatttatagctttgaaagcacaaaaatcagatgaagagctgaaggatgctcaaaaagcaatcgaagttttaggtgggaaagtagtagcagattacgctacagagttgccaaaaattcatgatgaacgtcatattattgttgttgcaaaaggaaaagaaactcctaaaaaatatcctagaaaagcaggaacaccagcaaaatccccaattgaataa

SEQ ID NO: 1372 - DNA, 1059 bp, Unknownn
  isolated from dental, unidentified
gtgacgaatttggaaacaacaaagattacacccaaagttttcattgatcgtgttttaggcggtactgccatcgggattatagttggtttaattcctaatgctgttcttgccgctatcctcaagatgttcggcactaatccttttgccgtacatttaggacaagcagcaattattttccaattaggaacacctttaattattggtacattgattgctcaaaagtttggctttgatggcatgaagatgaccgtagttggtggagccgcatttgtaggttctggcgtaattaaatacttcccagcgttgaataaaacaggtgcctatgtaggtgctggaacaggggatattattaataccatgttaacagcatcgattgcagttggattaattctgttgataggcgataaatttggatcagtagcaattgttttaacaccaattgtagtaggaacaggtgctggcttaattggattctatatgtatccatatgttacagcgataacttccgcaattggtaatgtgattaacacatttacagaattacaaccagttttaatgtgtattttaattgcctgctcttttgcagtgttaattatctctccaatttcaacagtagcgattgcaatggctatccaagttaacggcttggctgctggtgctgctgcaatgggagttgctgcaacaacacttgtacttgtagtaaactcatggaaagttaacaagccaggggtaacaattgcgattgccttaggtgcgatgaagatgatgatgcctaacttatttagacgtccaattatcttagtaccatgtttctttacagcaataatttctgcagttcctgtagctttgatgtcaatttcaggttctcctgcttccggtggttttggtttagtaggtttagtaggaccattagcatcaattgaaaaaggcttaggcgttgtcgcagcattgctagcatggttagttattccagttattgcgtcacttgtcggtcaattcttatttgaaaaagtatttaagttatatgaccgcaaagatgtttttgaatttttaggttag

SEQ ID NO: 1373 - DNA, 1026 bp, Unknownn
  isolated from dental, unidentified
atgagtaaatggaacagtattaaaatcgtaaaaggctcaggtggttggggtggtccaatcgttgtaacaccaacagaagaaaaacataaagtagtttatgtaacaggtggtaatagaccagatattgttgatacaattgttgaattaacaggtatggaagctattgatggttttaagacagcaattcctgatgaagaaatcgcattagcaatcgttgactgtggtggtaccttacgttgtggtatttacccaagtaaaaatattttaacagtaaatgttcttccaacaggtaaaagtggtcctttagctaaatacattactccagaattatatgtatctgctgtaactccaaagcaaatttcattagtaaatgctgaagatgcagaagcaattgttaaacaacaaaatgaaaaggctaccaaagaagaagttgcagatgataaagaagacggaatagatacttctaaaacattgacacaacaaggtcatggtggcggatttatcgctaagattggtattggtgtaggtaaagttgttgctacatttaaccaagctgctaaggaatcagtacaaacagttttgaatacaattattccatttatggcatttgttgctttgctaatcggtattatcatgggttccggtattggtaactggttcgctaaaatcatggtacctcttgcaggtaacgtttggggcttgatgattttaggtttcatttgttcattgccattcttatcaccattgcttggaccaggtgctgtaattgcccaagttatcggtactctaattggtgttgaaattggtaaaggtcatattcctccacaatatgcattaccagcattgttcgctatcaatactcaaaatgcctgtgacttcattcctgttggtttaggtcttgaagaagctaagccagaaacagttgaagttggggttacatctgtattgtactcacgtttcttaaacggtttacctcgagtatttgtagcatggttagctagtttcggattatattcaggaaaataa

SEQ ID NO: 1374 - DNA, 792 bp, Unknownn
  isolated from dental, unidentified
gtgttaacaagtaaagatattagtgtagttaagtatctatctaggaaatacgcagaagatacagtgaaagggttaggaatattatttggaatccatataattgggactatccttttaataatgatgtcaagttctgaagaaattcctagtattgcactcggattttggagcaattttccgttagcattttatttaatgggtgctttatttataatcagtgcgactaattacgagatattcgcatttttaaaccaaaatggaatttcacgtaaaacactatggaaaaataaaatgatagtgttagggttaggaactttaattttagtattaattggaactatatacgatgcagtagtatcaagtagtggaacgaatgatttgatagcaataacttatttaaaaggaactaatccagtagtaaaagcaataggaagttatctttttgatgtattagtaacttttatgacagtaacttggatcagtgcaatcggggcagcttgtgggctacttcctaaaaaacatcgcgcttggataatctttggaattgtaatggctgcatttttagtaattactagaattgtttcatggattgcgatgttaccatttgcttggacaagagttttcatggtagttgtaaaatatttcggcctattattgggtattagctatcatgggaatgaatatagttttaatttcttaccaccaattttaacagtgattgtattagcgattttaggagcaattttgacacgtcatcttttaatgaagatgaagattagaacggagggataa

SEQ ID NO: 1375 - DNA, 969 bp, Unknownn
  isolated from dental, unidentified
gtgttacaatatgtgtatcttaaatatggggtggcagagatgcagaatttagtaattttggactttggttctaattctacaaggttgtcgattaatgaagttagtgatgaaggtaagtaccaagaagtttttcgtactaaggaaatgacacgtatggcggaaggtatgggaaattctgaaaagaaagtgttgcaggctgacgcaattgaaagaacgctggatgctgttagaaaatttcagaaacattatgagaatttacctaatttaaagattaaaggaattgcaacagcggcagttagagtagctgagaataaagaagaatttttagagaaaataaagtctttgacaggtgtagaagtagaaattttatctggttctgctgaggcttactatgattatgtaggagtagctaattgtttagatgttaaggatgctgtcatctgtgatatgggtgggggtagctttgaggttattttgatgaaaaataaaaaggccttgaacctaatcagtattcagtatggagcagttagtttaactgagaaatttcaaacacaagataaaataaatgctggaaatttatttgagtttgaagtttttctccgagaattatttgctaaaaaactaccttggctatctgaagctaaagatttaccattggtgcttttaggtggggctaatcgtactgttgcgcgtaaaaaattgggcaagttagatgaaaaagatactactaatattcataacttccgtgtatataaagaagaatttcaaagaatatatcgtaagtggttagatatggacaaaactgagagagctacagatttaggggatgaaagtagtcgtgcagacatcataataggtggacttactcctgttatgcagttaatgttacaatgcgaaagtccatatgtgatgttttctgagagtggagtccgtgaaggtatcatctttgaattgttagctgaaaaatag

SEQ ID NO: 1376 - DNA, 1344 bp, Unknownn
  isolated from dental, unidentified
atggtaaaattcgactacacaaaagatgacattcgacgcattgcaaaggaagaaaatgtacgtttcttacgtttaatgtttactgatttatatggaacaattaaaaatgttgaagttccaattagtcagttagataaagttttagataataagatgatgtttgatggttcatccattgatggctttgtacgtattgaagaaagtgatatgtggttatatccagatttatcaacatggatgatttttccatggggtggagaacatggaaaagttgctcgtttaatttgtgaggtatataatgcagatcgcacaccatttttaggagatcctcgtaataatttaattagagtacttgatgaaatgaaggaaatgggctttacagaatttaatatcgggcctgaacctgaattctttttattcaaattagatgaaaaaactggacgtccaacaatccacttaaatgataagggaagttatttcgatttagctcctgttgatttaggtgaaaattgtcgtcgtgatattgtgttagagttggaaaatatgggatttgatgtagaagcttcccatcatgaagtagctcctggacaacatgaagttgattttaagtatgcggatgctttgcatgcatgtgataatattcaaacatttaaacttgttgtaaagactgttgcacgtaaatatggattacatgcaacatttatgccaaaaccattagatagaattaacggttcaggcatgcatttaaatatgtcattgttccataaagacggtaatgcattctttgatactaaaggtgaagaacaactatcacaagatgcatactacttcttgggtggcgtattgaaacatgcacgtaactttactgctattatgaatcctactgtaaattcttataaacgtttagtacctggatatgaagctcctgtttatgtggcttggtcaggacataatcgttcaccactggttcgtgttccaattgcaagaggaaattcaactcgcttagaattacgttcagtagatccatctgctaatccatatttagcagtagctgcattactagaagcaggtttagatggattacgtaataaaattgaaccagcagctcctgttgatagaaatatttatgcaatggatgatgaagaacgtgaggcaaataacattcaagatttaccatcaacattgcacaatgcattaaaagcattgaagacagataaggttgttcaagatgctatgggaccacatttatatcaaaacttcttagaagcaaagcgtttagaatgggatgcttatcgtcaagaagtttcacagtgggaaagagatcaatatttagaaatgtattag

SEQ ID NO: 1377 - DNA, 1398 bp, Streptococcus mitis
  isolated from dental, Streptococcus mitis
atggggattttaaatcgcattctaagaaaagaaagtctcgaacgttacttagattccgacaatcaccttgaacgcattatcggaactaaagatttaattgccatggggattggtgttgttattgggacaggtatttttatccttccaggaactgttgccgcaacacatagtggtcctgcgattactatttctttcatcctagctgcaattgtttgttctacttcagctttatgttatgcagaattttcatctgctttaccagttgccggaagtgcttattcattcggtaatgttatcttcggtgaactcataggttggattttaggttgggctttaattcttgaatatatgttagctgtcgccgctgttgcaactggatgggcttcatacttcaactcttttattgctggttttggaattcatattcctaaagcagtcagtggtccttttaatccatctcaaggtacttacgttaatttaactgctattttaattgtattgtttatttctttcttgttaagtagaggtgtgcaagcatctattcgtcttaacaacattatggtttatctaaaaattgcaattattttattatttgtcatcgttggtgccttttttgtgaaacctgctaattggaatccatatatgccatttggaatcaaaggtgtcttcactggtgcctcaacagttttctttgcttatttaggatttgatgttattgcttcatcagctgctgaagttaagaatccaaaacgttcaatgccagctggtatcttaggaactttatcaatcactactgttctatatattgctgtagcagctgttttaactggaatggtcaagtatacaaaacttgatgttggaaatcctgtatcatacgctatgcaactagctcaccaagattggtttgctggtatcatcgccttaggtgctttgatcggtatgtttactatgatcctttcaactacattctcatcttctcgcctaatttactcaattggtcgtgatggtttactacctgcttctttaagtaaattagatgaaaagacacatacacctaaagttgctctatatgccgtaacagttgttatagctttaactagtggatttgtttctttagaccaattagctaacctagttaatattggaactttagttgcttttaccgttgtttctctaggtgttattcctttacgtcgtcgtaaagatattgataacagcaaaggattcaaagttccattttatcctgtacttcctattgtttctgttgttttatgtttaatcatgctatctcaactttcattagaaacatgggttgcttctggtatttggttcttaattggtttgattatctacttcagttacggtattaaacacagtaagctttctggaaataaataa

SEQ ID NO: 1378 - DNA, 1092 bp, Unknownn
  isolated from dental, unidentified
ttggtaaacaaacaacatattaaaattttttctcataatgatttagatggttttggtgctccagttttacttaaaacacttcaaccatacttatttaaaaatgctacctttgacctaactacttgttcagctggaaatttagatagagagttatcttactggtttcgtcaaccttcattacaccaatataccgatgttttcatcgctgacatgacacctgatagtgactattcatttcaacaacttgaacaacattttccaaatcattggttaatttttgatcaccatgagagtgaagaaaaacttcgacaaaaatatcgtcaaaactgtattacacctactaatacagatattaatcctagtgcaacaagtttagtctgggattggataagtcaaaatgttaatttcagtaacattcctagtaaacgtcaaaatgatttacgttacttagtagaacttattcgtgcttatgatacatgggattggaaaaatgatcctaacatggacagtgctacacgtttagctgctgatgaattaaaccaattattctggttctatccattaagtcgttcagaaatgtttgtcactgaagtctttgggactagttgggaacaatatcgtcaaaataacagtcttttaattaacactttaaatggtagaagacaacgctatttagacaaacatctcaagagtgtgctcacatttgagctcgatggtcatagtttcggaattgtttacgctagtgattataaatctgaaattgcccattccttattaaaaaatcatccagtagatgcagctttagtgatcgacaatcgcagtatttccttgcgtagtaacggcaagctagatgttgcttctttctctgaaaagtattttaatggtggtggtcactcagattcagccggtggtacattagaatttaatcctgttgaaactggagaacaagctgtaattgatgctttaaaacaccaatttgaaatcaataaaaaactagagaagcaagaaaaagaagaaagtagcagtactttcgctgataatctcgatcctgaaatggctgctaaattggctaatctatttaataataattaa

SEQ ID NO: 1379 - DNA, 1647 bp, Unknownn
  isolated from dental, unidentified
atgagtacaattagtcattataaagaagtagatattaataaaaagaatcctctcctttcacaaattagaacgactgttgaaacagcattttatggtaacaattttgaaagagtaacagatatttcaaaagcatattatttagcaaaaaattgtcctagtacaattgtgacagatgttccaataaagcatacccaagaattagggttaccagtagattctaaaatgttagtaaataatcatggaaaaattgttggaagaacagcagctgcacgacatattattgggcatttaggagaagatactaacgaattagcaggagttcttagagatgcaatttttgaagctagtgacagaaaattctataagacagaagtttatgtaggattagatgaagattttatgttaaaatcacaccttgctgttccaaaaggttatgaatttaatatgttatcatatatgctaaattttcaaccagtaacttcagaatatgaaaaaatgtatcaagcttctcataaatatgaagaaggagacatttttatttatgctgatcctgaatttaaagatgaaaattatcctaatggtctagtaataattgatgctgaacataacgtagctgcaatattaggattaagatattttggagaattaaaaaaagcgacattaacattagcttgggcaatagctcatagacatggatatacagcttcacatggtggagaaaaagtatttagatttgatgataaagatgataaagtttttgcattctatgggctatccggttcaggaaaatcaacattgactcatgctaagcatggtggcaaatatgatattgatgttcttcatgatgatgcttttgtaatttcaagaataaatggaagttcagttgcattagaaccagcctattttgataagactaatgattatatgcctggttcaaaagaagcaagctactttaccacagttatgaatgtgggtgtaacgttaaatgaggaaaataagcgagttttagtaactgaagatttacgtaatggaaatggtcgtacaattaagtcaagatatgcttccttgaatagggtagataaagaaaatgcacctatagattctattttttggattatgaaagatgatagtcttccacctgttgttaagttagataatccaacgttagcagcaacttttggagtaacattagctactaagagatcaacagcagaaaatgtagtaaatgctgatagaaattctcttgtaattgagccttttgctaatccatttcgtgcatatccattagctgaagattatcgtgactttaaagagttatttgaaaaacgtaatgtatctggttatatagtgaatacagcatcttataacggtattgatattgataaagagataactttacaaattttagaagatatagctaatgaaaaagttaattgggaaaaatttggttctttagatggaatgtattacttaccatttgaaaaatatccagttgattttaaagataagagttacactgagaaattgaagagaagattagaaattagactggaatggattgaaaagtatgagggaaaccatcctgataatccattgccagctgaaataaaagattgtttaagtaatttaattaatgaattaaattaa

SEQ ID NO: 1380 - DNA, 717 bp, Unknownn
  isolated from dental, unidentified
atggaagaagaatatattcaaaatttgaaaaactatttagtggaattcgataaattaccaatagctaaaaagaaaataactgctttacttgaagtggataactgttataagaaaggtaatattccaactaaatcattgcctaatttagaatttacggaaacagagattttagaacatttaacagaattcccaaatattatggaactagagagtcatttactagattttagagaatatataattgaagaatatggaatctggcatatatattcgcaagagtggttacaagatttaaaatcttttttggcggatgaacaaacgttaatgattatggctggaaatgcagtgttagggaagtttttgaaaaatattatttgtactgacaatttagattggcgtcatcaagacaacgaacgtcctaatccttggacagatgtagagcagttggatgccttagaagcagtaaaaaagtatttaaataatgtgtctaatatcattatagaatggtgtccagatagtactgatacagatatcaaagtattgcattacctacgtcagaaaaaatggaagggaaatttgatagtacttggagaaaaacagggtgctacaaactcgaaagctttttggaaagaggctcatcttgaaagacctgttaacttgaatcaacatcataagccatttgattttattaaagatcaagtttatttagctaaataa

SEQ ID NO: 1381 - DNA, 1959 bp, Unknownn
  isolated from dental, unidentified
gtgactgaagaagaaagaaaagaaaaacttcaagaagaaaaggcaaaagaatatgatgctagccaaatacaagttcttgaaggtttagaagctgttcgtaaacgcccaggtatgtacattggttcaacaagttctcaagggctacatcatttagtatgggaaattattgataatggtatcgatgaagctttagcaggatttgctgatgaaattaatgtaacagttgaagaagacaatagcattactgtaaaagataatggtcgtggtattcctgttgatattcaaaagaaaacaggtcgtcctgcattagaaacagtttttacagtcttacatgccggtggtaaatttggcggtggaggctataaagtttctggtggtcttcatggtgtgggtgcctcagttgtaaatgcattatcaacaaatctagatgtaaaagtcatgcgagaagatgatgaaaacgtctatggtatggactttaaattaggtaaagtagctacctctatgacagttgtaggaaagtgtcctcgccatgaacatggaacgattgtccatttcaagccagatccagatatttttacagaaactacaacctatgacatcaatgtgttaactaaaagaattcgtgaattagcctttttgaataagggattaaagataacaattgatgataaacgtcaagaagaaccaacacatgaagaatttcactatgctggtggtattaagcattatattgaattcttgaataagggtaaggaagttattttcccagaacctatttatgttgaaggtgaacaaaatggaattacggtggaagtagctttacaatacactaatgatttccattctaacttgttatctttcaccaataatattcatacttatgaaggtggaactcatgaatctggatttaaaactgctttaacaagagtaattaatgattatggtcgtaaaagtggcttgattaaagaaaatgatgcaaatctttccggggaagatgtacgtgaaggcttaacagctgtagtatcaattaaacatcctaatccacaatttgaaggacaaacaaagactaagttaggaaattcagatgctcgaaaggttactgataaattatttagtgaaactttcaataaatttatgctggaaaatcctacagttgcaaagcaaattgtagaaaaaggacttttagccgctaaagctcgtattgccgctaaaagagcacgtgaggtaacacgtaagaagaatggtttagaaatttctaatttaccagggaagttagctgacaatacttcaaaagatcctgaaatttcagaattatttattgtcgaaggggactctgctggtggatctgccaagcagggacgttcacgtttaacacaagctatcttaccaattagaggtaagattttaaacgttgaaaaagcaacaatagatagaatcttggctaatgaagaaattcgttcgctatttacagctttaggaacaggatttggagaagaatttgatgtttctaaggcaaactatcataagttaatcatcatgactgatgctgatgtcgatggtgctcacatcagaactttgctattaactttgatatatcgtttcatgaaacctatgcttgacgcaggttacgtatatattgcacaaccacctttgtatcaagtgcgtcaaggtaagatgataaaatatattgattctgacgaagaattgaatgatgttttaggaagtttaccacctagtccaaagcctgttattcaacgttataaaggtttgggtgaaatggatgctgaacagttatgggaaactacaatgaatcctgaaaatcgtcgattattgagagtagaattatcagatgcagaagaagcaaatgaagtatttgaaatgttgatgggagatcacgttggacctcgtcgtcaatttatagaggataatgcaacatttgttaataacttggatgtttaa

SEQ ID NO: 1382 - DNA, 837 bp, Unknownn
  isolated from dental, unidentified
atggcgaaagtaattaaatataccaaagcttttaaaaaacagttcaaaaagcggcgccaagaccccaagtggcgttcaatatttaaaagttcactacctcaagagtttgatgatcaaaagcggagtccttggaaatatattattcagtgtttaattgaagataaaaccatttcagattatttttatacgcatgctttagaaggtgttacaatggaaaaacaagaaacgacaagaaagaaaaaaaggtttgatatgaaaaggtctttcaggcgaatttccgctgtcatagcaacgatggctttcacgacaggtctggccgcctgcggttcctcccagtcgactgccccatcggcgaacaaagccacttcctccgtcactgccccccagggctggaagaagttcacgtccaaggatctgggctattccgtctatttcccgggcgttccggagaaggacacctataaggatcccaccggcgcttatgcccgctattcgacggtcaatgacaagaatcacatcaactacgctgtgtccgtcaccaaattcacccggaagcaagtcgaagactccaaggggttcaatgacgcgcagaaacgtaaggtcttgaccaatgtcgctcgtcttctgcagattgacaagtattccttcaccaccgtggacgggcatatggccatttcctacaccggtcacgatagcgaggacccctcggtgatcatgcgtcgagaggtcgtttactcgtccgctggcctctatggcctcgaatcctttggaacttccagctcggaatacaagcagttcgtcgataccttccggctttccaaagatacgcaagaatga

SEQ ID NO: 1383 - DNA, 1923 bp, Unknownn
  isolated from dental, unidentified
atggctaagaaagtaaaaattgtttctccagcagcaggtaaagtattagcgcttagtgcaactaatgatgaagttttctccacaggtatgatgggagaaggctttggtttagaacccgttagtgaaaaagttgttgcaccagtttcaggtaagataactatggtagctgattctaaacatgcagtaggtattactactaaagaaggtttagaagttttggtacatatgggtatcgatactgtaggcttgaacggcgaaccttttgatttagccattcaagatggacaagaagttaaggcaggtcaagcattagctacaatgtccctagaaaatattaagctagctggcttagaaacaacaatcatggtaattataactaactccagcgataaattggaagggcttgatattgaagaaggtgaagttgaagctggtaaagaagttgcaacagcctacgttaaagcagctaccaagaaaaatggcaagttagattatgatgctttggcagatgtaattattgataatgtcggtggacaagaaaatgtaaatagcttagttcattgtatcactcgtcttcgtttcaacttaaaagatgagggtaaggctcatgatgatatcttgaaagatacagatggagtaattgacgtgttacatgcatctggtcaatatcaagttgttatcggaaatgaagttactaacgtttttgatgcagttatgaagaaaatgccaaatctagctgacgcaccagcagaagatacagctcctgttgatgatggtagaaatcctgttagtcgtgcatttggtaacttaattggtgttattactggttccatgagtccagtagttggggtaatcgcagcgtctggtattattaaaggtcttttagcattattaactttacctcaattaggagcattgcttgatgccaagagtacagcatacattactgttagtgcaatggcagactctgctttctacttcttaccagtcttggtaggatttgcggcagctaagcgtttaggtggcgatccaattgtagctgcagttattggtggggtactaacatatccacaattagtaacttggggtaaagcatttaaaggtatgtttacaatctttggaattaacttccaattcttaaactacacatactccattttcccaatgattttagctgcatggatggctaagaagttaggtgactggttgaagaaagttctacctagttacttacaaatgatcttcaatccattgattacagtattagttgtttcaacaatcactttagttgttacaggtccaattattcaaggtgtcgctaacggtatcgctgacttcatcaactggttagtacattcttccggttgggtaggtggcttggtaattggtggtttctatcaattactagttatcttcggtttacactggggcgttgtgccattggttgctcagcaaatcgcaggttctggcgaaagtgctttgaacgctattatttctgtaacaatggtttctcaaggggcagctgttttagcagtagctatcaagtccaagaagaatgacatgaagtccttaggtatcgctgcagcaatttccgcattctgtggggttacagaaccagctatttacggtatcaacttgcgttatcgtaaagtatttatttccggtttaatcggatctgctgtaggtggttttgttacaggtttaatgcacggatccatgtttggatttacaggatctctaatcggtttctcctcattctttgacttgaaacatcctagtgatttaaatagtttctatgcattcttaatctcaagtgctttagctttagtagtaagttttgtagtaacttgggtatggggatacagtgacgacatggcaatgggcaagaaagttgaaaagaagaaacgcccaggaacagtttaa

SEQ ID NO: 1384 - DNA, 2835 bp, Unknownn
  isolated from dental, unidentified
ttggctcaaaataaaataaaaattcgcggagcaagggcacataatttaaaaaatatagatgtcgatatacctaaagataagttggtagtagttactggtttatctggctcaggtaaaagttcattagcatttgatactttatatgctgaaggacaacgaagatatgtagagagtctctcagcatatgcacgtcaattcttgggacaaatggataaaacagatgttgattcgattgatggattatctccagcaatttcaattgatcaaaagacaacttccaaaaacccaagatcgacagtaggaacagttactgaaatcaatgattttttacgattattatgggcaagagtcggaacacctatttgtcctaatgatggtcatgaaataacaagtcaatctccagaacaaatggtagataagatattagaattgccagaaagaactaaattacaaattctagctccaattgtacgaggaaaaaaagggcaacataagaaaattattgaaaaagtaaaaaaagatggatttgtacgtattattgttgatggtgagattcatgatgttgaagaagaaatagagttagataaaaataaaaagcatgatataagtgttgtagtagatcgaattgtattgaaagatggtattcgatcaagattgtttgattcactagaagctgctttgagattaactaacggcaatgttgcagttgatgtaattggtgataaaatgctgcaattttctgagaacttctcatgtccatattgtggttttaccattggagaattagaaccacgtatattttcttttaacgcaccatttggagcatgtcctgattgtgatggtataggtgtgaaattagaagtagataaagatttggtaataccagacgatacaaaaactttaaatgaaggtgcacttgcaccatggaatcctatcagttctaagtactacccaacgatgttgcaacaagcatgtgaggcatttggtattgatatggatactccatttaaagatttaccagacaaagataaaaaaattatattgtatggagctggagatagagaatttcattttaaatttgaaagtgactttggtggtttgaaggatattgatacaacatttgaaggtgttattccaaatgttgaaagacgttatagagaaacaaatagtgattttacaagagatgttatgcgtcaatatatgactagtttaacttgtcaaacatgtcatggatatcgtttaaatgaacaagcattatctgtaaaaatagcaggtaaacatattggtgaagtgtcagattttcctattaatgaaagcttgaatttctttgaaaatctaacatttagtgaacaaaatcaagagattgccagaccgattctaaaagaaattgatgataggttaacatttttaaagaatgtaggtttagattacttaacacttagtcgttcggcacgtacactatcaggtggagaagcccaaagaattcgtttagctacacaaattggatcaaatttatcgggtgtaatgtatgttttagatgaaccatcaattggtctccatcaaagagataatgatagattgattgcttcattgaaaaaaatgcgtgatttaggtaatacactaattgttgtagaacacgatgaagatactatgagagcagcagattatttaattgatattggtccaggcgctggcgagaatggtggacaagttatagctgctggaactccaaagcaggtcgaaaaaaagcgtaattctttaactggacaatatttgtcaggtaagaagtatattgcaattccaagtgaacgacgaaaagggaatggaaagaagatagtagttaagggtgcttcggagaataatttgaaaaatatagatgttggtttcccactaggtgaatttatagccgttaccggtgtatctggttcaggaaaatcaacattggtaaatatgattttaaagcgtgccttggctcaaaaacttaatcataattctgaaaaaccagggaaatatcaaaaaattgaaggtgttgaaaacatcgaaaaaattattgatatagatcaaacgccaattggacgtactcctagaagtaatccggctacatataccggtgtattcgatgatattagaggactatttgctcaaaccaatcaggctaaactgagagggtatggcaaaggaagatttagctttaatattaagggtggaagatgtgaggcatgtaaaggcgatgggattataaagattgaaatgaactttttaccagatgtttatgttccttgtgaagtgtgtcatggtacacgctataattctgaaaccttagaagtagagtataaagataaaaatattgctgatattttaaatatgactgtatctgaagctttaacattttttgaaccaattcctaaaattaaacggaaactacaaacgattgtagatgttggtttaggttacgtaaaattaggacaaccagcaacaactttatctggtggtgaagcacaaagaatgaaattagcttcagaacttcataaaaagtctaatggaaaaactttttatattttagatgaacctacaacggggttacattcagaagatattaagagactattagaagttctgcaaagattagttgataagggaaatactgttcttgtaattgagcataatttagatgttataaagactgcagattatttaattgatctaggtcctgaaggtggagatggtggcggtcaaatagtagctaccggaacaccagaagaagttataagagttaatgatagctatactggtaagtatttaaaagaagtgctagtacctgatcattatgcatag

SEQ ID NO: 1385 - DNA, 1785 bp, Unknownn
  isolated from dental, unidentified
atgaatttttgtattttttgtggaaataagttgatggggaatgaagttttctgcccaaaatgtggtaaaagactagataatattcatattgaagttcctgtaaaaaaattaatccaagacgaactaaaggatattaagaagtcttcacttaatgaagaaaaagaattcgtgaatgaaaaaaatactctaaaagataaaactaagaatcatatagtaaaagaaatacagaatataacaagagatagcttaatagaagataaagagatgtctgtattaacagatgagcgagaaatagtagagaatccgcaaaatatagcgataaaaagagataattttgaaactaaaaatcacatagtagaagaaaaacaaagtattgcaaaagataattcagtaaaaaacaatgatatatctgtattgtcagataagcaagaaaaggtagaaaaactacaaaatacaactattgaagaaaagaaagatgaatttaaagattatatagtaaaaaagggtcagaatacagtagagagtactttgaataaaaagggaagtatacaaacttcaagagatgataaagtttctccttttagtaatataaaaaatgataagccaaaaaatatagacaaagtagataatttgatgatggactcttctataaagaaaagttcagatacaggaagattatctactaatactcgaatatatttaggtaaaagacttacaggaaataagaaaatatattgggagtatggtaatccacaactgcctaataagcatatgcttgttacaggaaaatctggacaagggaaaacatatttcttgcagactattatgtgggaattaagtaagaataaagttagttctttagtaatagattacacagatagttatttaaataatgagttggatgatgactttaaaaagaaaatgggtaaaaaattaaaagaagttattgtatatcaagaaaaactccctattaatccttttaagatacaaaagagatttttgccaggattagtattgacagaaactcctgaagatatggtagatagaatcattgaagttcttgattttatttttcatttaggaattcaacaaaagtcattagctagaaggattatgttgaaaggatataaaaataatcctactgattatacattgacccagtttaaggaacagttattagaaacaaattctggtgaaaatgtctacagtagaatgtccgttttactagatagagatccttttacatatcaaagttcatttgattggtctaaggtatttaattacgaaggtactgttacaatattacagatggttcagtatcaaagacaaatacaaaatacaatgatagaatttttgttgtgggatttattttatcattctcaaactaaaaaggatggaacaatttatcctatatttttggatgagatacaaaatcttaatttttcatcatcatcgccaacagtaaaaattttaagagaaggtagaaagtttggatggtctggaatttttgctacacaagcaatgagtagtataaaaggtgaagtagatgctctatataatgcagcagaacaaatacatttcttgccaccagaagatcaagtatcatcactagcaggctatatagcacctaatgctaaagaaaagaacatatttgaagcaagattaacaaggttaaagaagggtcagtgtataatgagtggaccaattttagacactgacttagacacaaaaaacctaattaatactaacaagatgataagtattgattcatttgaaaatagataa

SEQ ID NO: 1386 - DNA, 846 bp, Unknownn
  isolated from dental, unidentified
gtgttacgaaaaaataaatctgtatggttagttttactagctgttttattaatagtattttgtggagtaagactttatcgagtacaagctgctcagaataattatattaattcaaatgttcctactttattcttccatggttgggggagtagttatcgtgcggaacgacaaatagcaaattatgctaaaaataaaggtgtaactaatacaatcatcagagctgatgtttcggctaagggtgaagttgaattaataggaagtatgaaaaagaacgcaaaaaatccaattgttgaagtgaattatcaagataataagaacgcaaattataacgaagatgctaaatggatgaaaaatgtagtagtagccctacaaaagaaatacggcataaaaaagtttaatgtagtgggacattcgatgggaaatatgtcaattatgttttacttgctgaactatggtggagataagaatttacctcaaattcaaaagcaagtagatattgctggtcactttaatggtattttgggaatggatgacaaattaggtgaaagtaaattggaaaaaaatggtaagccaaatatctttaggcagagttataagaaattattggcaattagagagagttatcctaagaatcaaattgatgtcctaaacatctatggagacataggtgataagtcagatggaagggtaagcaataattcatcaaaatctttaaaatacttattaaatagtcgtgagaagtcatatcaagaattaaaaataagtggaaaatatggacaacatagtaaattgcatgaaagcaaaggggttgataaagcattgataggtttcttatgggctaaatag

SEQ ID NO: 1387 - DNA, 1128 bp, Unknownn
  isolated from dental, unidentified
atggttactgaatttttattttggaaggtgaaggaaatgacgaaagtatacaacttttcagctggtccagctgtgttaccaaaagaagttataaaaaaggcacaagatgaactaacttcttttaaaggtagtcaaatgagtgtaatggagataagtcatcgatcttcactttacacggaaatgtttcaaaaagtagaagaagatttgagatatttaatggaaattccagatgattatgatattttatttcaacaaggtggagcaactttacaatttactgcagttccactaaatttagctaataattatcaaaggatcggatatatagatacaggacattggtctcaaagagcgtatcaagaagcagaattattacataaatttgatgtagatgttatcgcaagttctaaagatagtaactacactgagttagtacatcaagttgagttggggaacaaaaagtatgattatgttcatttaactactaataatacaattgaaggaacaatgtatcgagacttaccttctggacttgacggacaaactattgtggcagatatgtcgtctaacattttaggacaaaaatataatgtagatgattttggattaatttacgctggtgctcaaaagaatattggtattgcaggactaacagtagtgattgtaaaacgtgatttaattggaaaagtaagcaatttaccttcaatgttagattacaagaagcaagctgataagcaatcagctttgaatacaccaccagtttttgcgatttatatggcaggattagtatttgaatggttaaaagaacagggtggagtagcagcgatgcaagctctaaatgaagaaaaatcacaattactatatgaatatttagataattctacgttatttagttctccagttaaaagagaagatcgttcattaacaaatattccttttgtgactggcaataagcagttagatgaaaaatttatagcagaagccacatcagcaggactattgaatttaaaaggccaccgtttagtaggtggaatgagagctagtttatacaatgcttttgaactagaaggtgtaaaagtattagtagattttatgaaagaattcgagttaaaaaataaaggggaataa

SEQ ID NO: 1388 - DNA, 1296 bp, Unknownn
  isolated from dental, unidentified
atgactgcagaattaggaataacaaatggttatggagtagttctggctgctgatagtagtctaacaatgcaagaccatagctcccgaaaatattatataactggacaaaaaatttttaagctatcatcgaagcatagtgtagctattatgttttatggaaatgctacaatcaatggtcaaaaaatacaatcaattgttgaaggctttaaccaatacttgggtgaagagacattaaataaatttacagaatacgtccagctatttaaagaatatctgattaaatcagcaaacagagaatatgagcaatatattaagcagaaactagaagatatattgaacaatttacatagcacttacaaaactcaagacttgttaggaaatctgattgaagtgaaaaaagaaattcaagaagaaaaaataccttatacttttcaagagtttcagaaattcatgaatcaagatcgaatgagtcagtttttgattagtgaagataataagtatacgactgaagaactagagtatgcgtattatatgctagttagtcaaactgtatccaatttttatacgacaggaattgtattagcaggaaaaggcaaggaagaaaattattgttcattatggaatagtgaattatatggtgttttagatagtaaaattttctcaataaaggaaatatcaagttcttctaattatagtaatttatacaaatttgcccaaagtgatggtgctgatgctttattgttaggtgtagatagaaaagttagcgatgccttttataataatttgtatataaaatatcaaggtacggatactatcgaaataacaaaagcatttcaaagaacagttgatgattactataacaaattttatcgagcatacattaatggtttaaccttagataaggtggctaattttgctaaacaattagttttagctactatgattaggcgtaacttttttgacaataatcaaatagtaggtggaagcattgatgttttaactatcgcaagtaatggtaaagtatcttggatgaaaaaagggaaaaatgtacgagatatagagttaaaagttacgagtgaagaaagaacaggtcataacttaaagaagccgagaatttcagatgagcctgaattaacatttgacgagtggatagaaaagcaaataagtttagctgaaaaggttgttaatagagaagaaaagcaagatgatgaggactcaaaagatgagatatcatttaaagaatggataaatcagcaaataaaaagtgctgaggaaatcgtaaagagaaatgagtga

SEQ ID NO: 1389 - DNA, 1155 bp, Unknownn
  isolated from dental, unidentified
atgttcaaaaggaagataggagagatttttatgacaaaagatgtattacattacgatactgtaggaagttttttaagaccagaaaaattaaagcaagcacgacaagattttttagaaaataaaatttcaagagaaaaattaaaatttgttgaagatgaggcgattgttgatttagttgagaaggaaaagcaacttggattaaaagtagtaactgatggtgagtttagaagaagttattggcatctagatactttctggggatttggtgggattgaacataccattccagaacatggatactttttccacggtgaagaaacaagagcagattcagcaacagtttcaggaaaaattcattatgtagaaaatcatcctgatgtacaagcattttcatatctaaaagaattaattaaggatgatgatgacgtaactgcacgtcaaagcattccagcaccagcacaattatacgtagaacttttcagagatgagcgtaataagaaaattacaaatgagttttatccagatcaccaagaattagtggcagatatctctaaagcttatcgtgagttaattcttgatttgtataaccatggttgtcgtgatattaaactcgatgattgtacttggggagttatcgttgatgacgatttttggaatgttttctcagaagacggaaagtatacaagagatggtttacaagatttatatcttgaattaaataatggtgctttagtagatttaccggaagatttaagaataacgacacacatttgtcgtgggaactatcattcgacttgggcatctaagggaggttatgaaccagttgcagcacatgtttttgctaaagaaaatgtcgacgcattttatttagagtttgatgatgaacgatctggaggcttcgagccattgagatttgttccaaaaggtaaagaggtggtcttaggaattattacaagtaagaaaccagaattagaagataaggaagaattgaagcaaagaatcaaagaagctgctaagtatgttgatttagaaaatctagctttaagtacacaatgtggatttgcttcaacagaagaaggaaacaagctaactgaagaagatcaagaagcaaaaatcaagttagtaatagaaacagctaaagaagtatggagctaa

SEQ ID NO: 1390 - DNA, 342 bp, Unknownn
  isolated from dental, unidentified
atgcttaatttcatccctgatgatatgggcgaagttcaacaaaaattattttggcttaaagctaatggatatcctgatgcaactgaacaagaagttatcgagaagactattcttgatggtgttcaatacatgtttaacgatgcattagaaggaccttactggactgttatttgggacgatactgataaaaaattagccgtacgtggagctacaagcgaaattgttggctatatcattcctagagaaaatcattctacattctctgatgactttaaggaagcttcccctctaacttgggaaaatctatctaaacaagtagaaaaacttattggctctgattaa

SEQ ID NO: 1391 - DNA, 732 bp, Unknownn
  isolated from dental, unidentified
atgttgtacataactctatggaaagaagatgatatcatggcagaagaattaccaagctacaagacagaattaatttcaatcgaaaatttggaaaaagactactatgaaataaagattaaaaaacctaatgatatgaattgggtggcaggtcaatacatgagactaggcttacctactaaagaaattacagaaaagaaaaagttacgtgcattatcatttgcttccttacctgaagatgatgtaatcttgctaggtacaagaacaggtaaagaaatcagtaactttaaacaaaatcttttaactgtacaaccaggtgaagaagtagaagttaagggtccattgggccaatttacacttcctgaagacggaaatcaaactttagtattttttgctggtggggtaggtgttacacctattagagcattacttgaaaaactagctaaagataagagtgaacgtacgattaaatttgtatattcatctttggattattatttctacaaggaagactttgctgaatttaagaaatcattaccaaatgcagaatttatttttgttcgcgatgaaaatgatgtagatagagaattaacaaagttgacaagcgaactagctaatgatgcgttatattatgtatcttcttcagaaaagattgtagaagctgtaagtcaatcgttacaagataagggaattgatgctgaaaacattaagcacgatatcttatacggatactaa

SEQ ID NO: 1392 - DNA, 1680 bp, Unknownn
  isolated from dental, unidentified
atgacaaaacttggtcaaaaagtaatttatcaaatttatcctaagtcattttacgattctaataatgatggttttggagatttgaaaggaattattgctaagattgactatttgaagaaacttaatattgatatgatttggttcaatcctttttatgtttctccgcaaaatgataatggatatgatatcgctgattactataagatagatgaacgttttggtactatggaagattttgaagaaatggtagccaagttaaaagaaactaacattggtgtaatgttggatatggtattaaatcactgttccactgaacacgaatggttccaaaaagctttggctggcgatgaaaagtatcaaaaatatttctaccttcgtcctgctaaagaagatggttcattaccaactaactggcaatctaaattcggtggccctgcatgggaaaaatttggtgatacagatttatactatcttcatttatacgataagactcaagcagatttagactggcataatccagatgtacgtgctgaagcagctaaaatcgtcaacttttggaaagaaaaaggcgttgctggctttagatttgacgtgcttaatgtaattggaaaagatgaagtattggtagattctgtagatccagatcatgaaaaacctctatatactgatactccagttgttcataagtatatcaaagaacttaaccgtaatacttttggaacagatcctgaaatcgtaactgttggggaaatgtcatcaacaactatccctaactcgattgaatatacaaatccagatgaacatgaattatctatggtcttcactttccatcatttgaaagttgattacgataacggtgaaaaatggagtaaagttccatttaactttatggaattaaaatctctattatctacttggcaaacagaaatggataaaggcaatggctggaatgcattattctggaacaatcatgatcaaccttgggctctaaatcgttttggtgatcccgtaaactaccgtgaaaaatcagctgaaatgctagcatctgccctacatttacttcgtggtactccttatatctacatgggtgaagaattaggtatgatggatcctcattataagtctattgacgactatgttgacgttgaagctttaaacggctatcaaatgttacttgataagggtgtagacaaggatcgtgcttttgaaattgttgtttccaagtcacgtgataactctcgtgtgcctatgcattgggatgatagtaaatatgctggctttagtgaagcaaaaccttggttaatgcctactgatcaagatgaaattaatgtagaaaaagaattagctagtggcgaaatctttaatcactatcaaaaattgattaaattaagaaaaaccgaaccacttatctacgctggtcatttcaaagaattattggcagatgataaacaagtctttgcttatgaacgttatctagatgattcatctgagaaattagttgttttcaataacttctatggcactgaagttacagttgatttaccagctgaatatcaagataaagaatgcacaacacttattgataattaccaaaatgagattcaaaagactgcaaaacaaattacactacaaccttatgaatctttagcaattaagagtctagagaataaaccaaaatag

SEQ ID NO: 1393 - DNA, 1200 bp, Unknownn
  isolated from dental, unidentified
ttgcataaattattattagtagctaaagaaacttatattcgtcaagttaaatcatggtcgtttttattcttagtattgtctccattcatttttattggtttatcagcaactattagctactttggcgcaaagatgacacctgatgatcaaattgctattgtttccactgataaaacgatacagtctcaattaaaacatcatgacacgtttacttggaaatataagtcagttgatgacgctaagaaagctatgaaagatgacaaaatagttggctacgtttatattaaatctgatagccagaaaatctctgccaattactacggaaatgatgaaatgtcttctactgatgaagttaaaattaggcagattcttcaaagtaaacaagctactttaaacattattaatgctggacttgataagcagcaacttcaacagctaagtattcagcctcaatataagaagcacatagcaaaaaaagtagttgataaaaaaacagttcaatctatttcatatatgatactgagtttcttaatgtacatagttatccttacttatgcggcaactacagctcaagagatcgctgctgagaagggaactaaaattatggaagttattttttcaagtatgtcagcaactaaatacttctatggtaaaattttaggtattttaggagttattttaactcatataggaatttacttacttggtggaatagctatctacccatttattatcaatttagacatggtatctaagttcaaagatatgattggagatattttattaaaccttgtttctgtcaatctcatatatgttgttttaggaattgttatctatactatcttagctgcattctttggtgctttagtagttagagttgaggacacaagtaaggcaattcaaccaattactatcctaatcatcgcatctttcttgagttcaatggtatttattaataatccttcaagtatgatcgtaaaagtattatcttatgtaccattcctatcatcattctttatgccaattagagtaattgataatagtgtatctattatagaaatcagtatttctttagcaattctatttgctacaacagctctaatgactagttatattagtaaaatatattttggattgattcttcaaagtgatgatgtaggaatctggaagaattttaaacgaggattgaaatttaaatag

SEQ ID NO: 1394 - DNA, 759 bp, Unknownn
  isolated from dental, unidentified
atgcatgaggatatattactatctaatgaacgaattgatcaattgtattcatcaaagataaaaattattcaaagtagcgaagttttttctttttcaatagatgctattttattggctgactttgcagactcattgaagaaaaagaattctaagatagtggatctatgtgcaggaaatggtgcagtaggtctttttttgagtcagaaagtgaatggaaaaataatccaagtagagattcaaaaaagattagctgatatggctagaagaagtatattactgaataatttagaagataaaatcacaatcttaaatgaggatttaaataatttacaaggtttgatatcaaaagattcggttgatatggtggtatgtaatcctccgtatttcgctaatttggaaacaagtaaaaaaaatcctaatcagtactatgctattgcaagacatgaaattaaggtaactctagaacaagtcatagaagttacaagtggacttttgaaatttggtgggaaggctaattttgtatatagacctgataggctacttgaaatgttagatttaatgagaaaacacaatattgctccaaaaaaaattcaattagtatatccaaaaaaagataaggaagctaatattgtattagttcaaggtataaaagcaggaaaagatggtgggattcgttaccttccacctataattgtgtctgaagataatggaaaatatactaatgttatagaggaacttttatatggtaaaggaaaatag

SEQ ID NO: 1395 - DNA, 693 bp, Unknownn
  isolated from dental, unidentified
atgattgcgcaagacatcgcttcaaaaattaaatatcatcaatataaagaaggagattatctcccaagtgaacatcaactttgtgaactttatggaacttctcgcgaaactattcgtaaagctctcaatcatttaaccgaattaggacttattcaaaaaatccgtggtaagggttctgtcgttttagatattcaaaaatttaccttccctatttctgggattacaagttttaaggaattaaatagatctctaaatatgcatgctaagacaacggttctaaagcaagtaaacacattggctcctaaaaaatttatggacattaatatcgataatcaacaggcaattttcgttgaacgtcttcgtactatcgacgacctacctgtagtgttagatcaagattatctacttacacctccagtttcttctttgccagctggtgtagctgaagactctatttatgaatatttagaaaaagaattacatttagaagtatcctatgctactaaagctattacggttgaaaaagccgcagatgatatcgctgaaaagttgcagctggatgatgataaactcgttgttatagtcagaagtctttcttatttagacgacactacactattccaactaacatcttcctatcatcgccctgacaaatttaaatttattgactttgctcgtagaaaaaaaatctaa

SEQ ID NO: 1396 - DNA, 2028 bp, Unknownn
  isolated from dental, unidentified
atgggtgaaaaaccaacattttatattacaactccaatttactatccatctggtaaattgcacatcggaaattcatatacaacaatcgcttgtgatgtgttagcacgttacaaacgacttcaaggttacgacgtattctttttaacaggtacagatgaacatgggttgaaaattgagcaaaaggctcaagcattaggaatgcaaccacaagaatacgtagataagatggctgctgatattaaagaactttggaaaaagctagaaataacaaatgataagtttatccgtacaactgatgattatcatgaaaaagctgttcaaaatatctttgaaaaattattggcaaaaggtgatatctacttaggtaaatatcgtggatggtattcagtatctgatgaagaatatttcacagaatcacaattagcagaagtttaccgtgatgaagatggaaacatgattggcggtaaggctccatctggacatgaagtgcaacttgttgaagaagattgctacttctttaagatgagtaaatatgctgatagattagtaaaatactatgaagaacatccagattttataattcctgatactagaaagaatgaaatgttaaataacttcattaaaccaggacttgaagacttggctctaactcgtacaagtttcaattggggtgttaaagttccttctaatccagagcacgtagtttatgtatggattgatgctttatgtaactatattactgctttaggatatgaaactggtgacgatgatagtctatttaagaaatactggcctgcagatgtccacatggtaggtaaagaaatcgttcgtttccacactatttactggccaatcattttaatggctttagatttacctttaccaaaacatattattggtcatggttggttattaatgcgtgacggcaagatgtcaaaatctaagggaaatgttgtctatccagaaatgatagttgaacgttatggtttagatgcattgcgctactacttaatgagagccgttccttttggaaatgatggtgtatttacacctgaagactttatcggtaagattaattttgatttggctaatgacttaggtaacttattaaatcgtacagttgcgatgattaacaagtaccgtggtggtcaaattcctgaattgaaatctggagtaactgcttttgataaagatttagaagacgtggctgctaatactatcaagaattttgaagaacaaatggatagtgttcatttctccaatgctttagatgaagtttggaaattagttgctcgttctaataaatatattgatgaaacagaaccttggattttagctaaagatgaaactaagaaggatgaattagatagtgtgttagctcacttagcagcttcattacgtttagttgcaatcttgattcaacctgtcatgactcacacacctaaggaaatttttgcacaattaggcttaaatagtgatgatatggcaattcaaggtgtttcatactttgacctacctgcaggtgcacaagtagtagctaaagggactcctatcttcccacgtttagatgtagaagaagaacaagaatatattaagtctaagatgactaagaatgaaaaagctaagggtcgtaaagctatggctgaaaaagctaaagaaaactgggatcctgaaaatacaactttagttttgactaaggacgaaatcaaatttgataagtttgataaagttgaattgaaagttgctgaaattaaagaagtgtctaaagttgaaggtgctgataagcttttgaaattcagattggatgcaggcgatgaaggtgaccgacaaattctttctggaattgctcaatggtatccaaatccagaagaactagttggaaagaaagttattgctgtaactaacttgaaacctcgtaagatgagaggcgaagttagccaaggaatgttgttgtcagcagaatttggtgaaacagtccaattaattacagtttcagaaaatattccaaatggttcattagtaggataa

SEQ ID NO: 1397 - DNA, 1746 bp, Unknownn
  isolated from dental, unidentified
ttgaataaagcagcgatattacatataccagcaagtgagatggcttattatgaaaataaggatgaattacaccttcaattacaatcagcccacaatgatttagcggatgtaacggttttggtaggtgaagttagcggaaataataacgatagctggagatatgaaagcttttttatgcagaaaactttcgcaactagatatcatgattattgggaagtcatattaaaattaaacaaaaatgaagcacaatatgtatttaaagttacagacacttacggtaatgtaggactttatgacgcccaacgtttatgtgaagctacggaagaaaatgctaattcaccacatggatttatcattgaaaatagagatatgcgacaagtaacgcaaattccagattgggttacaaagacagtctggtatcaaattcaaattgatagatttgctaatggcaacgataatctagctaagttatctgagaacgaagataatacaactcaaattttaggtggagatctaactggtattttaagtaaactagattatttacaaaatttaggtattaatggtattgtgctatcttctatttttgaaggcgatggaccatttaaattaacgactaacgatttttatagtattgatagtcagtttggaaataaagatctctttaagatgttagtcagcaacttacatcgccgcaatatgaaagtagtactaaaaatgaatttagcttatttaagcgataattcgagacaatggcgtgaaattctagaagaaggacaacatgcgaaatatgtagattggtttaatattaagggatttccgcctaaatatagccaagatccacataataaaaatattgttagagctaattataaattcagtgagttaaatccacattatccaactttgaatttgaaaaatccagaagttcaaacctatctaattcaagcaataaaatattgggtagaacattttgcaattgatggattaatattggatcatgctgataaattgagtcgagaatttgtacatttattaaaccgaaatcttaagaagatgaaacctgatttctacctagttggaaaatcagaaatgagcaatactagtgtggttcaattaggggattttgatgcgatgacagatgatgctttaggcaatttgttattgaattttgctagagataagaaaatcgccgctagtgaatttaagtatcaattaagtcgacaaatgttagctcaaaataccaagttaagtcgagtgactttaagaacattggatgatttaacatcttcgagaattttaacgcgctgtcgcgaaaataaggctttgatgcgctccttgttaacctttatgtatttattaaaaggtagtccagcaattacttatggaacagaactagggctttcaggacatgattttccaagtaatctagtaggaatggattggaatcaagaagatcaagacgataagatgatgcgttttatcaaagtgttgaataattttaggttgcaaaactataaaattctaagtgaaggcagttttgagtggggccagattagtgatagttatgattatgtaagttttatcagaagaaaagataaaagaagattatttgctttatttaattttggctataatggaataaaatttgtcttacctaaacacgctaaattaattttaggtcaaaatattgtagatgagaaatccgaaataggtcagtatggatttgtaatattagaagcatag

SEQ ID NO: 1398 - DNA, 1773 bp, Unknownn
  isolated from dental, unidentified
atgagaagaacaacttatgcaggattagttgatgaaaaatatcttgatcaagaagtttgcctaaaaggttgggtacaaaagcgtagaaatttaggtaacttaatttttattgacttacgtgatattgaaggaattgttcaattggtatttagccaagaattcaatccagaagctttaaaggttgctgaacaattacgtagtgaatatgtcattgaagttaagggtaaagtagtggctagaggagaaaaagctatcaaccctaacatgagaacaggtaaagttgaagttgaagtttcagatattgaaattttaaacaaagctaagacaactccgtttgatattgcagatgatattaatgcatcagacgatttacgtttacaatatcgatatcttgatttacgtcgtccagaaatgcaaaaagctttgatgatacgtaaccgtattactcaaactgttcatagctacttggatgaaaatcactttttagatattgaaacaccatatttgacacgttcaactccagaaggtgcacgtgattaccttgtgccttcacgtgtatatccaggtcatttctatgctttaccacaatcaccacaattgttcaagcaattattaatgggtgcaggttatgatcgttattaccaaattgcacgttgcttccgcgatgaagacttacgtggtgaccgtcaaccggaatttacacaaattgatattgaaacttcctttatgtctgctgaagaaattcaagaaatgacagaaggattattgaagcgtgttatgaaagaaactttagatgttgatatcaagacaccaattcaaagaattacttggaatgaagcaatggacagatttggttctgataagccagatattagatttggtatggaattaaaagatatgtctagtgcagttcaaaatgctggtttcaaagtctttgatatgacacttgaaaatggtggtcaagtaaaagctatcactgttccaggtggtgctgacaagtattcacgtaaacaaattgaagaaaagcaagaatacatcaagcgttttggtgctaaaggattagcttgggtaaaagttacagatgatggattaactggaccaattgctaaattctttactgaaagagctgaagatattaaggcagcagcagaagctaagagtggggacttgatcttattcgtagcatctaatcgtaaggtagtggctgattctttaggttacttgcgtgtagcaattgctaaagaaatggatatgattaataaagatgaatttgcatttatctgggttgtagactggccattatttgaatatagtgaagagtttgatagatatattgctgcacaccatccatttacaatgcctaatgaagaagatttagatttattagaaactgatcctcacaaatgccatgctcaaagttatgatattgtacttaatggttatgaattgggtggtggatcaatccgtatccacagacgtgacattcaagaagcaatgtttaaggctttaggattcataaaagaaaaagcagaagaacaatttggttggttcatggatgcattagactttggtttccctccacatggtggtctggctttaggtttagatagatttgcgatgttacttgcaggtaaagataatattcgtgaagttatcgcattccctaagaattccaaagcttctgaaccattgacacatgccccaagtactgtagctccaaaacaattggatgaactatacttgaagacagatgtccctgaagaagatgaataa

SEQ ID NO: 1399 - DNA, 864 bp, Unknownn
  isolated from dental, unidentified
atggatattttaggaggtattagtttgaaaacaagacgaagcgacagattaattgatatgacgcgttattttatggaacgaccacatacattagtgtcattaactttttttgccgaacgttatgaatctgctaaatcatcaatcagtgaagacttggctattataaaacgtactgttaagttaagaggtataggaattttagaaacaataccaggtgctacagggggagctatttttatcccatctattgatgaagatgaagcacgtgcatttatcgaagatatgactgaacaactttcacaccaagatagattattacctgggggatacgtatatttatctgacttacttggcagaccagacgttttgagatacgttggtcgtgtgattgcacgtcaatatatagataagcaaattgatgcagtaatgaccgtagctactaaaggtgttccaattgcacaaagtgtagcttcatatttaaatgttccattcgtaattgtgcgtcgtgattctaagattactgaaggttctacagtatcagtaaattatgtatctgggtctagtgaacgcattgaaaaaatggaattatccaagcgtagtttgaaacgtggttctcatgtattagtagtggatgatttcatgaagggtggcggtactgttaacggtatgaagtccatgattgaagaatttgaatctaaacttgtgggaattaccgtttttgcagaaggtgcatttgatggtcgtcgaatggttgaagattacacatcactattaaaagttgatagtgtcaatacaattgataaaactattcacgtaagcccaggaaattatttagaaaaagtctttggcaaaaaagaagattaa

SEQ ID NO: 1400 - DNA, 1002 bp, Oribacterium sinus
  isolated from dental, Oribacterium sinus
gtgttagaattaatttgtaataattctaaactaactttggaaggggaaattattatggcaatgaatcctagcaaagcacaagatgtgtggaaagatattggaaagagcgtacaatttacagttcttgaattaaagcgtgaaaatcaagctcatgaacaagaagtaattcaagaatttgcagatcgttatcaggcaattattcgttccttgagaattagaaatggtgatggttacttaaaagcatctttcggtattagtaatgatgcttgggattatctattccctaatgctccaaagcctaaggaactagaaacatatgaaacaattagtggtccagaatactcaatgcctgcaagtaaaggcgacttattcttccatattcgtgctgatagcgaagcatatgtatacgaagcaatgagtcaattccgcagattccttgaagacattacaacagttgttgatgaaactaaaggcttccgttattttgaaggtcgcgctattatcggttttatcgatggaacagaagctccacaagtagaagatgctgctgattatgcaatcattggtgatgaagatccattctttgaaaatggttcatatgcatttgctcaaaagtggaaacataacatggacttctggaatcatatgaagactgaggaacaagaaaaagctgttggtcgtgagaaatttactgacctagaacttgaagatgaagataagtttaagaatgctcataacgtagcatctaaggcagaaattgatggtgaggaacaaaagattgtacgtatgaacgttccatattctgatccagcacaaaataatactggtacttactttattggatatgcacgtcattggaaagtaaccaaaatgatgttacaaaatatggtagataaatcagacttcttgttgacattctcagatattttatcaggtcaattattcttcattccttcacgtgatatgttggataagatagccgatggtgaattgaataaataa

SEQ ID NO: 1401 - DNA, 870 bp, Unknownn
  isolated from dental, unidentified
atgtcaattcaagcaaaaaaattaaactatacttaccaaattggaacacctttagaacatatagcattgaaagatgtatcgataaatattaaagacggtagttatacggcaatagtcggacatactggtagtggcaaatctacattgctacagcatttgaatggcctattgaaacctactagtggagaaatttcaatcaatggatatacaatcgataataccactaaaaataaagagttgggaaaattaagaaaagaagtaggatttgtttttcaatttcctgaagcacaattatttgaagaaacagttctaaaagatatagcatttgctcctaaaaactttggaaaaagtgaagatgaagccgaaaaaattgcaagagaaaaagcaaaattagtagctcttcctgaagaagtattggagaaatcaccttttgaattatctggtggtcaaatgagaagagtagcaattgcagggattttggcaatggaaccaaaagttttagtattagatgaaccaactgcgggattagatcctgagggacgccatcaaatgatggaaatgtttaatagattgcataaagatgaaaacttaacaatcatcttagtaacacaccaaatgaatgatgttgctgaatatgctgatcatgtaatagtcttggaatcaggtaaagtaattgctgattctactcctaaagaactatttagtgatccagagtggttaaaaaatcatcatttaaatcttccacaaactacagattttgcctacaaattgtttgataagctagctctttctaaacatagtattccactaaaaagtgaagagttaactgatgaaattttaaaaatactagggggaaatttgaatgaataa

SEQ ID NO: 1402 - DNA, 831 bp, Unknownn
  isolated from dental, unidentified
atgaaaaatttaagaaaagtaacgctgcttttttcagcgttgctaatgatctttttcttaggagcatgtggaaaaaaggataaagcagcaaatattgctcagagaactgaacaaactaagacagttacctggggtgtaaaagcagatactagattatttggtttaatgaacattaagacagggcaaattgaaggttttgatgtagatatggccaaggcattgacgaaaaaaatgtatggtaaggatgctaaagtaaaattagtacagacaacagccaaaactaagataccactcttaaaaaatcaaaatattgatgctgtaattgctgcgatgacaatcactcctgaaagacgtaagatagttgaattctcacaaccatattttgcagctggtcagtcattgttggtgccagacaatagcacaattaagaatgttcacgacttagataaaaagggcatggttgttttagctgtaaaaggaacaactgctgtggctaatattcataagtttgctcctaaagctaaagttttggaatttgatgattatggtcaagcatttacagctttgaaatctggtcaaggtcaagcgatgagtacagacaatggtatattggcagggattgcttctgaaaatcctggttatcaggttgtaggtggtaactttactaatgaaccttatggaattgctgtagataaaggccaaactcaaatgatgaaaagaattgataaagctttagatgaattaaaagctgatggtacttatgataagttaattcaaaagtggtttggaaatgttaaggggtttgatgcgaaaggagctggagaaagatga

SEQ ID NO: 1403 - DNA, 549 bp, Unknownn
  isolated from dental, unidentified
atgacaaaggcattgttgattattgattatactaatgattttgtggatgataagggagctttaacttgtggtaagccagctcaagagttggaagactatattgttaaaacagctcaagatttttatagcaatggtgattatgtaattctaccaacagatacacattttgaaaatgacgtatttcacccagaacataaattatttccgccacataatatagcaggaacttggggacaaaagttatatggaaaattagatgaatggtatcaagaacatcaagcagacgaaaaagtatatcaatttgctaagaatcgctactctgcctttcaaaatactaatctagataattttttgcgtgaaagaggaattaaagatctatatttagtaggagtttgtaccgatatttgtgtcttacatacagcaattggtggctacaatttgaattatcaattaacaattttaaaagatggagtagctacctttacagataatggacaagaatgggctctagaacattttaagaatagtttaggagcaacagttgaatag

SEQ ID NO: 1404 - DNA, 1110 bp, Unknownn
  isolated from dental, unidentified
ttgagtattgttaccttaataactggattaataaagaaagttttgaaacatttattgaaggataataaaaaagtgtggagtttaaagaaacaagcaatttttttctctatattatcagatttattatcagcaggattttccttacgacagtctctgataagtatacaaaatataatgccagaattttattcagtttctcataaagtaaagaaaaatttgctgatgggaactaagattagcgatgctttaaaagagaatatttctaaatcaacctattatcaattgttaattgcagagcaacatggagaaatggagaaaagcatcaagcaattggggagtttacttgaaagaagagtggagcagcaaaataaattaaagagtttaatggtgtatccaatgattttattttttatgttgataataattatgttaggaataaagttttggttgaagccaactattaataattttggagaagatagtgtaaaaacatcgtcgattattaattggacagcagttggtaaatacagtctaattttagtggctttgataatagtactatatgtattaaaaattttgagatggtggagtaaacaagaaactataactagacatcattggtatagccaattgctaattataggtaagatttatcgacaatatagctactactatttgagctttaatttgtcactacttttgaaaagtggactagatttaaaacaaatatgtagctttttaaatgaatttgataagcaatctttactgtatcaattaggacaacaattaagagagttgttaaatgctggaagtatgcctgatgaattggtgaaaaaatatccatttatccctcctgaattgaaattgtttttaaataagggagaaacgttggaaaacataagtaatgagttagcggtttattcagaagtttcgtataggaaattattaaaattaattgataaattgattgagtttataatgtggaatttcagaacatttcacaacatttcacaacattccataaatgctaacttaacaatgtttttactatatttgaaatgtttaactgccaatatatatttctcgaaatatcaaaaaagtatgcattaa

SEQ ID NO: 1405 - DNA, 612 bp, Unknownn; identical to SEQ ID NO: 516
  isolated from dental, unidentified

SEQ ID NO: 1406 - DNA, 918 bp, Unknownn
  isolated from dental, unidentified
gtgtataaaaataaagaggtaagaaaaatgtctgattatttagttaaaagtttagtatacgatggagcaattagagcttatgcagttgatgctactgaaactgtaggagaagcacaaaaattacacgatacttggagtgctgcttcagctgcttttggtagaagtttgataggtactttattattatcagcatcggaactatctggtgatgaaaaaatgaccgtaaaaatcaatggcgatggaccaattggggctattgtggtagatggtaatgctaaaggtacagtcaaaggatacgtacatgaaccacatgtgcatttgcctttaaatgaaaaacataagattgatgttaaaggcgcagtaggtagtcaaggctttttatcagtaactaaagatttaggattaaaagagccttttacaggacaagtgccccttgtatctggtgagttaggtgaagatttcacttactatctagctaagtcagagcaaattccatcagccgtaggattatctgtttttgttgaagatgataacacaataggtgtagctggtggttttatgattcaagttttaccaggagctagtgatgaaattttagatgaaattgaaaagaagttacaagaaataccgttagtatctgaaatgatgcgtaaagatggtaagactcctgaagaaattttgtatacacttttcccaaaagacaaagtaaaaattcttgagaaaataccagtagcatatgaatgcaattgttcaaaagaaagatttgctgaagcactagcaagtttacctaaaaaagatcttgaagaaatgatagaacaagataaaggtgcagaagcagtttgccatttttgtgggaaaaaatacgaatttaatgaaaaagaattaactaaaatcatgaatgaagctaatcaagcttaa

SEQ ID NO: 1407 - DNA, 1635 bp, Unknownn; identical to SEQ ID NO: 26
  isolated from dental, unidentified

SEQ ID NO: 1408 - DNA, 702 bp, Unknownn
  isolated from dental, unidentified
atggcaaaagtattggttgtagatgatgaacaggcaataacaacattattgaaatataatttagaaaaggcaggctatgaagttaaaaccgttaataatggaaatgatgcattagatgaaggattaactggcaaatacgactttataatcttagatctaatgttgccaggaattgatggaattgaagttactaagagaataagacaagaaaagataacaacatatattcttattcttactgctaaggacgatgagtatgataagatcattggactagaattaggtgctgatgattatttgactaaaccattttcaccacgtgaaattgttgctaggttaaaagcagtcaaaagaagagtggaacattattctgataattcagagaaggattccaaaaataagtattactttggaaactatgtggtaaatcttgacagttatgaattgagagataaaaataataatttaattaagttaacgcctaaagaattcgaattgcttgtgtattttttaagaaaaaaaggtagggttttaggacgcgaagaattattgaacaatgtttggggatttgactatatcggtcaaacaagaatggtagatatgcatgtcagtcatttacgtgaaaaaatagaggagaatcctaagaagcctatttttttaaaaactgttagaggcttcggttatcgctttgaggacgaataa

SEQ ID NO: 1409 - DNA, 3426 bp, Unknownn
  isolated from dental, unidentified
gtggaaaaagtattaattgctaatcgtggcgaaattgcaattcgtattattagagcatgtcatgaactaggattaaaaacggtagctatttatgccaaggaagatgaatatggtgttcatcgttttaaagctgatgaagcttacttagtaggtagtggtaaaaaacctattgaagcttatctagatatcaatgacataattcgaatagctaaaatgaccaatgctgatgcaattcatccaggttatggatttttagctgaaaatgaagaatttgctcaaaaatgtgaagaaaatggaattacatttattggaccatcagtggaacatctacgtatttttggtgataaagtagaagctcgtaatgttgctaattctgctggtttacatactattccgggaacgaatgatccagtaaaatcacttaaagatgttgaaaagtttgcagataaacacggttatcctattatgattaaagcagcaatgggtggcggtggccgtggtatgagaattgttaaacgtaaagaagaattacgcgaggcatatgaacgcgctagaagtgaagctaaccaatcatttggtgatgatgaactttatgttgaaaaaatgattgttaaccctaaacatatagaagttcaaattttagcagataaacatggaaatgtaatgcatctttttgaaagagactgttctgtacaacgtcgtaatcaaaaggttatagaatttgccccaagcataactttgtcacaagaacgtcgcaaagaaatttgtgaagctgcagttaatttggcgaaatctgtaaactactataatgctggaacagtagaatttttagtaactgaagatgatttttactttgttgaagtaaatccacgtgttcaagtagaacatactgttacagaaatgatcacaggtgttgatattgtacaatcacaaattcaaattgctgaaggtaaagacttgtataatgatttagagttaccaaaacaagaagaattaacaagccaaggtatagcaatccaatgtcgtattacaactgaagatccagaaaataattttatgccagatacaggtaaattggaaacataccgttcaccaggtggttttggtgttcgcctagatggtggtaatgtatatgctggagcagtaataacacctttttatgattctttattggttaaggcttgtgttcaagcacgaaactttaaagaagctattaagcgtatgaacagagtgcttaatgaatttagaattcgaggtgttaaaacaaatattaaattcatgcgtaacgtgttgaaccatcctgttttcgttgcaggcgatgcacgcactacatttattgataacacaccagagttatttgaatttaatcgtagcagtaacaataataaccaattattgaagtatattggtgatgttactgttaacggattcccaggcacaaaacatcatcgtaaagtatttgtccctgatattaaattggataagaattttgtatctgaaagtaaagtagaaaatgcaaaatcagtatttgataatggtggagttgatgctttagccaattgggtaaataaacaagaaaaggtattaataacagatacaacaatgagagatgcccaccaaagtttatttgcaactagaatgcgtactaaagatatgcttccggtaattgaaaaatatgatacagctttacctcatgtattttctgctgaggtttggggtggagctacttttgatgtagcgtatcgtttcttaaatgaaagcccatgggatagattagatattattcgtgagaaaatgcctaatactttgctacaaatgctattgagaggttctaatgctgtaggatataagaattatcctgataatgtattaagagaatttgtcaatgaaagtgcaaaacatggaattgatgtatttagaattttcgatagtcttaactggacagatcaaatggaaaagagtatagagtttgttcgcgatgctggaaagatagcagaagggacaatgtgttatactggagatattttaactcctgagaataataagtatagtttagactactatgtcaacttagctaaggaattagaagcaatgggttcgcatattatcggtattaaagatatggcaggacttctaaaaccaaatgctgcttatgaattaattagtacattgaaagaacaagttaatgtgccaatacatttacatacacacgatacaacaggtaatggtgtagcaacatatgtgcaagctgttcgcggtggagttgatattattgatgttgcaactagttcactttctggtacaacaagtcaaccaagtatgagtagtttgtattacgcattagaagggaacgctcgtcagccagaactaaatattgataatgttgaaacattgaatcgttattggagtggaattaagccattctatcaagactttatgaatggaactacatctccacaaacggatatttatcaaacagaaatgccgggtggacaatattctaatttacaacaacaagcaaaggcagtaggtattgatgattttgaacaagttaagtcaatgtacagaactgttaataagttattaggtgatatcattaaagttactccaagttcaaaagttgtgggtgattttgcaatctttatgattcaaaataatttagacgaaaagtcaatctttgaaagaggtaaaactttagattttcctaaatcagttgtagatttctttgcaggcgatttgggccaaccagttggtggatttcctaagaaactgcaagaacttgtgcttaaaggtaagaagccaatcacagtgcgcccaggtagtttagctaagccagttgactttgatgaagtagctgatgaattaaaagataagattaaacgtaatcctacaaaggaagaagttttaagttatatcctatatccagaagtcttcatagattatattaacaacgtaaaacgttttggttctatgcatgatttagatacaattactttctatcaaggaatgcgtgaaggggaaacaattcatgttgactttaaaccaggacgtagtattataattcgtctagattctgtttcagaagctgatgaggaaggaaatcgtagcttattcttctcattaaatggtcaaaatattcaaattattgttcatgataagagtaaggaagctaagattaagaagattcctaaagcagagccaactaatgaaagtcatataggtgcaactttaagtggatcagtactagaagtattagtacaaaagggtcaagaagttaagaagggtgaagcattaattgttactgaagctatgaagatggaaacaacaattaaggctccatttgatggaaaagttagtcatgtatatgttaaaaatggcgatattcttgaaagtcaagatttattattggaattggacaaaaactaa

SEQ ID NO: 1410 - DNA, 696 bp, Unknownn
  isolated from dental, unidentified
atgtggcatacagttattagttctttacctgagttaatatcagctggaataaagtacacaattccgctagcgattatttcatttattctaggattgattttagctttggttacagctttaattagaatttcgcaaactaaaggacctttcttggttatcaaagcaatttttagattttatgtttggctatttagaagtacaccattattggtccaattatttattgtatactttggattaccgtatctaaaaatcaaaggactagcaccagaagggataaagttagatccatttacatcaggaattatagttttttcacttaatacaggggcatatgcttccgaaacaattcgtgcggcaattacttcaatccctaaaggacaatgggaagctgctgcctcaattggaatgactcataaacaagcattgatgagaataatcatccctcaagcagctagagtttcattaccaccgttagctaatagtttcattggtttagtgaaagatacatctttagcagcttccattacgattgtggaaatgtttgaagttagtcaacaaattgcagctgaaaattatgagccattagtaatgtactgcacagtagcagtcttatatgcaattctatgcacggtgttatccttcttacaaggatggcttgaaaaagtaacgtcacgttatgtggcaactcaataa

SEQ ID NO: 1411 - DNA, 714 bp, Unknownn
  isolated from dental, unidentified
atggaaattatggtaaaggtaagagcaaacggagaaagagggtgtgagtggatgcaaaagtttgagttgcgtttagatgatattgattttcaaagtcaagaatcatttaaaactttaagattcaatgttgaattttctggagagaagaatcaagtgttttatataactagtacatatccaaatgaaggtaaaagtacagtttcattagagttagccttagctttctctgataatggaaaaaaagcattgttaatagatgcggatttaagaaagtcagtttcaagacagttaattcgtactggtagtattgagatgggactatcagattacttagtaggcagagcacaatttgatgatgtgatcgctcaaagtaatatagaaaactttagtatgatattttctggaccagttccacctaatccaagtgaaatattggatggagaaagatttaagcatttaatagaaactgttaaagaaaaattcgatattgttatcattgatacgccaccaatgggaagtgtcattgatgcagcagtgattgctaaaaactgcgacggtggcattattgtaattaatagtggacaagctagttatcgacaaattagaaaaactaaagaacaattggaacgtgctgatagtaaaatcatcggatgtgtcttaaataaagtagatgcttccaataatgattactactacggttactaccataaataa

SEQ ID NO: 1412 - DNA, 516 bp, Unknownn
  isolated from dental, unidentified
aaaaatgttattatcatgacaagtggtttggataatcgcgatggttatggttatgtttctagtcgtataggtttgaaaagaaaagctattccagttgttagtgaaactaatattaaagatctagtagaacaatcttctttagagcctgcctgtattttagttgatgaggcacaatttttagaaaaacatcatgtattggaattaactcagattgtagatgaactgaatattcctgtaatgacttttgggttaaaaaatgattttatgaatgagttgtttgaaggatctaaatatcttttattatatgctgacaaaatagaagaaatgaagacaatttgttggttttgtaataaaaaggctattatgaatttaagaatgcatgattctaaaccggtatatagtggtgaacagataatgattggtggtaatgaatcttattatccagtatgtagaaaacattattttaatccacctattaataatttagaaaaagatgaaggagaaataaatggataa

SEQ ID NO: 1413 - DNA, 843 bp, Unknownn
  isolated from dental, unidentified
atgagaagaaaaggtttattaggatttattgcagtaattattgtaattgcagttgcagcatttttcacttttggtcataaaaagactgaggctaagaagacagtaacagtaggtgtagttggacaaactaatcaagatgaaaaaatttggaatcaagtaaagaaaacagctaaagaaaaatatggagtaacagttaaagttaagagttttacagactataaccaaccaaataaagctttacaagaaggagaaatagatttaaacagtttccaacacaaggctttcctaaatgcttggaataaagccaataaaggtactttagttccaattggaaatacagttattgcaccaatcagattatattcttacaaatacaaaaatattaatgagttaccaaagaatgcaacaattgctgttcctaacgatgcatcaaatgaaagtagagcattgtacgtattaaagaatgcgggattaattagtttcaagaaaggcactggaaaattagcaacaattgctgacattgaaaagaatccaaagaatttaacaattaaagaactaggtgctgaacaaactgctcgttctttaaatgacgtagatgctgctgtagtaaacaatacttacgctattccagcaaaattaggtgataaacaaacaatttatactgaaccattaaataaagattcagaacaatggattaatgtcatcgtagctaataagaaagacaaggataacgaagcatataaagcagtggttaaatcttatcaaacagatgctgtaaagaaattaatccacaaagcttatggtaacagtgaagttacagcttggaatttaaaactaaaatag

SEQ ID NO: 1414 - DNA, 681 bp, Unknownn
  isolated from dental, unidentified
gtgaatagtttgaagggtgtagtatttgatttagatggtgtaattactgatacagctaaatttcactttgaagcttggagtcaacttgcaaaagaaaaatttgatttaactctaccagctgaatttgaaagtaagttgaagggaattagtagaattgaatctttagaaagaattttggaatttggtaatttgagcgataagtatataagtgatcaagtagctgaaatggcaaatgaaaaaaatacttactacgtagcagcaattgatagtcaattaactgaaaatgatatcttaccaggagtaaaaagattacttgatgagttgaaagaacatgacatgaaactagcaatagcttctgcctctaagaatgctccacatattttagaaaagctaggaatcattgatgagtttgatgcaattgctgatccagctaaggtagctaaaggcaagccagctccagatatctttattgcaggtgctgaagcaattaatttagatcctaaagattgtgtaggcgtagaagatgcagtagctggagtagctgctatcaagtctgcaggaatggttgcagttgcagttggtgataaggatgaattaagccaagctgatgaagttgtaccaagtacacaagattttagctatgaattgtttaatcaagtgtggaataaagtgaataagtaa

SEQ ID NO: 1415 - DNA, 1398 bp, Unknownn
  isolated from dental, unidentified
atgatggataattctgaaatatatgtgggattggacatcggaacgacttcaataaaagtcatcatcgcagaacatgtgaaaggacaagcaaatatcattggttacggtaatacaaaatctgctggcttaaatcgtggtgtaattgtagatattgatcaagttgttgcaacaataagagatgctgttaatcaagctgaaaaaaaagctaacttggatatttctgaagtaacagttggaatacctgctaatttgctacagattgaaaaatgtcacggtatggtttccgtcagtgatgaaaatggtaactcacaagaaattacgaagaatgatgtgtataaagtaacacaagctgctttggtacaaaatcttcctcctgaacgtgatgttattgatatcattccagatgaatttattgtagatggtttcgatggaattaaagatccccgtggtatgatgggggttcgtatggagatgcacgctgttatgtatacgggtcctaagactattttacataatatcaagaagtgcatacaaaaagcaggtttgaaagttaaagcaacagtggtagctcctttggctactgccagattagcaatgtctgatgcagaacaagattttggatctattttaattgatatgggtggtggacagacaactgcagctgtaattcacgaccataaattaaagtatacatatgtagaccaagaaggtggcgattatgtcactagagatatttcggtagttcttaacacttccattgagaatgccgaaagcttgaagcgtacttatggttttgcaatggctaatcaagcatcttctgaagatgtatttcctgtacaagttgtagggaaacaagaacctgaacaagtatcagaagaatatttggctgaaattatagaagctcgtatgagacaggtgtttgaaaagataaatcgttctttaaacgatgttaatgcttttcaattaccgggtggaataattttaactggtggaatggctgctttaccaggaattagagaattagcagaagaaatttttggagtaagcgttaaaatttatattccacaagaaatgaatttacgtttcccatcattctctcaagtgataggattagtaaactatgtaactaaaatgagtgatattgaacgcttagttaaaggtagtttggaaggaaatacaattgatataacagcagatactattccatatgctgatagcatgattagtaataattttgatacaacagctgtatctaatgattatgtggatgattatgtagaaactgcagatgttgaacctcaagacttacaagaaacacaacctaagcataagcaaaataaaaagaaaaatggtatattgtcgaaagctaagaattttatggaatctttctttgactaa

SEQ ID NO: 1416 - DNA, 1623 bp, Unknownn
  isolated from dental, unidentified
atggcaaaggaaattaagttttcagaagatgctcgttcaaagatgttgaagggtgtagataaattagcaaatacagtaaaatcaactattggtcctaaaggtcgtaatgttgttttggaacaatcttatggttccccaacaattacaaatgatggtgtaacaattgctaaagctattgatttagaagatcatttcgaaaatatgggagcaaaattggtgtctgaagttgcttctaagacaaatgatattgctggtgacggtacaacaactgctactgttttaacacaagctattgtaaatgaaggtatgaaaaatgtaactgctggtgcaaacccagttggaattcgtcgtggtattgaattagcaactaaggctgcagttgacgcattacatgaaatgtctcatacagtagaatccaagagtgatattgcacaagttgcttctatttcatctgctaacgaagaagttggtaaattaattgctgatgctatggaaaaagttggtaacgatggtgttattacaattgaagaatccaaaggtattgatacttctttagatgttgttgaaggtatgcaatttgatagaggatatctatcacaatatatggtaacagataatgataagatggaagctgatttagataatccatacattttattaacagataagaagatttcaaacattcaagaagtattaccattattgcaatcaattgtacaacaaggtcgtccattattgattattgctgatgatgtagatggcgaagcattacctacacttgttttgaacaagattcgtggaacatttaacgttgttgcagttaaggctccaggatttggtgatcgtcgtaaggcaatgttacaagatattgctacattgacaggtgctactgttatcacagatgacttaggcttacaattgaaagatacaacagttgaacaattaggttctgctggaaaagtaacagtaactaaggaaaatacaacaattgttgaaggcgctggtgacaaggacaagatcgctgaacgtgtagaacaaattaagaagcaaatcagtgaaacaacttctgattttgatcgtgaaaaattacaagaacgtttggctaaattatctggtggtgtcgcagttattaaagttggtgctgcaactgaaacagaattgaaagaacgtaagtaccgtattgaagatgctttgaatgctacacgtgctgctgttgaagaaggatttgttcctggtggtggtacagcattggtaaatgttattggtaaagttgctgctttggaagaagaaggcgacgtacaaacaggtattaacattgtaaaacgtgctttggaagaacctgttcgtcaaattgcagaaaatgcaggtttagaaggttctgtaattgttgaaaaattaaaggaacaaaaaccaggtgtaggtttcaatgctgctacaaatgaatgggttgacatggttgaagctggtattgtggatcctacaaaggtaactcgttcagcacttcaaaatgcagctagtgtatctgctttattattgacaacagaagcagtagttgctgataagccagaaccagaaagtaacgaccaaatgcctgcaacaccaggtatgggcggtatgatgtaa

SEQ ID NO: 1417 - DNA, 642 bp, Unknownn
  isolated from dental, unidentified
atgttagaaaattatttatttgattttgacggtacaattgctgattctggtgaaactggaattatcgcagttcaaaaagcttttgttgattatggattggagaagccaactgcagaatcagttaggtattatatgggcgttccaattgaaacattcttccctaaaatatctaatcgtgagttaaacgatgctgaatgggaagaagtttttgcgatatttagacaatactacagtgaattagaacttgaaattacacaacttttcccaggtatgaaagaaactttgatgcaattggttgaggatgggaaacgtttatttgtagtatcaagcaagaactcagtttccttaaatcgaaatttggaaaatttggggatagcagatttgtttacagacacaattggatcggatcaagtggaaaactacaagccagctccagacggtataaatatacttgctaatagacatgatctagataaggcgaagacagttatgattggcgatgctaagtacgatttacaaatggggaaagctgctgaagttaagacatgtggctgtgcttgggatacctatgatattgaattattgaaaaaagaagaaccggattatttgttagaaaaagtagaaaagttactagaaatctaa

SEQ ID NO: 1418 - DNA, 570 bp, Streptococcus sp.
  isolated from dental, Streptococcus sp.
atgagaaaaataagcatttttgttctttctgtgcttccattaatgacgctaggagcttgttcaataacgtcatcaagtaaatcctctaacgaaagtttattttcttataaagcaagttctcgaaaagcagaaagcattaaaaaggctaaaaaagaagcacatgataaggctgaagctgctaaaaagaaaaaacataaaaagaagaaaaagaaaaaggaaagttctagcagttctgaacaaagcagttctgtaagttcaagtgtatctgaatcaactgactcaagttcagtttcatcaagcgatgatacacaagacacatcatcaaatcaacaaaatacaagtcaaggtaatactacaacatatcaagcaccagcatctagttactactatggcgggtatactgctcctcaaggtggaggtagtggcagtggatctggtagcggagcaagcactccaactgattcaaatcctgctccttcagatgatggagatgccaacaatgattccggcaattctggcaatgctggtgacaatgttcctgaacaacctactacagctgcagaagaataa

SEQ ID NO: 1419 - DNA, 1113 bp, Unknownn
  isolated from dental, unidentified
gtgacaaattatttagtagtaggtgcagggcttttcggtgcagtatttgcacacgaagctgctcaaagaggacacaaagtaaaggttattgaaaaaagagatcatgttgccggaaatatttacacaaaagaggtacatggtattcaagttcatcaatttggtgcacatatcttccatacttctaagaaagaaatttggaaatatgtaaatcaatttgctgaatttaatcgttatactaatagcccagtagctaattataatggtgaaatttataatttaccgtttaacatgaacacatttaataaactttggggagttgtaactcctaaagaagctatggctaagattgaagaacaacgtgcagttcttaatggtaagaaaccaaaaaatcttgaagaacaagctatttcattaattggaacagatatttatgaaaaattaatcaagggttatacagaaaaacaatggggacgtaaagctacagaattgccagcttttattattcgtcgtttaccagtacgtttaacttatgataacaactatttcaatgatacatatcaaggtattccaatcggcggttatacacaaattgtcgaaaagatgttagataatgacaatatcactgtagaaacaggggtagatttcttcgatcgtaaagaagaatatctaaaagaatacgataaagttgtcttcacaggtatgattgatcaattcttcaattacaaacttggagaattggaatatagaagtttacgctttgaaacagaagtgttagatgaagataatcatcaaggcaatgccgtagtaaattatacagatgctgaaacaccttatactagaataatcgaacataagcattttgaatttggtaagggtgaaaaaggtaagacggttattacgcgtgaatatcctgctgattggaaacgtggcgatgaaccttactatccagtaaatgatagtaaaaacaacagcctttacaagcaatatcaagaattggcaagtaaagaaactgaaaatgtaatctttggtggacgtttgggacaatatcgttactacaatatggatcaagttataggagcagctttactaacagtaaagaatgaatttgaataa

SEQ ID NO: 1420 - DNA, 2070 bp, Unknownn
  isolated from dental, unidentified
atgcgattagcattaagaaaaattcgagatggattgagtacacgaataggtttctttacattaacgcttttccttttttggatgaagacttatatcgtatacaatactaaattcactttgggagtatcggatggaatgcaagaattcttgttagctttaaatccgataccagcaggattattattatttggaatagcactttatttcagaggtagaaaatcttattggattatgatagtcattaatctgctacaatcgttatggttgtttgctaatattttatactatcgagaattttcagattttctatcgatgagtatcataaaatcatcgggttctgtttcaaataacttaagtttaagtattagtcagattatacatggaacagactttttagtatttttagatgtaattattttagcattattggtgattttcaaagtaatcaaacctgatttgagtcctgtgaaaatttggagacctataataattacggtgtcttcactagttttattcgctattaatttaggtttagccgagaaagaccgttcgcaactattaacaagaacatttgataataattacattgttaagtacttaggtttagatttctttgcgggttacagtacatatcaagctcatcaagaatccgcaactagagctaatgctagcaagaaagacttagatgaaattctgaagaaaattaataaaaatagaacatctcctaatatcgagtattatggaaaggctaaaggaaagaacgtatttattttccatttagaaagtttccaacaatttatgattgattataaagttaatggtgaagaagtaacgccaaatataaataagttttatcatgattctaatacattagcatttgataatttctttaatcaggtaggacagggtaagacttctgacgcagaaactatgttagagaattcattatatggattaccatcaggttcggctatgacaagttatggagcaggaaatacattccaagcattgccagcaatgttagatcaaagaggatatactacagctgcattccacggagacgtaggaagtttctggaatagagataatacctataagtcttggggatatcaatatttctttagtaaagactactataagagtaagaaagattataatataggttatggattaaaagacaagattttcttaaaacaatctgtaaaatatattgaacaattgccacaacctttttatgcaaaaatcattactctaacaaaccattatccatatgaattggacaaaaagaatcaatcaattgcgaaaacaacaacaggagatgcaactgtggatggttatgtccaaactgcacgctacctcgatcagtcatttgaagaatttattaattatttgaagaaggctggattatatgataattcaatgattgttgtatatggtgatcattatggtatctcaaataaccataaaaaagcaattgcgcaattattgggtaaaaagaaagtaactagttatgatttggctatgttccaaaaagttccattcatgatccacttaaatggattgaaaggtggcattaatcatacatatggtggagaaattgatgtaatgcctacgttaatggacttactaggaataaaagatacaggaactgttcaacttggacaagatttgttatcaaataatagaagtcagacagttgcgtttagaaatggtgactttgtatctcctgtttatagtaaaattggaagcaaagtttataataataatggtgaagttgtaaattctaagttaacttctaaggagtctaaggaagttgaaaagcaacaatatgaagtagacagtgagttgaatatgtctgataagataataacaggtgatttactgagattctacaatttggaaggctttaagaaagtagacaagtcacaatatacttataagaagagtgtagctttgaaggaattgaaagaagcacagaagaaaaagaaaacaagtttattaacaaagaataatggtaaatcgacagaggatatgttctcaactgatgctccagaactaaaagagaaataa

SEQ ID NO: 1421 - DNA, 777 bp, Unknownn
  isolated from dental, unidentified
atgcaatacacgggagaaactattgattctgccataagtaaaggattgcaagatttgagtgtagatagagaaaatgtagagattgaagtcatctctcatggtcgcaaaggattcctgggattaggaaaaaagccagcagttatagaattgactgtgaactcaagtgtgcaaactgaaagtgatactaaacctcaattagagattgtatctgaggatcaagtagatagagaatcagaaactttagataacgaggatagtaaaaacattgaaataaatagtgagaaagtagaagaagaaaatcaaaataatttagatgtggttattcaaaatttaggttactatctagctgatataactaagcagctgggaatagaggctgttatagatgttagccaagggaaaagggtagtttactataattttgatactgaactagaaggtttattaataggaaaacatggtagaacgttaaattccttacaactactagcgcaagattacttcgataagcataaaaataataatcgaagaattcgtattatgttaaatgtagctgattatcgtgagcgaagagaagaaaccttgaacaatttagctcagaaaaaagcacatgaagctataatttctagaagtcaaattagtttagagccaatgccagcgtttgaaagaaagattattcattcatccttagctaaagatgagcatgttaaaactttttcgcgaggttcagagccttatcgttatgtaattattgcaccagcgaaagctaaatattaa

SEQ ID NO: 1422 - DNA, 1221 bp, Rothia dentocariosa
  isolated from dental, Rothia dentocariosa
atggaattccctattgtgtgtaagaaaaatcaacctaaagctaaaagatcagtattagccttctatgtatactttaattatttcgtctggggatcatcaatcattctggtttctcaattccatagttggttcatggaattatggcatacagatctaaaaggaatttcaattgttatttcgatgctaggtttaggacatttgattactgttttattagcgggttggttttcggataaatttggtagaaaaaatactataattatcggaacaatttccaacatcatatttttgataggtttattagtaagtagaaatatttggatggcttcaatttgtagtttatttttaggcaatgccaattcatttaatgattctggtagctatcctttattaacggaaaaatttccagagaaacctgctagtatgaatgctttagtaaaagcttcaatgtcattatcgcaaacgatcttaccgttagtaattgcagctgtacacagtgcatacattattattccagctatggcagtgatgctaggattacttctattaaaagtgagtgtaactaattttggtaaaaatgaaacaatagttaaagaaacagttagtgaacaaaaagaaatcttggaaacttctacaaataagccttctgttttgattgatggggtaagaatggtaatattaggatttactttatcatttatattctatatgtactcacaatatgcaccagtatttgcagaaaaagttattggatcaacaccagttttttctaaaacgttgatttcatggtatgctatttcttctttaatctcggtatttatcacatcgactgtagttagaaaggtacatccatttaaagtgttattgacatattcaattgttgctgcagcgatgttagctgtgatggttgttcatccaactccaacaattgcacgtttgacaagtatcgcaattggtttctttgcagcaggtggtatttggcaagttggtctaacaattttatctcgttattttccactagaaaaagggagagttacaggatactatagttttgcggctgttttaacatattttgtgggtccaattgtgtctacttttgtcttagatgatacagcagccagtttagttcatgtatttgttttagatgtagctgtctcagtgttaggaataatcgtaatgataattttagcagtacgttgcttcaagtataaattcatctaa

SEQ ID NO: 1423 - DNA, 870 bp, Oribacterium sp.
  isolated from dental, Oribacterium sp.
atggaaatttcggaaaaagcccctgccaaacttaatctaagtcttgatacccctttccgtcatcaagatggcgagcccgaatggcgtatggttatgacagcaatcgatttatctgattatgttcatattaaaactattcctaacagcaaagagataactgtacaaactaataccggctttttaccttgtgatcaacgaaatttagcttaccaagcagcaaagcttctgcaatctaaattgaacaaaccagaaggcgtggaaatagagattgataaacatatccctgtttccgcaggtatgggtggtggatctgccgatgcagctgcagttttaagaggtttaaataaaatttggaatttaaatatatcacgtgaggagttagcaaaattggctcttacaatcgactctgatgttccattttgtgtatatagcgaacctgccttagtaactggacgtggagaagaaattactccgataggtccacttccaccaatgtggttagtcatcgctaaacctcaagctagtgtttcaactcctacaatattgcgacaaattcatgaacaacatttaaatcaccaagaagttcaaaatgttgtgtccgcaattaagcaacaagatttcgataaaatgtgtcgccatatggggaatgcattagaacccattactatgaaaaagtgccctgacattattaaaatcaaagacaaaatgttacaatttggagctgatgctgctcagatgagtggctctggcccaactgtctttggcatttctcaaaaaaaatctcgtgctactcacatttataatagtttacgtggtttttgtaaagaagtttatcttgttagagcattagattcgttaacgacaaaataa

SEQ ID NO: 1424 - DNA, 1884 bp, Unknownn
  isolated from dental, unidentified
atgatagaggcagaaaatatgaataaaaaagttcgcttcttccattcaatccattttaaaatagcccttgtatttgcattgttattactaataacttttcaaattgttggggctatatttgttagacaactaaaaaatgataatttaaaatctttcaaacaacgagtggaattgtctacttatgttgaaaattcattaatagttgctttgagtaggacggatacagaaggggctaacactaaaattaagaacatcttagatgatattaataacgctaatattcaagaagttcaagtaatagatgcgaaaggcactatcaggggagatagtgatgtaaatagtcgttctttaatcgggcaaaagacaacaaatagtgcagttaaaggcgtgctttatacaggtcgtacatatacagaaacgacttataatcggaatgataataagcaatattacatttcaatcacacctttgctgaatgtatcgagtaataataacgctgttgttggggcaatttatactcgggcagatatggcgagtgtatatgactcggtaaataacgttgtagtgatctttgcttctgcttcgttaattgcgattgttatcggtatgtttttagcgatcattgtttcaagttcgattactaagccaatcgaagaaatgaagcggcaaacagctaggattgcacgtggagattactcaggacacgtacatcaatatggaaatgatgaattaggtcaattagcacaagctgtaaataatttatcaattcgtgttgaagaaactcaggagctttctgaatcagaaagaagaagattggacagtgtgctatcgcatatgtctgacggtgtgattgcgactgatagacgtggtgggataacgattgttaatgatatggcgatgaattatctcgatatttctgaaggcgaagtattaggtaagtcaatcttagatattttggatattcgtaaccaatatacgttaagagatttgctagaaaaacaagatgaagttgtccttgatatgtcaggtgaaaaagacttaatcttgaatgcctatttctcagttattcaaagagaatctggctttatttctgggattgtctgcgtgctacacgatgttacggaacaacaaaagattgatagagaacgtaagcaatttgtttctaacgtttcccacgaattgcgtacacctttaacaagtatgcgcagctacattgaagcgttgaatgatggcgcttggagagatgaaaaagttgctccagaatttttgaaggttacacaagatgaaactgacagaatgatacgtatgattaatgatttgctaagcttatcaagaatggattctggaactgtaaaattagatctagaattagtcaatatcaatgggctagtaaattatattctggatcgtttcgacatgatgttgaagaaagataagattgatacgcgagatattaagactaagaattacacgattaaacgtgattttactaaacgtgatttatgggtagagttagataccgataaattcattcaagtggtcgacaatatcatgaataacgcgattaagtactctcctgatggcggggtaatcacttgtcgcttattggaaacacataataatgtaattctaagtatcagcgaccaaggtctaggaattccaaagaaagatctaggtcatgtctttgatcgtttcttccgtgttgataaagcacgttcaagggctcaaggaggaactggtttaggattagcgatttctaaagaagtaatcgaacttcatcatggtcgcatttgggtagatagtgtagaaggtaaaggttcaacattctatatttctttaccatatgaagaatatagtgaggaggatttgtgggatgaaaattag

SEQ ID NO: 1425 - DNA, 876 bp, Unknownn
  isolated from dental, unidentified
atgatacaaataatcgcttcagatatggacggtacacttttaaatgacaaaatggtaatttctaaacgaaatgccgatgctattaaagaagcacaaaaaaatggggttcacttcattgtttcctctggtcgtggatataatgaaatcaagcctttaattgaggctgctgatttcaatagtcctatgattacacttaacggtgctgaagttttagatgaaaatggaaaagttttaagttcttctcctctacctaaaattactgctaaaaaaatcattcgcttattacgaaaaaaaggactctacgctgaagtaatcacttcaaagggcatctactctgataacaaagctaaaagaattgaaaactttgctgaacttttaactcgagttagtcctgatactccatataagttagctgttatcatggcttctaatcgtctagaacttatgaatatcaattatactgacgactatatggaacttatagatgaaaagcacaccaaagttttcaaaattgttgcctttagttctgaaggtaagaaagttttagatcctattcgtgatgaaatcagtgaaaattctgaacttgttgtaacctcttcttctgaatctaacattgaaattaatcatgttaatgctcagaaaggaattgctttacaagcatatgctgactatttaaatatacctatggataacgtcatggcaattggcgacaataacaatgatgtttctatgttaaaagtcgctggaatgagttatgcaatggaaaatggctctaacgaagttaaaatgttagctaaaagaatagctgacactaatacttctgacggtgttggtaaggctattgaagaagttcttagagaaaatcaagaacactaa

SEQ ID NO: 1426 - DNA, 987 bp, Unknownn
  isolated from dental, unidentified
atggtgaaggatataggtatcgacttgggtactgctaatgttttaataaatgttaaaggtagaggtattgtccttaatgagccatcagttgttgctatagatactaagagtggcagggttctttctgttggatctgaagcatatcaaatggttggtagaacacctagtaatattcgtgcaattcgtcctttaaaagatggggtaattgctgattttgatatgactgagcaaatgctatcctatttcataaaaaaattaaacgttaaaggttttatgtctcgtcctaatattttaatttgttgtcctactaatactacagatattgaaagaaaagcaattagacaagcagccgaaaaatctggtggtggtagtaaggtatacttggaagaagaacctaaagttgcagcaattggtgcaggtttagatgttttccaaccacatggaaatatggtaattgatatcggtggtgggactagtgatatagcagtactatcactaggagatattgttgtaagtcgttcattacgtgcagctggagataaattaaacagtgatatcgcaaattacgtaaggaataaacataacttaattataggtgaaagaactgctgaaaaagtaaaaatggaaataggttctgtactaaaaggacacagagatgaaacatttagtgtacgtggtaggaatgtagttgatggattacctaagactattacgatgacttctgatgaaacggaagaagcaatgcatgatacaatgcaagctatgatttctgctgctaaagatttattaagtacgactcctccagaattagcttcagatatcattgatagaggaattgttattactggtggtggtgcattgctagatggaatagacatgttgttctcagaacatttgaaagtaccagttatgatttcagaaactccattggatgatgttgctttaggaacaggaaaattacttgaccatattgaaaaatcaaattaa

SEQ ID NO: 1427 - DNA, 624 bp, Unknownn
  isolated from dental, unidentified
ttgaataatattttttctcaaacttgcgttataataagatatatagcaattattggtggtgagaaaatggaattaactgaaatcaaagaaaaaactttacaagcacttaatgagttgcttgaacaagctaatttaaaaaaagatgatatttttgtactaggtatgagtactagtgaaatacaaggacaacatattggtaaacattcaaatattgatatcggtcgcacagtcgtaaatacaatcaatgatcgccttaaagaattaggtgtacatcttgcagttcaaggttgcgaacatttgaaccgtgctttagttgttgaagaaagtgttgctgaacagaataatttggaaattgtcacagtttatccgtctctacatgctggtggagctggtcaaatcgcagcatttgaagcttttgataacccagtagaagttgaacatatcactgcaaaagctggtatggatattggggatacttctattggtatgcatgtaaaatttgtacaaattcccgttagaacaagtgttactgaaattggcaaagcccatgttacgttcttgcgttcacgtcctaaattgatcggtggtcaacgcgctaaatatacttgggatccatttaattaa

SEQ ID NO: 1428 - DNA, 786 bp, Unknownn
  isolated from dental, unidentified
atggctcaggaaaataagcaaaactcacgaacagctgagcatttaacgtttaaattggatcagtttgaaggtcctttagatttacttttacatttaatcaagcaaaatgaaatggatatttatgatattcaggttgcagaaataacttctcagtatatagattaccttcatcaaatgcaagatttaaggttagatattgctggggagtatttagttattgctgcaactttattaaatatcaaaagcaaaatgttattgcctgttgaacaagagcaacaagttgaagaagattatgtcgatccacgtgaagatttagtgcaacaattggtttcacaccaactttatcaagaagttgcggctaaatttcatgtaatggaaaagcaacgaatggaattattttccagagaacaggcagttaatgaagatgtaacctatgaagtttcagaaggaacaacgattgatctactacaaaaagcctttgcaaaattgatggctcgtaaacaagtaaagaaaatcaaaaagattaaacggaaaattattcctgaacgttatacaattaaaaaagaaattgaaaatattgaacatacactcaaaatgcacaaaggaacgatgaattttactgatttatttgattttgacggtgaggttgaagtcgaaaaagttgttacatcttttctagcattattggagttggtaagagttggtagagtaagtgcgagtcaggaagaaaataatggaccaattctaatgacatatgaaggaaaggcggaggaagatgctatctaa

SEQ ID NO: 1429 - DNA, 873 bp, Unknownn
  isolated from dental, unidentified
ttgaaagaccaaggagggatatttatgccttttgattggagcaacttgataactacacaacatttgataaacttattagatgttgcagttgtttggtatgctatttataagttgatgatgcttcttcgaggaacaaaggcagttcaactctttaaaggaattgtagtaatcgtaattatcaagttactaagctggtatattggattatcaactgtatcttggataatggaccaagttattaattggggaattattgcaattatcattatttttcagcctgaaattcggcgaggtctagaacatttaggacgtggaacatttgtccataaccgtaagcaaggtgctgaagaagagaagatggtaaaagctctcgatcaggctattcaatatatgtctaagcgaagaattggggcgttgataacaatccaaatgaatacaggtttagaagattatattgaaacagggataaaattggatgcagatataacaggtgcattactaataaatatttttattcctaatacgcctcttcatgatggagctgttattatcaaagataacaagattgcggtagccgcagcatacttaccattatctgaaagtaatcttattcctaaagctttaggaacacgtcatcgagcagctgtgggaattagtgaagtaacggatgctttgacgattgttgtatctgaagaaactggtggagttacaattaccaaaaatagtgaattattaagggatttaactcaaaatgactaccttaagcttttaagaaatgaacttattcctaagcaagaagttaagaatgataatatcttaactaaatttgtagatggatttgctaagagttttaaaggaggtagaaaacattga

SEQ ID NO: 1430 - DNA, 756 bp, Unknownn
  isolated from dental, unidentified
gtgcgtacaccaattatcgcaggtaactggaaaatgaatatgaatccagaacaaactgcagaatttgtaaaagctgttaaggataatttaccagcagcatctgaagttgaagctgttattgcagctcctgctgttgacttaccggcattacttgaaaatgcaaaaggttctgatttaaaagttgcagctgaaaactgctactttgaagatgaaggtgcttttacaggtgaaacatcaccaaaagtactaaaggaaatgggagtagactacgttgttatcggtcattccgaacgtcgtgattacttccacgaaactgatgaagatattaacaagaaagctcacgctatcttccgtaatggtttaacaccaatcatttgctgtggtgaatctttggaaactcgtgaagctggaaaagctgaagaatgggtagcaaatcaagttacagcagctttgaaggatctttccgcagaacaagttgcaagcttagttatcgcttatgaaccaatctgggctatcggtacaggtaagacagctactgcagatcaagcagaagaaatttgtgcagtagttcgtaagacagttgctgatttatatgatgaaacagtagctgacaaagtacgtgtacaatacggtggttctgtaaaaccagctaacgttaaagaattaatggcaaaagaaaacattgatggtggattagttggtggagcttcattagttcctgattcatacttacaattagtaaactacaaaaactag

SEQ ID NO: 1431 - DNA, 1035 bp, Unknownn
  isolated from dental, unidentified
ttgaaaaaagtaaataaatacattgttactttaactatattggtaatagtagctattttaatgtttttaccaattcccgtttacttagagcagccaggtgcagctgaaagtattaatcaatatgtaacggttaatggaaagactaataaacaaaaaggtgatttcatgctagtttatgttgctgttcaaaaagcaacaccactaacatacttatggagtttttcgcaaaaacatattgatagagtatcagctgaagaaatgacaggtggcagttcagatgcagaatttgatagaattcaagaatattatatgcaagatgcagtgaactctgccaaatatgtggctttgaaacatgcagggaaagaagttagccaaaaatatattggaatatatgttatgtctgtcttagataaatctgattttaagaataaaattcaagttggcgatacaataacaaacgttaatggaaaacattatagtaatgctacaggatatcaaaatgctttagcaaaaattaaagccggagaaaaagtaactattacttatcaacgtgatggaaagaatcataaagctattggtaagacaatgaagttaccacaaactaagagaactggtatagggataacactggctaaccgttcgaaagtaaagactaatgaaaagatatccgctaatatggaaggaataggaggaccctctgctggtttaatgttgtctttacaaatgtattcgcaattgtcgaaaaaagacttattaaaaggtagagatgttgcaggtacaggtactattgatgcagatggaaaagtgggagatattggtggaattgacaagaaggtcatctccgcttctaaagcacatgctaaaatattctttgctcctgataaccctgtaagtaaagtggttaaaaagtatgatccgaatgctaaatcaaattatgaagaagcagttgagactgcaaaagaaattcatacaaaaatgaaaattgttccagtaagatcatttaatgatgcagttaattatttggaaaataattag

SEQ ID NO: 1432 - DNA, 1131 bp, Unknownn
  isolated from dental, unidentified
atgcctaataaaaagaatttgatgttttggtcgttagaaattttgattgttgcaacattaatttgggtttgtatgaagataaattttgtttttcaaccagtagtagcattcttttcaaccttatttatcccggtaatcatatcaggatttttgtattacatgctactaccattagtgaagttactaatgaaggttaagattgggaaatttaaaattaatcgaactggagcagtcgccattgtttttatagcagtttttgcgattattgcgatgtcaattgctttccttttaccaaaaattattgtgcaggtagaaaatttaatcacaaaatctccaacttatgtttctcaattggagaagaatttccagcattttttgaaatatgatagtcgaagtagttggttgaaagatattgatttgcagtcttacttaaaccgtttcgaaggatccggtagtgagatgatagctaaatttatgaagtcattaactaacagtttaggaagtattatctccgcaataactaatatcacagttacagttttaactgttccatttatgttattttatatgttaaaagatggttataaattaatgcctagtattttaaagtttgtaccgcgtaaacgtactgctcaagttgaagcaatgttacaagatatgagcaatactttatcaaaatatattagtggacaagcaattgaatgtatttttgttggtatttgtacagctattggttatggacttgccggtgtaccttatgctttattaacaggaatatttgctggagcaactaatattattccatatatcggtccttatattggattagttccagctttgattctatccttaactgattcttttaacactgcagtaatggcaataatagtctgcattatcgtacagcaaattgatggtaatctgatttatccaaatgttatcggaaaatcagttgatatccatcctctaacaattatcttattgttgttggtagctggaaaaattgctgggttactaggtattattttatgtataccattttatgcaatcatcaaggtaattgttaaacatgtaagggaagttattattttagagaatgaatcttcagatgaagcaaaaattgaaaaataa

SEQ ID NO: 1433 - DNA, 972 bp, Unknownn
  isolated from dental, unidentified
atggaagtgattaatatgagattaacaaacacacatgatatttctttagaaaacacaatccaaggtatcaagcttgcttatccatctcttaaacaggtttcaggaatatttggatttatagatagaaattttaatgatgaacacattcctttgatttcaggtggtggtgctggtcatgatcctgctcactggggatttgttggacctggaatgctaagcgcttcaattactggagaattatttgaaccacctactccagaagaaataattacagttactaaaaaaacaactacacttaaaaaagctttttatattgttaaaaactttcccaaagatgttgctgcttttactcaagctaaagtaactttagaagataaaggttggcaaattggaatggttattgttagagatgatgtttcggtagattcatcttttgaaaaaagacggcgtggcgtagctggaactatcctaattcataaaattctcggctactatgcccaaaaaggagctaatattgatactcttgaaatgattggccagcatttaacagagaacctaaaaactattggtgtggctttttctggagataattttaacctaaaagataatgaaatatactacggaattggcatccatggtgaacctggctatcgcaaagaagaatttaagtcttctgaattacttgctagagagttgatagccaaattgcgcttaaatttccaatggtacaagggtgatacatttgttgttctaatcaattctctaggtggtactacacctattgaaaatttgatttttaataatgatgtttgttctttattggctttagataacatcaatattgcattcgataaggttggaacttttctttcatcttatggaattaacgggatttctctatcattattaaaagttgaagatgccgactggcttcatgccttacaagctcccgttaatgttccagcttggtaa

SEQ ID NO: 1434 - DNA, 915 bp, Unknownn
  isolated from dental, unidentified
atgataataaatgttattataaaaaaagtaggtgtacactttatgaaaatcgctgttgttactgatagtacagcttatttagaacctgaagtggcagaacaatatggaattaaagttgttcctattccatttattatagataacaaggtttataatgaaggtattgatattaccacagaagaattttacagcaagttaaaaacttcagaatcatttccaagtacatctcaacctgcaatcggagaacttattaatttatatacatcattaggaaatgaaggttatgatgctgtaattagtattcatttggccggaacaatttctggcctggttcaaacaattgaaaatatcagagagcaagttacaaatattgatgtaataccatttgattcgaaaattacagttcgtttgatgggaaatcttgccattgctgctgctaagatggcacaagctgggaaagatgttgatgaaattatttcaactttagaatcactacgaagtacaattaaagaatattttgttgttgatgatttgcaaaatttggttcgtggtggacgtttatcaaatgcttcagcttttattggtagtgttttaaaaataaaaccaatcttaacttttgatgatgaatcagataaaattgtagcttttgataaagttcgctcaactaagcgtgctttaaagcgtgtagaggacttatttgaagaaaatatcaaagatcgttcttatcctttgagactaatagtttttcatgctaataacgaagaaatggctatggaatggaaagctaaattacaagagaaatatccgaattatccaattgatgttagttactttggaccagttatcggaactcatttaggtgaaaaggcgcttgctttaggttggatgaaagatattgaaaaattagatttttaa

SEQ ID NO: 1435 - DNA, 873 bp, Unknownn
  isolated from dental, unidentified
atgaaaaaactttattctgctcttatgactgcatttaacgaagatggttctgttaacttagacggtgttcgtgaaatggttcgttacaatattgatgtaaatcatatcgatggactttatgtaggtggtagtactggtgaaactttcatgcttagtacagaagaaaaaaagagtatcttcaaggttgcttatgaagaagctgctggcaaaacacatcttattgctcaagtagggtctttgaatttaaatgaagcaaaagaattagctaaatatgtgactgatttaggttaccctatgatttctgctgttacacctttctattataatttctcatttgaacaaattaagaattattataattcaattcttgaaggtgtagataataaacttattatttattctattccagctttaacaggtgtagcattatctctagatcaatttgctgaattgtttgaaaatccaaaaattgtaggtattaaatatactaatgccgatttctatctcctagaacgtgttcgtaatcgtttcccagataagttaattctttcaggttttgacgaaatgctattacctgctcttgcattggacgttgatggtgcaattggttcaacatttaacttaaacgctcctcgtgttaaagaagaaattgcagctttcgaggctggagatatagaaaaagctcgtgaacttcaaacattaagtaatgactatattactgatcttttaaataatgatttatatccaactattaagttagtatttgaaaaaattggtgttcatgctggctactgcaaagaacctatgagcaagccaactcctgaaatggaagctggagctcaaaagatttatgaaaaatatttcaaagaatag

SEQ ID NO: 1436 - DNA, 810 bp, Unknownn
  isolated from dental, unidentified
atgttttggttaataacagcaattgtagtggcacttgtatttgttggctttggttatactaaaaagcgtgaaacgcaaaagcagtttgataatttaatgtctcaagcaataactaatgctcaagctgcagaatataagaaagcagaacttaatttgcaagatgctctacgtaagaaaccagatgatgtagtagctaaacaacgattagaacaagttaaactctatcaagaaggcttagctgaattgaaacaagatgattatgaacaagcacagttaacatttagatcaactgcaaaagtatctccgtctttatcaattttaacccaaagagctaagaagaaagataagtttctagaatcagtactaaagcaacgtgaaaagtatgatgatctttataatgaagctgtaagacttactgaaatgggagcttatagccaatcgaatgaaaatctagttcagattttagatggaaaaaatattgacgaaaagtattattcacaagtaagaaaagatgcacgtgaattgcaagaaagaaataatagtattttggaacaaattagaattcaaaatcaacaagctgcaataagaagacaacgtgaacaacaaagacaagaagaagctagaaaagcacaacaagctgctgctagttcatcatcgtcagcggaaaatcaaaatgatgagcccaagaaaagtgacgataaaaatgatgatagaaatagtggtcaagacaatgtaaaaaatagttcggaatctaagccagaaacaaataattctgcagctgagccacaacctaataatgaaaataagtaa

SEQ ID NO: 1437 - DNA, 591 bp, Oribacterium sp.
  isolated from dental, Oribacterium sp.
atgacaacattttatattatccgtcacggacaaagtgaagctaatgctaagggaattcttcaaggtagccaaattgacactccactaactgaacttggacgctctcaagctcaagttacactttcaaaacttggaactgacaattttgacgctatctatgctagtccgcttttacgagctgctcaaactgccactattatcggtggtagtgataaaactattacttttgatcctcgcctaaaagaatatgattatggtacttgggacggagaaatcgaagctgatatttggcaaaagtatccccaatatttcgatgaacatcacaatttacttcctaattcttgggtggattcaaaaggtgatacatatttagaagtaaaatcacgtttagaatctttcttcgatgaagttattgctcgacatccagacgactctgtgttagttgttagtcatggtttcaccatcaaattaatcttagattatattctcaatatcggtaatctagttaatattagtgaacctacaaatgctggtattactaaggttaaaatgactaaagatactaaaactgttatttacttcaatcgctaa

SEQ ID NO: 1438 - DNA, 567 bp, Unknownn
  isolated from dental, unidentified
atgaatgacttaatgtctcaacttaaatcatatattccttttaacgaacaagaaaaacaagataagcagcttattattgaccaacttgctaatgccaaagatatttttactcgtaaaaacaaattagctcattttaccgtatcagcttggattatcagccatgataaaaataaagttctaatggcttatcacaatatctatcaatcttggtcttggcttggaggacatgctgatggcaactctaatttaaagcaagtaattctcaaagaaattcaagaagaaagtggcctaactgatgttaaatttttatcagacgatattttctcgcttgaagttctaactgttgatggacacgaaaaacgtggagaatatgtttcttcgcacttacatttaaacattacttacctattcgaagctgatactactatgccattgcgcatcaagcctgatgaaaatagtcaaatcgcttggcttgatttatctagcttagattctaaggtcagtgaagtttggttcaatcaacgtatctatcataaattaattgaaaaggttaacctactttactaa

SEQ ID NO: 1439 - DNA, 924 bp, Unknownn; identical to SEQ ID NO: 344
  isolated from dental, unidentified

SEQ ID NO: 1440 - DNA, 993 bp, Unknownn
  isolated from dental, unidentified
atgcgagctaaattaagcgatgttgctaaaaaggctggcgtttctcctacaactgtttcacgtgttattaataattacggttatattagtgataaaactcgtaataaagtacatgaagcaatgaaggagttaaattaccaacctaactcattagcccgctcgctacacggtaaaaagactaatctagttggtttaatctttcctggtgtttctaatccattttttggtgaattagtcgaagaaatagagaataagcttttcgaagatggctataaggttatcttatgtaatgcagcttataataaagaaaaagaacgttcttatttgagaatgcttctagctaaccaagttgatggtattattgctggtgctcataatttgggcattgatgaatatcaagaatttggtttaccaattgtttcttttgatagaagtttatctgaaaatgttcctattgttagttcagataactataaaggtggcgtcattgctactcaagaactttttgatgccggttgtcgtcatatatattttgtgggtaatcctgttcaaaaaggaaatccaactgatcaccgactttcaggttatcgtgacacaattaaaaaattaggattaactttacatattcatccagtatctttttcagaaacacctatgcttaagattatggcaattaaacaactactttctgaacataaagcagatggaattgtatgtaccgatgaccttactgcattgctagttattcaagcagcacaagaacttggtattaatatccctgaacaattaaagataactggctttgatggtactaaatttatccaacaatatcatcctgaattatcaactgttgttcaacctactaaagatattgctgctttattggttaaacttctagaacgtagaattgctcatccagatgaagatttaaaacaaaaaagttatattttacctattagattcattaagtctaaaacaatttcagacaattaa

SEQ ID NO: 1441 - DNA, 1038 bp, Unknownn
  isolated from dental, unidentified
atgagtcgctatcaagaagctggagtagatattcatgcgggttatgaactagttaataaaataaaaaaagatgtcaaatctactcaaagaatgggaacaacaggaaatattggtagctttggtggaacttttgacttaagtgtactaaatgttaaagaacctgtattagtttctggtactgacggagtaggaactaagttattaattgcacaaaagatggacaagcatgacaccataggaattgattgtgttgctatgtgtgtaaatgatattttggctcaaggagcagaacctctatattttctagactatattgctactggaaaaaatgatccagataagattgcgcagattgttgctggagttgctgaaggttgtagacaagcgggaactgccttaattggaggagaaactgctgaaatgccagatatgtatgcgaaagatgaatatgatttagcaggattttcctctggtgttgtagaaaaaagtaagctattgacggatgctaatcctcaagaaaatgatattttggtaggcttagcttctagtggaatacattcaaatggtttctccttagttcgtcaaattctatttaaggataataaaattgatttatctgaaaaaagggaagaatttggtggaaaaacaatcggagaagtaattttagaaccaacaaaaatttatatagatagtgttttaccacttgtaaaagaaaatttagtaaatggaatagctcatattacaggtgggggactgattgaaaatttaccaagaatgtttgctgatgatctaactgctgaaattgatgcaagctcttggaaagttttaccaatttttgaatatctcaaaaaattaggtaacttatcacaaaatgattgttatgaaactttcaacatgggtattggtatggttttagcagtatctgaagataagttagaatcagtaaagaaattattaagtgataaaaacgaagatttctatattattggaaacttgaggaaaagaaaagacaatgaagaaaaaatcattgtacattaa

SEQ ID NO: 1442 - DNA, 1518 bp, Unknownn
  isolated from dental, unidentified
atgatgtcagataaatatattatggctatcgacgaaggtactacaagtacacgtgcgattatcttcgacaaaaaaggaaataaagttgctgaaggacaaaaagaatttcgtcaatatttccctcaaccaggttgggtagaacatgacgctaatgaaatttggaacgcagtattatcaacaatagctaattcttttattagctcaggaatacaaccaaaacaaattgcaggtattggtattactaaccaacgtgaaacaactattatttgggacaaagaaacaggattaccaatttataacgctattgtttggcaatcaagacaaacaagtgacattgcacaaaaattaattgatgaaggttattctgatactattcatgaaaagacaggtttaatcattgatgcctacttctcagcaacaaagattcgttggatcttagatcatgtagaaggtgctcaagaacgtgctgaaaaaggtgaattgttattcggtacgattgatacatggcttacatggaaattaacaggtggtaaagttcacgtaacagattattcaaatgctagtcgtacaatgctgtttaacattcatgatttgaaatgggacaaggaaattttagaattattgaatattcctgaagctctattaccagaagttaaaggaaattctgaaatctatggtcaaactgcagcataccacttctttggtagtcaagttcctatttccggtatggctggtgaccaacaatctgctttattcggtcaattagctttagaagatggaacagttaagaatacttatggtacaggttcatttatcgtaatgaatacaggtaataaaccagttctttccgataataacttactaacaactattggatattctattgatggcaagattaattttgctttagaaggttcagtatttgtatctggttcagcacttcaatggttaagagatagtatggaaattattgaatcagctcctgaatcagaaagagcagcaaatgaatcaactaaccataatgaagtttacgttgttccagcctttacaggtttaggtgctccttactgggatagtgatgctcgcggggcagtgtttggattgacacgtggtacaactaagaatgactttattaaagctactttacaatcacttgcttaccaaacaagagatgtattagatacgatggaaaaagatacaggtattaagattccagtccttcgtgttgacggtggagctgctatgaataattacttgttacaattccaatctgatttgcttaataagtcagttgaaagagctggaaacttagaaacaacagctctaggtgtagctttcttagctggattggcagttggtttctggaaagacacagatgaattgaaagaattatttacagttggtcgcagatttgaaccagaaatgtccgatgatgctagagaatatctatatgctggatggaagaacgcagtagaagcaacacgtatattcaaacataaaataaacgaaaatctttag

SEQ ID NO: 1443 - DNA, 1200 bp, Streptococcus anginosus
  isolated from dental, Streptococcus anginosus
atggagagaaaaaatattgctgtatttttaacaggtggaattgctgtttataaagcagcaaatgttgttagaggcttaattaaaaaaggatttaaagtaaaagtagctatgagtgaagcttctcaaaaatttataactccatatacattccaagctttaacacatgaaaaagtctatactgatttatttgagataacggatgataacccaataccacatattgaattagctgattgggctgattttactttgattataccagctacagcaaacataatagcaaaaatggctaatggtatagctgatgattttattactacgacactgttagcaatagatacgccgaaatttgttgttccagcgatgaatgagaaaatgttattgaacaatgctaccaaaagaaatatgcaaactttgataaatgatggtgtaaaaataatgtctccagatacaggtatgttagctgaaggatatactggtaagggaagattgcctaaagaagaagagatcattgagtggattattaataaaataaattcaaagaaagatttagttggtaaaaaagtcgttatttctgctggaagtacaatcgaaccaattgatcctgtcaggtatatatctaactattcgagtggaaaaatgggctacgctttagcggaagcagcattcgaacgtggagcaagcgttatattagtaagtggtcctactaatttattggcaaccccaggtgtaaaaatcaacagaattaaaacaactaaagaattagaaagaaaaatgaatgaagaatttaaaactgctgatattgcaataatggcagcagctgtttctgactatcatgttgctaaagtagcaaataataagattaaaaaaaatggagaaaagttaacattagaattggtacaaaatcctgatattttaaaaggactgggctcagttaaggaaaaacaaatattagtaggatttgctgctgagacgaataatttatatgaaaatgctcaaaataagttactttccaaacatgcggacatgattgttggaaatgacgtatctagaaaagatataggatttggaaatgataataatgaagtaacactatttactttgaaaaatagtcctattaagttacctaagactaataaaaaagaattaagtcataaaattttggatgtaattgttgaaaaacttatgtctaaggagtga

SEQ ID NO: 1444 - DNA, 582 bp, Unknownn
  isolated from dental, unidentified
ttgcagcattggcaattgatacctattattggttttatacttcaaaaaggaaaatgtcatttctgtaagcaaaaaattcctttaagtagtactgttattgaattagctattggtgtcatatttatttttaatacgatcataatagcgaatactaatttaatttttacatcattactagtagtctggcttactttaatctctttagaagattattacacattgagcgttgattcaattactcttgaatatggaggattaatattgctcatttttagatttcataccgtaattactaatctaaaagctaatttcctcataatcattcttttcataattattttaatcagttgtaatcttctaaataaatttggtactgcagatactatcttgattgtttttagttttttattactaggattttacaatactctagtagtaattcttttatcatgtattttaggaattatttcatatttaatcaaaagggatttttctgcttctcacccctttattccatatttaagtttgagtattttaattattttttacgcaataaatatatttaaaattccaataatataa

SEQ ID NO: 1445 - DNA, 1293 bp, Unknownn
  isolated from dental, unidentified
atgtcatcagtagtagtcgttggtagtcaatggggagacgaaggaaagggtaagatcacagactttcttagtcaaaatgctgaagttattgcacgttaccaaggtggtgataatgcaggacatacaattgcatttgacggaaaaacatataaattacgcttgatcccatcaggtattttttattctgataagattagtgttattggtaatggggtagttttaaatccaaaatctttagttacagaattaaagtaccttcatgataatggagtatcaacagacaatcttcgtatttcaaatcgtgctcatgttatcttgccatatcatatcgttttagatggcttacaagaagctgttaaaaaagataataagattggtacaacaaataaaggtattggaccagcttatatggataaagcagctcgtgtaggtattcgtgttgcagatttattagaaaaagatacttttgaagaaaaattacgtacaaaccttgaagaaaagaatcgtttatttgaaaaaatgtatggtcacgaaccattaaaattcgaagatatttttgaagaatactacgaatatggacaagaacttaaagattatgtgacagatacatctgttattttaaatgatgctttagactctggtaaacgtgttttatttgaaggagcacaaggtgtaatgttagatattgatcaaggtacatatccattcgttacatcttcaaatccagttgctggtggagttactatcggtagtggtgtaggaccagctaagattgataaagttgttggtgcatgtaaggcatatacttctcgtgtaggtgatggtccattcccaacagaattacatgatgaaattggtgatcatatccgtgaagtaggtcatgaatacggtacagttactaaacgtcctcgtcgtataggttggtttgacagtgttgttatgcgtcactcaaaacgtgtttcaggcttaactaatttgtgcttaaactgtgttgatgtattaacaggtcttgatgaaattaagatttgtacagcatacgaattaaatggtgaaaaaatttatcattatccagcaagtttgaaggaattatctgcatgcaaacctgtatacgaaacattaccaggttggaaagaagatattactaactgcaagacattagaagatttacctgaaaatgctcgtaactatattcacagaattcaagatttagtaggtgtaaaggtatctacattctctgtaggtccagatcgtgaacaaacaaatgtcttagataacgtatgggcacatatttaa

SEQ ID NO: 1446 - DNA, 981 bp, Unknownn
  isolated from dental, unidentified
ttggaaaatatagaaatatcttatacagcacgttatgttccacctgaagttataaataatcaaagattaacagaatttatggatacatctgatgaatggataagccaacgaactggaataaagaagaggcatataagcttaaatgagagtacagctgatttagcaaagaaagtagcagaaaagttattaacaaaaagtggatggaatcctaattctttagatttaataatagttgctacaatgtctcctaattcttttacaccagcaacagcggctattgttcaaggaagaataagtgctgataatgcagtttgttttgatatttcagctgcatgttcaggatatatatatggtttaagtattgttgaagcaatgctaaggaatatgaatttaaaaagggctatgctaattggaagtgaaaatctttctaagttgatagattggaatgacagatcaacggctgtacttttcggggacggtgcagcaggtgctttgattgagttaaaagaagatacagattctaaatttatcagcagtgatttgaaaactattggaaatgaagctaagtttttaacagcaggaataactgatccgttagaaaaatttccagatttagatagcataaggaaatatacgactttcaaaatggatggcagaagagtatatacttttgcgactagggaagttccccaatctattctaagggcagtgcaaaaagctaaccttagtttggaagatatagattattttattttgcatcaagcaaattcaagaattattcgacaagtagctaagaaattaaagcaaaatgaagaaaaatttccaattaacatagatagttttggaaatacttcggcagctagtgaacctcttttattagatgaattaatagaaaatggaattgtaaaaagagggatgacgctagcattaagtggctttggtggtggcttaacagtcggtactcatattattaaatattaa

SEQ ID NO: 1447 - DNA, 1464 bp, Unknownn
  isolated from dental, unidentified
atggattactttaagaatgatttagcaagtattcacgatgatttagtaaataagaaatatagtgttgaagaattaactaagtcaacatttgataacattaaaaaggtagataaagaaattgaagccttcttgaaattagatgaagaaagagcattagaaaaggctcgtaaaattgatgaacgaggcgttaaagctgattctattttagatggtattggtatcggtattaaagataatatcgtaactaaagatttaacaacaacagctgcttctaaaatgttagaaaattttgaaccaatttacaacgcaactgtaatggataagcttaatgacgctggcatgattacagttggtaagttgaatatggatgaatttgcgatgggtagttctacagaaaattcagctttcaaaattactaagaatgtctgggatactacaaaagttcctggtggttcttctggtggttctgcagcagcagttgcatctggtcaagttctagcatctttaggttctgatactggtggttcaattcgtcaaccagctgcatttaatggaattgttggggtaaaaccaacatatggtcgtgtatctcgttatggtttgattgcttttgcatctagtttagatcaaattggacctttgacacgtacagttaaagacaatgctttagtgttaaacgcaattagtggacatgatgctcatgactttactagctccagtcgtgaagttcctgattttactaagggaattgaagatggtgttaagggtatgagaattgctgttcctaaagaatactttggtgaaggtgtagacgaagacgttgctaaggcagttaaggatgccgtaaagacttttgaaagcttaggggcaacagtagatgaagtatctctacctcatagtaaatatggtgttccagtttactacattattgcttcatctgaagcatcttctaaccttcaaagatatgatggtattcgttatggattccgtgctaaagatgtaaagaacttggaagatgtatatgtacgttcacgttctgaaggatttggcgatgaagttaagcgtcgtatcatgttaggaacattctctctttctgctggttcatacgatgcattcttcaagaaggctgcacaagttagaactttgatttgccaagactttgaaaatgtttataaaaactatgacttgattttagctccaacatctccaactactgcatacggaattggtgaagaaatcaacgatccagtaacaatgtatatgaatgatattttaacaattccagttaacttagcaggacttccaggtatgtccttacctgcaggattctctaatggattgccaattggtttacaactaattgcaccacgttttgcagaaagtacaatgtatcgtgcaggatatgcatttgaacaatcaactgattttcataaagcaataccaacgttaggaggtcaaaactaa

SEQ ID NO: 1448 - DNA, 1116 bp, Oribacterium sp.
  isolated from dental, Oribacterium sp.
atggtaattggaagacatcgcaatacgcgtgctataattagcctagaagcaattaagcataatgtagcaacccaaatttcaaaattaaaggatagtcaatctttatttgcagtagttaaagcaaatgcttatgggcatggaatgattcctgtagctaaagccgctaaagaagcaggagctaacggcttttgtgtggctattattgatgagggaatagctttacgagaaagtggaataaaagatccgattttgatcttaggtgtaaatccagcgagtgaagcagtttgtatggctaaacatgatttgtctgtggctgtagggactttagaatttttgactgaagctcaaaagctacttcaagaagaaaaacaaagcttaaagatccacctagcattagacacaggtatgggaagaattggctttagaaatactgaagatttgaaagaagctgttgattttattgaaaaacattctgatcaattaaagtgtgaaggagtatttacacatttttcaactgctgatagtaaggacccagcatattttgaaaagcaatctcaaaagtttgatgagttagtgggagtattgaaaaagaaaccaaaatatattcatcaagctaactcagctacagctctatggcatccaaattttgaaggaaatctagtaagaatgggaatttcaatgtatggattaaatccttctggcgatgtgattgatgaaacttggaatttagagccagcattaagtttggaaagtgaattagtagcagttaaagaagtagaagctggttcatccattggttatggtgctacctatactagttctcaatcagaatggattggaactgtgccaattggctatgctgatggttggttaagaagaatgcaaggttttaaagttttgattgatggtcaatattgtgaaattgtcggtagagtttgtatggatcaatttatggttagactacctaaaaagtatgatcttggtacaaaagtaactttaattggagaaaataatggtaaagttattacagctcaagatgtggctaactatgccgatacaattcattatgaaattatgtgtaatataacggagagagttccaagaatttacaagtag

SEQ ID NO: 1449 - DNA, 888 bp, Unknownn
  isolated from dental, unidentified
atggggaaagattcatcacaagaaatgcgaagaacacaagctgaaaaaatgttaaagcaacccaagaaacttcgtgctaagtggataagtcggttatttactttaatcatggtggctgctttaagtgtcgcaactatgggacttttgataaagactacggttttgaacgcagattttactagtaaggaattagctaaagatgaaaatattgggaaattatatactgaagccaatcaaacattagcatcatctgctcaaatgtaccgaattccagcaagttatgcggatagtttaattactaaaaagcaatttagacaagatgttgagattgcaattaaaagaatttatgacggacaagttacacaaattgtggatactaatactttaagcagtcaaattcaaacaaatgtgaataaagaaattgcaagctcaggagtacctgttgacgcgtctgtctttagtggagtagtggagtcactggcttctgtattaagcaattacatcagccaacaaattccaagtacacagttacaacaagtatatgatgcagccagcaatatcagtggttatgtgacattgatgataactgcaggaagtatcatcacagtggtaatgttgatcttagtattattattacagagaagtttatttggttggctgcactatacagggttagcatttttgattacagggataatcttttgcatcattggatatactagtgtgccagcagagatatttccaagtttaattaatcaatcaggaattttgggaagtattgttgaaaactatgcctacgcaattttaagtcagattgtgaatatgggaataatcgaatctgtaattggtatagtggcattattagtaagtttctttagaaaggtttag

SEQ ID NO: 1450 - DNA, 585 bp, Unknownn
  isolated from dental, unidentified
atgtcagtaactaaagaaaacttagaaaaatggttagaaatatttggtgatttaattgaaactaacaaggcatatcttagtgatttagatacaccaattggagatggagatcatggtaataacatggctcgtggtatggctgcagttaaagaaactttagcaagtaagaaaccggaagatattgttggagtatttaaagttacagcgatgtccttgattagtaaagttggtggggcttctggtcctttatatggaactgcatttttagaaatggctaaggctagtgctaaaacagatgatttagcagaattaatggaattagctttagctggaattaagaaacgtggtggagctgaagctggagataagacaatggtggatgtttggacaatattagtaccaaaattgaaagataatagtctaactcaagcagatattgacgcagcagttgaatctacaaaggatatggttgccaagaaaggtcgtgcttcttacttaggtgaacgttcagttggacatttagatccaggtgctgtatcaagtggttacctatttacagcccttttagaagcgggggttatgtaa

SEQ ID NO: 1451 - DNA, 1500 bp, Unknownn
  isolated from dental, unidentified
atgaaaatttttaagaagatgttaatgcttttagctgtactcatgatggtagttacaccatttgctgcgattactgctgatacaacttctagcagttcttccactgatacagctaagacaacagatgattcattgaaaaaggtaaaagaaaagggaacattggtagttggtttaagtgccgattatccaccttacgaatttactactaagcaagatggcaagactgaatatgtcggaattgatattcaaattgctaagaaatttgctaaagatttaggcgttaagttagttattaagaatatgaacttcgattccttactagttgcgcttgaaacaggtaagatcgatacaatcatttctgcgatgaacccaactgaagaacgtcgtaagagtgttgatttctctaacatttactactctggtggtaagtacattgttatcaacaagaaagataagagtaaatatacatctaaggaaagctttaagggtcaaacagttggtgctcaaaatggtactttggaatacaatttgattaaacaacaattccctggagcaacagttaaaggtttagctaagttaaataacttaattattgctttacaatctggtaaagtatctggggtattgatggaagaaccaacagctaaggcttacgtacaaaacaaccctaacttatatgcttataactctaaagtaagtgttgacgttaatgaaacaggggctgcgatggcattccctaaaggagcaacagctttaacacaagctgctaacaagacaattgctgatattaagaaacaagatttattagacaaggaatacgttccagaggctgctaagtatatgaagcaatctagcaagaacaacacaatggctagttactggacatacttcgcaaaaggtattgaatatacattaattatcacagttgtatctgtattaattggttttgttttaggtatcattcttgctttaatgcgtttaggtcacaacaaacttctacacggtttagcagttgcatacattgaatttattcgtggtactccattaatggtacaagtaatgtttgtatacttcggaattggcgcagttattcaatcattacctgctttggcagctggtattatcgctgtatctctaaactccggtgcttatgtcgctgaagttattcgttcaggtattgaatcaatcgcaattggtcaaactgaagctgcaagaagtttaggtatgagtcaaaagcaaacataccaatatgttgttattccacaagcaattaagaatatttggccagctttaggtaatgaatttattaccttgatcaaggaaagttcaattgtatcagttatcggtgtaggtgacttgatgtatcaaacacaattagttcaatctgctacttataaaggtgtagctccattggctatcacaatggtaatctactttgtactaacctttacattatctaaaggcttgaattactttgaagggaagatgaaacatgagtaa

SEQ ID NO: 1452 - DNA, 1734 bp, Unknownn
  isolated from dental, unidentified
atggtaaagttgatgcgacgaaatttagattggtgggcagttattactgctactatctttttaggatttcaagtggtttgtgatttaagcttacctaatttgacatctaacttaataaataacggagtagctaaaggaaatgtaggatatatttggcaaataggtcttcaaatgctggggctgactttagttggtatttttgcagcagcaggaaatgtatattttgcttctactcaagcacaaaaaatgggtgccagattgagagaaaagatatttaaaaaagttttatcctttggaaattatgaaatggataaatttggttcttcatcattaattaccagaacgacgaatgatgttatgcaaattcaaaacgttacaataatgatgttaagaatgatgattatggctcctttaatgctaattggtgcaagtgtaatggcatattttaatgaaaaacgtctaactagcatattcttagtatctattccaatattactaatcgctattggatgtgctatgtattttgcagtgccattatttcaaaaattacaaaaacaaatcgatagaattaatttaatctttcgtgaaggattaactggtgtaagagtaattagagcttttagacaagataagtttgaacaggaaagatttgatagagctaataaagattatacagaaacagggattaaagttttcagcattgtttccttaatgtttcctattatgaccttagttttgaatgtaacaaatatgggaattatttggtttggagctaagttaatagctaaccatgaaatgcaagtaggtaatttagtagctttcatgacttatgcctcaatgattttatttagctttatgatgctatcaatgatttttgtattggtaccaagagcggaagcagctgctaaacgtattaatgctgttttagagatagaaaattcaattaatgacgtagaatcagaaataggtagtgacagtgataaactacaagcaagtctagaatttaagaatgtatcatttagatatcgtggtgcagaagatttagcattggataatttatctgtagatgtaaaggctggagaaacattggctattattggtgggacaggatctggtaaatctacattaattaatcttattcctcgactatacgatgtaaattcaggagaagtattggttgatggaaatgatgtccgaaaatatagcttacatgatttgcatgataaggtagcgttcgttcaacaaaaagcagtactttttaagggaactattcgttcaaacttactaattggaaatcctgaagcaactgaagaagacatgtggaaagctctagaaatagctcaagctaaagatttcatttcagacttaccagatggattagatgctgttgttgaacaaggtggggataatttttctggtggtcaaaagcagagattagcaattgcacgtgcaattatcaaacctgcttcaatttatgtatttgatgattctttttctgcattagactttaaaacagatgctaaattacgtttagcactacgtcaagatgagagaattagcaaagcaattatagttattgtagctcaaagaatttcaacagttactggtgcagatcatattgttgttttagatgaaggcaaggtagtaggacaaggcacacataaggaattattagctgataatactacttaccaagaaattgttgaatcacagatgaaaggagctgcaatctaa

SEQ ID NO: 1453 - DNA, 786 bp, Unknownn
  isolated from dental, unidentified
atgacattaaggattgcattggcacaaattcctgttgaacacgggaaacctgaagaaaattacaaaaaggttgatcaatatttaagcaaggcagcacaagctaaggtggatgtagttgtcttaccagaattgtggaatacaggttatgacctagcaaggttagaagaaatcgcagatgttgaagggaagcgaactaaagaatttctacaagctaaagcacaagactataaggttaacattgttggtggatcagttgcgattaaagagcatgaacagttttacaatacaacttatatagttgataaacaaggtaagcttattagtgagtatcgtaaagttcatttgtttagattgatggatgaagataagtatttagctgctggtgatcaaaaaaatgtttttgaattagctggtgtgaagagtgcatcgttcatctgttatgacatccgattcccagaatggttgcggacagttgccaagaaaaaattgagtgtaatctatgtcgtggctcaatggcctcaaactagaattgaacaatggaaagccttgttagttgcaagagcgattgaaaatcaagcttatgttgttgcagttaatcgagtgggcgataatcctgacaataaatttaatggtcattcactgataattaatcctttaggtgaagttttaagtgatagtggcgatcaagaaacattgacagtttatgatttagatacatccgaaatggaaaaattcactcaacaaattcatgtatttgaagatcgtagaccagaattatacgactaa

SEQ ID NO: 1454 - DNA, 1677 bp, Unknownn
  isolated from dental, unidentified
gtggtagttatctttcattcatttaaaaactttaaacatggcatttttacgctatgtttattaattaatttaattgcttggataggcttgtttctattcagaattttctcaacttttcttttagaacgagctgctgttccattaatttcttttaccaacataactaatattattattaaacatccatttgtagctactggattagtaatagagtttattgttttcttactattgactttttggctagctactattgccatcattggctttaaaatgttgcttacagagagttttaattgggatactctttttcaaaagtcattagaagttcttggtagatatcatctgctaggtggaattattactggagtttatttactaggatttttgccatttttacactttttatttaagacaccttggctaagtaatctaactttaacttctatggtgactgaatttgtatctaaaaatcctttttctttagttggagggcaactactttatatatgtttgctatattttttaattagattttaccttgtcttaccactcatggttttggaaaatgaaggtattctttcctctttaaaaataagttggcaaaccactagcactaagaatttctggaaaaagttctggctagctcttatcaaagttttccttattacttggagtggatatctagtaatattgttacttcaagttatagccgattggattttaccaacatataatttactagctattaattatgctttatttagtctttggggcatcgttagtttgggcataagtataactctggcttatacagaagttcagattactaatccgcgaggaacattcttattagaatttttactaatagctatcaccttcactttgagctttgcaacaggaaaggttttattcaatcaccctattaatcctgtgacaattgctcatagaggtgttaatcagaaaaatggtgtacctaatacacttgaatcactaaaaaagacgattaagtatcatcctgattacatcgaaatggatgttcatatgactaaagataataaattcattgtcttacacgataacaatttgaaaaaactagctggcattaaagctcatccggaagatttaactctagctgaacttaaaaagcttaatgtcacagctaataatcaccagactaaattaactgattttgacacatatctcaaatatgcaaatcagcatcatcaaaagttgttaattgaattaaaaactactcctaacaacgctactgatttcgctaatatttttgctaagagatactacgctaatatcattgaaaatcatcatcaactccacactttagattttcaaactttgatgattttacaaaatgatattccgaagggaaatttaaattatctaatgccatataacttaactattcccgaagaaaatatccatgcatatggcatgcgttattcaactttatcaccagattttgtggcaattaatcgtcagaaacataaattagtctatacttggacccctaattccagattagccattaatgaagctttgagtttaggtgtctatggcattgttactgataatgtttctcaactacatgttgccattaaagaagctcaacattggagcgacgctgaaagattattacaagttttgctatatagctaa

SEQ ID NO: 1455 - DNA, 1380 bp, Unknownn
  isolated from dental, unidentified
atgcaaaaggtaaagaatgatataaaaataaaagttggacagaagtttcctttaacaattaaaagactaggaataaatggtgaaggaattggatactttaagcgcaagataacatttgttccacaagcacttcctggtgaagtaattttggctgaagtaactaaagttcatcctaagtatttaaatgcgaaaataaagaaaattagaaaagcaagtcctgatagggtagaacctgttgataattatgatgttggtgggatagagcttgaacatttagcatacagcaagcagttagaatttaagacagatgttattcgtcaatctttagaaaaattcaaaccaaccaattatgaaaatatggaattacgtccaaccttagggatggaagtaccttatgagtatcgaaataaagcccaatttccagtaagaaaagttaagggaaataaggtaattgccggattatacaaacctaatagccatatcttagtagatttaccaacttttaaaactcaaataccattaacaatggaaataatgagaaagatagttaagctattagaaaaatggaatatttcaatttatgatgaaagaagaaattcaggaatcttaaaaacggttgtaatcagacaaacgctaaagacagaacaagttcaaatagtatttgtaacggcaagaaataattgtgctaacttaaatcaagttgtaaacgaaattatggcagcatatccacaaatcgtatcagtcatgcaaaatattaatccgagccgttcttccttggtttggggtgaagaaacctttaaattagctggaacggatagattactagaacaattaggagacataaaatttgaactatctgcacgatcatttttccaattaaaccctagtcaaactgaagtattatatacagaagtgaaaaaggcattggatttaaaagaagatgaaacactagtagatgcatactgtggggtaggaacaattggtttatttgtttcaccagacgccaaagaagtaagaggaatggatattattcctgaagcaatagaagatgctaagaaaaatgcagaattatcaggtagaaagaatattcattacgaagtagggaaggcagaagatctttttgccaaatggactaaaaataattttgtgccagatgctttggtagttgatcctccaagaactggactggatgataagatgatagagactattttaaagtatcgtcccaataaatttgtatatgtttcatgtaatccgtcaactttagctagagatttagtgaagttggtcaaaatatataatgttgagtacattcaatcagtagatatgtttccacaaacagcaagagtagaagctgttgttaaattgagtaaaaagtaa

SEQ ID NO: 1456 - DNA, 1257 bp, Unknownn
  isolated from dental, unidentified
atgacttatgctgaaaaggtattagatgaaattgaaaaagaaaattatgaagaagcacgtaaacattttggctggtctttaagaaaagattcagatgatatgatatatagtttggcagaagaattatattctttgggattttctaatatggccaaatgtgcctatcaaaccctattggaacgttatcctgacgaagatagtttgaaaacagctttggcagacatcgccattagtgaaggtgaagataatgaagctttagaatatctaagtagtattacaccagactctgaagcatatcttcaagctttattagtttcagcagatttatatcaaacacaaggaatgtttgaagtaagtgaacaaaaattattgcaagcattagatctagctcctgatgaagaaattatacgttttgctttagcagaattgtactacaatatcaaacaatataaacaagcaattcctatttacttagatcttatcaagcaaggtaatttctcaatttcacaagtaaatctagtacagagattgggaatgtcatatgctttatcaggacaatttgaaaaagccttggcatacttggaacaaattcatagtgaagaaagagacgatgatacacagttccaattaggaattactcaatatgaattaggacatattgaagatgcaattagtagttttgaaaagttaagggatacttctccagattatgctacaacttactcatatttagcagtagcttatgaaaaagaaggacaacttcaaaaagcattaacaaccttacaagaaggaattgcagtagatgaatacaatataaagttgtatcaaaaggctagtgagttagctgctaaattaggtcaacgtgatgaagctgagcgttatttactaatagccttagatcaggaacctgataatttaacaattgtaattatgttgagtaatttacttattgagtatggaaaattcgaacaaaatattgaattactaacagattatctagatcaagatgaaatcgaccctcaactatattggaacttaggtcgttcatatgctaatttagataactatgatgatgccattaagtattatgatgcggcttctgaacaaatttcatcgttagaattcttaaaagatgctgcaattttttatcgtaatgctggcgatagacaaaaagctaagatgttcgttgatgaatatctagtaagtcaacctaatgatagtgaaatgttagaattacaagatgaattgttatattag

SEQ ID NO: 1457 - DNA, 762 bp, Unknownn
  isolated from dental, unidentified
ttggaaataacatcaacaagtaatagtagagtaaaagaatggaagaaattaaatactaaaaagggaagaaaaagacaaaataagtatattcttgatggtttacatttagtgaaagaagcactaaaagcaaataagaaagttgaagaattgttaataacttctaaatttgagcatctaaatgaaatagaaatcccagatgaaactaaggtgattatgatttctgaggaaatttcgaaaagtatttcagaaactcaaacgccacaaggaatttttggaattgtatctattgaagaagaaaagatcacatatcctcaaaaggacgtaggtgcttggttaatgttagatggtgttcaggatccaggaaatattggaacaatggtacgtactgcagatgctgctggtttctctggagtaatcttaggagaagggtcggcagatttgtataatcctaaagtcgtaagagcaatgcaagggagtcaatttcatattaaagttattaatgacaatctctctggttggattagacattttaaagatatgaaggttcctgtttttggaagtgaacttaacgaacatgctagagagtatactaacgtcggacaacatactgattttgccttagttatgggaaatgagggaaatggaatgagtaaagaaattttagagatgacttcaattaatttgtatataccaataaccaatgctgaatcactaaatgtagcggtggctgcaggtatactaatgtttgctttgaagaaataa

SEQ ID NO: 1458 - DNA, 1140 bp, Unknownn
  isolated from dental, unidentified
atgggaaatgaagtgctttttccaggtgatactctggggattattggtgacagttctaatggaattagattggctcaaacagctaaaaggctaggatttaaagtgattatttatgctactaacgaaggaagtcctactttagcagatgcagatgttaagattgtgggtgattttagcgataaggctaagttacaagattttgctgagcgttgtgatttagtaatgtatgaatcagaacatatatcttctgaagttattgcatatctacaaaaattcactaaagttccgcaaggttctgaaactttagaaattgtacaagatagattgttggaacgtgctttctttgaacaaatgaatataaatattgccccttatgcaacaattgttagcttagaggacgtttatcaagctgttagttcaattggctacccttgtgtattaaaacctattcaaaaaggatttggacctaaacgtcaacaaataattcgtaagcaaacagacattgccaaatgtgcagatattattgatatggggacttatatcttagaatcgtggataccttataataaagaactatcagttataatgacacgtgattatgatggaaatttagcatattttcctgtaattgaaactagatataaagaaaatcgtcttaatgaggcaattgtaccagctaatatccaacctgatgtagaggaggaagtaaaacgtttagctggtgaaattgtcagtggtttaaaatatgtaggtgctttagaagtagctttctatctaactgaaagtggttctttgtatgtaaaaagaattgtgccagctttacacaattctggctacgtctttgataaagcaactaatgtttcgatgtttgagcaacatcttagaactttggtgaagatgccattagttgatattaaattagttcaacctgcaggcatggtaatgattgaagaagaaaatattgatgacattcgtacacaatgggtactaaaaaataattggtattatacattctttagatacccagaatcaatgagaccacaaccagaaggctatattatagtattagctgaaagtgaaatggaaataaaacaacaaatagaatcgactggtatttgggacgatttatcaaaagaataa

SEQ ID NO: 1459 - DNA, 1956 bp, Unknownn
  isolated from dental, unidentified
atgggattgatttatattgcgaatacagctttactgatgtttaatgtcatctattatcgtgaattcacagattttatgacgattaatacgatatttggatactctacggtgtcacaaggattgagtggaagctcgtttgcattattgaaaccacaagatattattattgttgcagatataataatagttgctttaggctttatcacaggttttcttcatttagacaaacgcccaattccacgagtgcaagcattagctttaacttcgttttcgttgttttgtttagtattgaatattactttaggtgaaattagccgtccacaattattgtcaagaacttttgatagaaattatctagtaaagtatctgggaatagatacctatatggtttatgatggattgaagacggcaaggaacagtcaagttcgtaataaagctggaagttcagacttaaataacattattaattttacgcgtaatcattatgctgaaccaaattctaaaatgtatggaatagcaaaggggcgcaatgtaatcgttattcatttagaaagttttcaacaatttttgattaactacaagctaaatgataaggaagttaccccatttttaaatagtttatataatagtaaagagacatatagttttgctaacttttttaatcaggtaggacaggggaaaacttctgatgctgaaaatatgttggaaaccagtacgtatggattatctcaaggttctctattttcaatacttggaactgataatacatttgagggagctccggctatattaggtcagtctcaaggttatacctcggctgtttttcatgggaattctggatcattttggaatagaaataatgtatataagaatttaggatataattatttctttgattctagttactataatactgatgcaaataatttaactgaatatggattaaaagataaattattattccatgattctgttaagtatttagaaagactccaacaacctttctatactaaatttgtaactgtatctaatcattttccatttgccttagatgatcaaaatacatcttttgataaggctaatacatcagatgcttcgataaataattattttgtgacagctcattatttggatcaagctgtgcaagaattttttgaatatttgaagaagtcaggattatatgacaattcgattatcgttttatatggtgatcattacggaatatctgatactagaaatttaaaattggcttcattattaggtaaatcttcatccacatggagtgattttgataatactcaaatgcaaagagtgccatttatgatacatataccaggtactaaagatggtggtgttcaaactcaatatggtggagaaatagatgtattgccaacgttactgcatctattgggaatagattctcgtgattacattcaatttggaacagatttattttcatcaaaacacgatcaagtagttgcttttagaaatgaagattttataacaccaaaatatacagtgattggtaatactatttaccaaaatagtacgggaaaaatattaacccatcctagtcaaaaagttaaggatgagataaagaaggatagggaaaaggttaataccgaactatccttatcagatacattgaataacaagaatctcttaagattttatataccaacgggatttactcctgttgatcctaagaaatataactacactaatcaatatggtcagattttaaagattcaagaggatttaggaaagaagtctacatcgctatggtctaaaaatggaaataaaacaactattgatgattatagttcagacgcacctgaattaacaacaacagatcaaaatgaagctaatgtatcaagtgtaaagaacacattaaaatccaacaaaaaagaatcaatagatacatcatcttcatcggcagaaagtgattctgattaa

SEQ ID NO: 1460 - DNA, 1689 bp, Unknownn
  isolated from dental, unidentified
atgactgaaaagaaagtaattactgctcaagctcaagggcataacggaccaattgatttggaaattggagttgaaaatcaagaaattataaatgttgatgtaaagaaacattctgaaacaaaaggtatttttaatcaagttttctcaaaactaagaaatgatattcttgataatcaaagttttgatatcgatgcaattagtggcgctactgtcatgagtgatgcaattttgaaatcagctaaagatgcggtggaagaagcagaagtaaagattgattctaagaaaaaagatattcctcatgtaactgaagaattgcatacagatgttgttgttattggtggtggagaagctggcttagttgctggatgtcgcgccttaaaattaggaaagaaagtaattttagtagaaaaaaatggttacctaggtggagctacaatcctaaatggttctaatgtaactgcaacaggatctaaagttgctaagaatatttttggtgatgaagcggataatgatacaccagaaaaattagcagatgatgttagacgtgaatcaaaagatactaatgttcctgagttaactaatttaatggcaaataacattggcgatgcaattgattttatttctgaatttgccggtttagaatatcgaaaagctcaaactcaaacaccagaacattcggttgaacgtcaagttgaattaccaacatcaagtagttatgaatttatcactaaagttgctaaagcttttgaagaaaaaggtggtcaaatcttacttgatagtcgagtagaagaagttataactgacggtgataagattacaggtattgtgactgaaggaaagcataaaacaactaagatttttgcttcggcagtggtcttagcttccggtggttatggtgctaatacaaagatgcgtggaccagaaagtcaaggtttatactattatggaccaatgacatcaactggcgatgcttatcaatttttagctccattacaattgaagacaagaaacttaggctggtataaagtatatcctcatggggtagaaactgaaccaggaattgctaagttaacaacgtatgcatctaaacttgctactgatatgggagcaatttatgttaatacagatggtaaacgaatcgttaatgaatctgatgtatatgctgaattaagagatgcagtcttaaaacaaaaagacagagtggcattcttagtaatggataagcgaacatgggatgaattctataagttgttagtcttacatgactttagtgaaagtgaaatcgctgattactttgcaaaagacggaaagagtaatccaattcttgtgaagggtagtttacaagaagttgcacaaaaagcaggtattgatgtagctggtttaagtgagactgttcaaaaatacaatgactatgctaaacaaggaaaagatgaagaatttggccgagatagtaaattcttacatgagtatgaaggcgacgaattttacatcattgaacaacgtgatcgttttgcaaccacattaggtggatttgtaacagatgcagatttacatctacaatttgaaaatggtaataaattggctaatgtagttgctgcaggtgaagtaatcggtggaacaaatggacatgattctatgccaagtatgatgaactcatggggcatttcttccggatttgtagcaggaaaa

SEQ ID NO: 1461 - DNA, 732 bp, Unknownn
  isolated from dental, unidentified
atggatgaaaatatacttaaattaaaaaaattagtttcagagagtagtaatattgtcttttttggtggagcaggagtatctactgaaagtggaattccagattttagaagtgaacaagggatttataatacagtaaagaattttggttatcctcctgagcaaattttatcgcattcattttttatgaaaaatccagaaaaattttatgatttttatcgttctactatgatatatgaaagtgctaagcctaatttagcacatttaggattagctaaattagagaaacaaggtaagttaaaggctatcgttactcaaaacatagatggattgcatcaattagcaggaagcaagactgtttacgaattgcatggatcaattcatagaaattattgtatgaaatgtggcaaattttacccattaagtacaattacagaaagtaagggtgtaccacaatgtaaagagtgtggtggtacaatcaaaccagatgttgttttatatgaagaaggattagatgaagaaattatcaataatagtattaaagcaataaaaaaagctgacatgttaattgtaggtggaacttctctaaatgtttatccagctgcaagttttgttaattattatgatgggaataaactaattttaataaataaaagtaagacaccttatgatagatatgcagatttattaatccatgatagtataggaaaagtttttaatgaaataatagagtaa

SEQ ID NO: 1462 - DNA, 1452 bp, Unknownn
  isolated from dental, unidentified
atgtcttatgaaatcaaaggattaaacgaagagtgtggagtctttggagtttttggagctgaaaatgcaagtcaattgacttactttggtttacatagtttacaacatcgaggacaagaaggagcaggaattgtttcgagtgatggcgatagattacatcaacatcgcgataggggattattagcaaaagtatttgctgacgggaaagacttactaaggttaactggagatagtgctattggccatgttcgttatggaacaagtggtaataattctatcaataacattcaaccatttttattcagatttcatgatggtgatgttgctttagctcataatggtaatttgactaacgctgtaactttaaagcgaaatcttgaagacagaggggcagtttttcagtcaaattcagatactgaaattttaattcatttgattcgtcaaaaacaaaattgcacttttattgaagcacttaagcaaagtttaaacgaagtaaaaggcggatttgcttttctactattacgtaaggatagcttaattgcggcactggatccgaatggttttcgtcctttatcaataggacaattagataacggtgcatacgtagtagcaagtgaaacttgtgcgttggacacagtaggagcaaaatttgttagagatgtgcagccaggcgaattaattgtaatcaacaaagatggtatgaagatagatcgatatactgataaaacacaactatcaatttgttcaatggaatacatatattttgccagacctgattcaattattcatggtgtaacggtgcataatgcgcgaaagagaatgggaaaacttttagccaaggaacaaccagcagatgctgatatggttattggcgttcctaactcctcattatcggctgcttctggatatgcagaggaattgggactaccttatgaaatgggattaataaagaatcagtatgttgctcgtacatttattcaaccgacacaagaattacgtgaacgtggagtaaagatgaagttgtcagctgttagaggggtagttgaaggcaagcgagttgttgttgtagatgattcaattgttagaggaacaacttcaaagcaattagtaaaattattacgagaggctggagctaaagaggtccatatgcgaatttcatctccaccatttaagttcccttgtttctatggaattgatatttcaactcgttcagagttaatggctgcaaatcatactgtagaagaaatgtcagatttaataggtgcagatagtttaggatttttgagtataccatccttaataaaggctatttctgttaaaggcggtgccgattatcctaatggtggattaacggttgcttattttgatggtaagtatccaactcctttatatgattatgaagaagcttacttaacttctttgaaatcacaacaagaaagagaggaaaagtaa

SEQ ID NO: 1463 - DNA, 564 bp, Rothia dentocariosa; identical to SEQ ID NO: 110
  isolated from dental, Rothia dentocariosa

SEQ ID NO: 1464 - DNA, 2829 bp, Unknownn
  isolated from dental, unidentified
gtgctggaaggacttataggttggcttagacagtgctacctaaatgtttataacaaaagaatattatttaatgaagtggttaacgatgacatcgttgcaagtaaggtggtaccgcgtagtaattgcgtccttactagcaacgatgttttattgtttttgggctttaaaacagaaaggaatttgaaaatgaaagaattatcaagtgctcaaatacgtcaaatgtatttagactttttcaagagtaagggacacgatgtaatgaagagtgcaccacttattccacacgatgatccaactttattgtggattaactccggtgtcgctacaatgaaaaaatattttgacggttcagttgttccaaagaaccatcgtatcactagttcacaaaaatctattagaactaacgatattgaaaatgtaggtcatacagctcgtcaccatactttatttgaaatgttaggaaacttttctgttggtgattacttcaagaaagaagctattacatgggcatgggaattactaacaagtcctgaatggttcgatatggataaggaaaaattgtacatcacagtttatcctgaagataaagatgctaagaagtattgggaagaagtaggggtagatcctagccatatttatgaagctgaagataacttctgggatattggtgaaggtccatctggtccggactcagaaatattctttgatcgtggtcaagaaatgaataatttaccagaagatgatcctgaaagttatcctggtggagaaaatgaacgttatttagaaatctggaatattgtattttctgaattcaatcataagccagacggaacatatgaaccattgccacataaaaacattgatacgggtatgggattagaacgtgtagtatctgtattccaacatgcacgaacaaactttgaaacagacttattcttaccaattattgaaaaaactgctgaattaagtgcaggtaagaagtatggtgaaaatgcagaagcagatgtttcctttaaagttattgcagatcatgcacgtgcagttacattcgctattggtgacggtgctttgccttcaaatgaaggtcgaggatatgttattcgtcgtcttatcagacgtgcagttatgcatggtcaaaagcttggaattgatgaagcattcctttataagttggttccagttgttggaaaaatcatggaatctgcatatccagaagtgttagaacaagctgaatttatcgaaaaagttattaagatggaagaagatagattcaacgatactttgaaagatggtatgcaattattagatagcttaattgctgaaactaaagaaaatggtggtaaagaattaccaggaaaacctgtatttaagttatatgacacatatggattcccattagaattgacaaaagaatatgctaatgatgaaggccttgatgttgatgaagaaggtttcaatgaagaaatggaacaacaaaaggcacgtgcaagagcagctcgttcagatgctaagtctatgggtgttcaaaatggcttattaactgatattacaactccaagtgaatatgtaggttatcatgaattgaaagctaatggtgtattaaaagatatcatcattgacaatgaattagttgatacagttccagctgattctagagcacaagttatctttgataaaacaccattctatgctgaaatgggtggacaagtagctgataagggtgttatcaagaaccaagctggcgaagttgttgctgaagttgaagatgtacaacatgctccaaatggacaaaacatgcatacaatccacgcacttaaggaaatgactagagaaaatacatattctctagaagtagatgttgctttccataataaagtgaagaagaaccatactgcaactcacttattagaccaagcattgagagatgttttaggttcacatactcatcaagcaggatcattagttgaaccaacatatttacgttttgacttcacaaatctaggatctgtaacagcagaagatttgaagaagattgaagatatcgtgaatgctaagatttgggaaaatattcaagttgaaacagttgttacagataaggaatcagctgaaaaaatgggtgctattgccttgtttggcgataagtatggtgatacagttcgtgttgttaaagttggcgattactccatggaattctgtggtggtactcatgttgctaatactaatgaaattggtttattcaagattgtttctgaatcaggtgttggtgctggagtaagacgtattgaagctgttacttcagaagaagcatttgaattcttagaagaaagaaatcaattattacgtcaaagtgctgatgaattgaagatagtacaaattaaagaagttccacgtaagattgaacaattacaagaacaagtcaaattgcttgaacaacaaaaacaagctttagaagataagtttgcaagtcaacaagcaggagatatctttaagaatattaaagatatcaacggcaagactttaattgctggtcaggttaacgtttcaggcatgagtcaattaagacaacttgcagatcaatggaaagaaaagcaactttcagatgtacttgtacttgctactgcaacagcagatggtaaggttaacttaattacagctattagtagcgatgcagttaaggaaggttataaagccggagatttaattaaagcaatcgcacctaaagtaggcggtggcggtggtggccgtcctgacttggcacaagctggtggtaagaaaccagaaggcattcaagaagcattgaaagctgctgaagattggttgaataaataa

SEQ ID NO: 1465 - DNA, 924 bp, Unknownn
  isolated from dental, unidentified
atgagtaataaagtaacagttttgggaagcttgaatgttgatactattctgagaatacccagattaccacagccaggtgaaacattgaaaatggacgatataggtgttgcaggcggaggaaagggagcaaatcaagctatttcagctgctagatctaaatcacatgtaacatttattggtggagttggcaatgatgttcaaggtgagatgatgttgaaactcctaaaagaagatggaattaatattaataatgttgcaaaattaaatgaaggaactggtcaagcgtttattttattgcaagaaagtggtgaaaatagcattgtaatctatggtggtgcaaaccaagccataaaaaccactgttatacaaaatgcaatgaatgatataaaggatagtgattttttagtagcccaatttgaaacacctctagaagtgacaaatgaagcatttaaattagcacgtgagttaaatgtaaagacaattttgaatccagcaccagcgactgatattttagacgaactaaagaaaaatatagatttaataattcctaatgaaacagaggctgaattgttaactggaataaaagtagttgacgaagatacatgtagtaaagcggctgacaaattaattgatcaaggtattaacaatgttattattactttaggtaagcagggggcttattataaaacaaaagatggcgtttgtgaattagtacctgcttttaaagttaaagcgattgatactacagctgctggtgatacatttatcggtgctctagtatctaaattagatactagttttagcaatttaagggaagctattatttatgcaagtaaggcttcttctctagctgtccaaagattaggtgcaattccatcaataccatataaagatgatgtagaaaaacagttaaatagtaaatag

SEQ ID NO: 1466 - DNA, 1119 bp, Unknownn
  isolated from dental, unidentified
atgttgggagtgaggcttttgaaacgattacttattctagaagatggtagtacatttttaggagaaggttttggttcacaaataaattcaactggtgaggtggtattaaccactgcaatgactggttatcaaaaggttgtcacatccccaacgtatgcaaatcaaataattgtttttacgacacctgtactgggaacatatgggacaaacattgatgatttagaatcattgcaaccagtctgtaaaggtgtcgtttgtcatacatacactgatagcatgaatgtgtcgagtccacagtcattttcagattacttaaagaatcaagatattcctggaatttatggtattgatacacgaaaattagtaagaattttgtcaaaacataatggaataatgaaaggaagtattattgacgctgaaaacgatctagaacatgcttttgatcaattacatgcaactgtattaactgaccaattagtagatatggtttctactagtaaaccatatcctaatcctgataccggaagaaatatagtcttagttgattatggggtaaaacatagtgtattgcgtcaattatcacgtatgaattgcaatacaattattgttccatacactgcgacatttcaagaaattaaaaatctttgtccggatggtgtgctattatccaatggacctggaaacccatatactttagaagattcatttgaaacaattagacaaattcaggctaattatccgacatttgcaataggattaggacatcaattattggctattgcaaatggagctaaagtaaaggaattaccacgtgcacatcgaggattgaattttccggttattgaaattgcaactggcagaattataacagttgcacaaaatcatagttacatagtcgatgaaagttcattacctaaagataacttaattgtaactcacaaagatttaaatagtgggtggattgaaggtattaagcatcgaaaatatccaactttttctgttcaatttgaaccagaaggagctccaggtcctagtgatggaacagatgtattctatgattttatgcatttaattgacataaggaaggataagataaatgctattagagagtcaaaataa

SEQ ID NO: 1467 - DNA, 993 bp, Unknownn
  isolated from dental, unidentified
atgaaagatgtagctaaagatgctaatgtatccgtggcaacagtttcaaattatattaatgggaaaaaagttagacctgaagtcgaagaacaagtcagacaatctattgaaaagttgcattatgtaagaaatgcagctgctagggcactgaaaactagtgaatctaaatatgtagtttttgttttacctacagtttggtctccatttttttcagaattaacattttgggtacaacaatatttaaatgatatgggatataaattaatactcagtgtttctgaaaataattattttaaagagaaatcatatgtaaaaatggctgaagagcaaagggtagcagggataatatcaatttcttactctgatttgaatagccatgttccggctaatattccattagtatcaatagaaaaagatgatacaggaatgtttccattagtaacatctaataattatgatggtggtaaaattgcagcatctgaattccataaaagaggagtaactagtgcaatatatgctggtacattacatgaagaattttcaccaatgattgctagaaagtctgggtttatagatcagtgtaataatttaggaatacattatagcattctagatgttccatcttctaaaaatactgaagactttcataaatttttaaaccagctatcagagtcagtaaaagataaagaagcagattttggaaaactgggaatatttgcttattctgatgaggttgctattcacataaaagaaaagctagatgaagagaaaataaaagtaccagaacaagttcaaattataggctttgatggtagtaaaatatatcctaatacaagattaactgtgtcttctattagacaggatgttcaacagatagcaaataaagcaactgaaatacttgataaacaaataaaaggaaattcagaaagagaagcatcacgaataatggttcctgtaaattttcaacaaggtttaacaactacatcaatatag

SEQ ID NO: 1468 - DNA, 1131 bp, Unknownn
  isolated from dental, unidentified
atgaactttaaattaattgcaacatgtgctgcaggtatagaaagtatcgttggtaacgaactaaagcatttaggttataaagtgaatgttgaaaatggtcgagttagatttgatggcgacgtagctgatatcgctaaaacaaatctatggttaagaacagcagatagaataaagattgtagttggtgaatttacagctaaaacttttgaagagttattccaaggtgttgaaagtttaaactgggaagattttctacctttagatgctgaatttccagtagctggtaaatctcaaaaatctactttacataatgtaccaagtgttcaagcaataactaaaaaagcaattgttactaaaatgagtactgtctatcatagaagaactaagttacctgagacaggggcattgtatccaattgaagttgctattaataaggacaaggtcttaattacattggatactaccggtagcagtttattcaaacgtggatacagagtaaataaaggtggagcccctctaaaagaaaatatggcagctgcattagttctattagctcgctggtatcctgaaatgccatttgtagatccagtatgtggttctggaacaattccaattgaagctgctttgattggatgtaatattgcacctggtttgaaacgtaattttgcctttgaagactgggattgggttgataaagacattattaaacaagcaagagaacaagcacaagcagcaatcaagaaagatattgatttagatatatctggatatgatattgatggaagtatgattgaaattgctaaagaaaatgctgttcaagctggagtccaagatatagttaacttcaagcaaatggcagtaaaagacttcaaaacagataagatcaatggtgttattgtagctaatccgccatatggtgagcgtttaagtgataaagaacatgtacatcaactatatcaacaaatgggtaaactataccaaccattaacatcttggagtaagtacattttgacaagtgacttacaatttgaacaattttatggaacaaaagctactaaacgtagaaaattatataatggttccttacgtacagatttcttccaatactggggaaagaagataagaaattaa

SEQ ID NO: 1469 - DNA, 2364 bp, Unknownn
  isolated from dental, unidentified
atggcaaatcttcttaaacgttgggtggaaagtgataaacgagagcttaaacgcctaggaaaaattgctgataaggtagaatcatatgctgatgaatttggtgctttatcagatgatgaattaaaagcaaaaacagaagaatttaaaaaaagatatcaagatggggaaagcttagatgatttattacctgaagcttttgctgtctgccgagaaggtgcaaaaagggtactaggcttgtatccataccatgttcaaataattggtggtatcgttttgcacgaaggtaatattgcagaaatgaaaacaggtgaaggtaaaactttgactgctacaatgccagtatatttgaatgctatttctggtaaaggtgttcacgttgttactgttaacgaatatttatctgaacgtgatgccacagaaatgggagagttatacacatggttaggattaactgttgggttgaacttagctgataaatcaccagaagaaaagcgtaatgcttataattgtgatattacttattcaactaatagtgaacttggttttgactatttgcgtgataacatggttgtttacaaggaagatatggttcaacgtccattgaattttgttatcgtagacgaagttgactctattttaattgacgaagctagaacaccattgattatttctggtcaagcaacgggaacgacaactctttatactagaactgatcgttttgctaaaactttgacagaagatgaagatttcaagattgatttggaatcaaagacagtttcattgacagaagatggtattcgtaaaggtgaaaaatattttggattaaagaacttatatgatccagataatatggcactaaaccatcatttggataacgctctacgtgctaattacatcatgctaagagataaagattacgttgtacgcgatggtgaagtgctaattgttgatcaatttactggacgtattatggatggacgtcgttactctgacggattacatcaagctattgaagctaaagaacatgttgaaattgaagaagaaacaaagacaatggctaacattacttatcagaacttcttcagaatgtataataaactttctggaatgacaggtacagctaagacagaacgcgaagaattccgtgaaatttataatatggaagttgtatctattcctacaaacaagccaattgctcgtgtagacaagcctgatttgttatatcctacactaaagagtaaatttaatgcagtagtaagagatgtaaaagcacgtcatgaaaaaggacaacctgttttagtaggtacagttgcggttgaaacttctgaattattgtctaagatgttagacgatgaaggcataccacactctgttttaaatgctaaaaaccatgctcgtgaagctgaaattgtaatgaatgctggtcaacgtggtgcggtaacaattgctactaacatggctggtcgtggtactgacatcaaacttggacctggtgttcgtgaattaggtggattagctgttattggtactgaacgccatgaatcacgaagaattgataatcagttacgtggacgttctggtcgtcaaggagatccaggtgttactcagttctatctatcattagaagacgatttaatgttgcgttttggatcggaacgtattaagaatttcttggaaagaatgaaagttagcgatgacgatgcagttattcaatctaagatgataagtcgtcaagtagaatcagcacaaaaacgtgttgagggtaataactatgatactcgtaagcaagttcttcaatatgatgatgttatgagagctcaacgtgaagttatttatgctcaaagacaacaagtaattatggaagaaaagagcttgaaaccaataatcatgcctatgattgaaagaactgtaaagcatacggttttgatgcatactcaaggtgataagagtgaatggaatttgcaaggtattttagattttgctgtttctgcaatggttaatgaagatactattagtttaggtgatttagtgaataaaacaccagatgaaattgttgactatttaatgaaacgtgcagaagatatctatgctgaaaaagaaaaacaattgtatgacgaaagtcaaatgttagaatttgaaaaagttgtaattctaagagttgttgactcattgtggacagatcatattgatgaaatggaccaattaagacaatctattggtttgcgtggatatggacaattaaatccattggtagaatatcaacaagatggtttcagaatgtttgaacaaatggtaggtgcaatcgaatatgatgttactcgtttgttcttgaaagctgaaattagacaagacataaagcgataa

SEQ ID NO: 1470 - DNA, 1173 bp, Unknownn
  isolated from dental, unidentified
atgaagaataataaaatgtgtgcaatcttagggaatgaacatgaatatacggaattactaccattgaccaaaagaagagcattagctactctttactttgactgcaaataccgtatcatggattttgctttatcaagtattgtaaatgctaatattcgtaacattttcttagtggtaaaccaagctaaattaaaatcctactttgaccatttaggtggcggtagagaatggggtttagatagcattggtagttatcgctatattaacttttctcaagatttagttcgtcaaaaagtagaaggtcaaaaatattttgatgatgtaattgattacttagaaaaatcacgttcaacatatactgtttttgttggtaataagatgttaaacagtgttgatttgaaagctgttttgaagattcataaggcacaaaagaatgacatgacagttgtattcaaacgtatgccaaaagataagattgcttctgatgatcaaattttagaaattgatgatcaaacaaatcgtgtaaagggcaatcataactttagtgaatattcacataattctgatatttacaacttatcaatgaatatcttcatcattgaaactcaaaacttaattaaccaacttcgtaaaggtcaaagaataggtgcatctgctaacttagaagacttcttcttaagtttgattagtcgtttaaactgtggtacatacgaatacacaggatacatgtgcaatatctttgatgtgaagagttactatgatgctaacatggatatgttgaatgtcgatcatatgaattcattgttatacagtagccaacacattattactagaacaaagaatgaagtagctactcactttactaagacttccgatgttaagaatagtcaatttgcaacaggatgcgttgttgaaggatatgtaagaaacagtttagtatcacgtagaacatttatctctgaaaactctaaagtagaagactcaataatcatgtctaatgctcgtattggaaaagatgtagaaattaaatatgcaatcttagacaaagatgttgtagttaaatctggtgtaaagattatcggaactccagaaaaccctgtagttattgaaaagaagatgaaagtaacaagtgatgttattcaagatacacctagggaggatgttgaagactaa

SEQ ID NO: 1471 - DNA, 1815 bp, Unknownn
  isolated from dental, unidentified
ttgcaacaaattcgttcagatttgcaatttatcgatcactatatcaatgttttcaaacgtagttggggaagctacttgtttttctttttagggattaatttgtttattgaggcaattgttatccccatttttacgtttttaactagttggattttaaagctaagtcatattccatatgtttcatatactaatattttagaaattatcactcatcaccctgttggatcatttgctctcattttagaattagttctgatagttggtgtaattttcttccagtttacatttttactaacaggtattactaatatttctagggataatttttcacttaaagaagtttggtttacttcttgggaacgtttaattcaacttcgaccaacaagtattctattcttcattggatattttatccttattatgccttttgctaatttaatttttaaaacacctttactgaataaagcaaagattccagcattcatcgttgatttcttattagctaaatggcaatttgccttattacttgcagttgcttatcttatcgtcttttacctaggactcagattactgtacactttgccgttaatgattattcaaaattatcatactcgcgaagctgtatctaaaagttttaagttaactagacatcaaaatcttgctaatcttcgtaggatggctgttatctctatttattttggcgctattactgcggtcggatatttactagtcttacttctccaagtgggatttgacaaacttcctaagccttttgacttaattatggctattatcatgctggcaattatccagatttttagcacttttattgcaacaattgttagttttctcttacttcaaatgactttaccaactgaagtatttaagggacatcctactttttaccatagtaatcgtatcaatcaacgtaagaaaaagatcagaattactactgttattttgattggcttcattgcattactatcactaaccaatgattacttttatttacatagtaataatatcccaccccttcgcatctcacatcgcggtgttgatgacggtaatggtgtacaaaatacaattccagctatggctgctactattaaagaacatccagattttatcgaaatggatattcatgaaactaaagatcatcaatttgtcgttatgcatgacgaaaatcttaaaaatcttactggcgtcaacaaagctccttatcagttgactctatctcaaattactaaattagtagctcatgagaatggtcatgctgctcacgttgtaagttttgacgattatttagcttatgctaataagcatcaccaaaaattgttaattgaagttaaaactactccacacgattcaaaagatgtcgttgatatctttttgaaaaagtataagaaaaatattttgaaacatcatcacgaggttcattccttagattacaatgttgttaaacaaattaaagctaaagctcctaaaatatttgtaagttatatcttgccttataacttcacctatcctcaaacatctgccaatgcatatagtatggagcaatcaacattaaacgattcttttattgttgattctctctttaatcaacaaaaagtatatgcttggacagttaatactgacagtgaaatggatagaattttgtggttaaatactgatggtattattaccgataatttgtcagctttagatagtaaaataaatgatttttatcatgatccttcttatgctgatatgcttttcaattacattacggttattccttatagcaattcaataactagtgaggccagtgtgtaa

SEQ ID NO: 1472 - DNA, 828 bp, Unknownn
  isolated from dental, unidentified
atgactgaatggttaggattaagaaataaagttgttgtaattacaggtgctgctggtggtatgggaacaaagttttctcatgactttgctgaacaaggtgctaaattagtattgatggatattgctgaagaacgtgttgaaaaattaagtaaagaattagctgatgaatttaaagtagaaacacttgaagttgtatgtaattctacagatgaacatgatgtagatgaagctgtaaagaaggtagttgataaatttggtcgtgttgacgtattggttaacacagcagcaattcttcgtttctcaccattagaagatttaacatttgatgaatggaaacaacaaattaatattaacattaatggttatttcttaacttctcaacgatttggtcgtcaaatgattaaacaaaagaaaggtacaatggttcatatttcaacagttgcttctcatttcccagaaacatactctggtgcatatagtacaaccaaagctgctgtaaacatgatttctaaacaaatagcagccgaatggggacaatttggtgtacgtagtaactgtgtacttccttgcttagttaagactccattatcaaaagacttctacaaagataaggaagttgaagatggacgtagtcgtttagtagcaagcaagcgtattggtgaattaaaggatatttctaatactgtactattcttagcaagtgatcgttcagattatacaaatggtgatgaaatcaatgttgatggtggtatcggtattatgatgcaagatatgattccaaagccaggtggacgtcgtcaatatgcaattgaccaccacaagaagtaa

SEQ ID NO: 1473 - DNA, 1008 bp, Unknownn; identical to SEQ ID NO: 348
  isolated from dental, unidentified

SEQ ID NO: 1474 - DNA, 687 bp, Oribacterium sinus
  isolated from dental, Oribacterium sinus
atgaataatcaaggtatacagtcatatttccagtttaagaatgttaactggccagatatgtggagtgcaacttgggaaacaatttggatgacagtcgtatcaatcgctatcgtcgcaattttaggattattattaggtctgctattatttgaaacttcaggtagtgataaattatcggttaagatcttgaatgttattgttggagtatttgttaacattttccgctccatcccatttattattttaatcgtattactgttaccattaacacaagttttggttggctcaattacaggagctaaggccggaattccagctttagttatcggtgcttctccaatgtacgctcgtttagttgaaattgcatttcatgaagtagacaaaggtgtcattgaagcagcagtggcgatgggagctaacaaatggcaaatcttatacaaagtgttaattcctgaatcactacctgcactagtttcagggataacagtttcaacaattgcgttgattggttatattgccatggctggggcaatcggtgcaggtgggttaggacaacttgcctataccgatggattccaatcctacaacaatgcaataacattagtcgcaactgtaattatcgttttaatcgtatttgttttccaatggttaggcgactcaacagttaagaagattgataaacgttaa

SEQ ID NO: 1475 - DNA, 1149 bp, Unknownn
  isolated from dental, unidentified
atggaagaaaaagaaaagattaaaattttgcaggatttaatacaaattaattcagttaatggaaatgaattagaagtagcagaatatttacacaagctttttgcaaaatcaaatttagaatcaaaggttgatgaatttggtgatagaagagctaatttagtactagatgttggacaaagcgagaaagtactaggacttacaggacatatggatactgttgcattaggaaatgaagataagtggagctatcctccattagaagctaaaattgatggtgacagattatatggacgtggagcagctgacatgaagagtggcttggcagctttagcaatagcaattattgaattatcagatttgggaaaaataccaggacatattagatttattgcaactgctggcgaagagtatggtacaccaggagctaacaggctaagagatttaggagtagctaaagatctagatgcattagttgtaggtgaagcaactaatggagatataatatatgcacattctgggagtttcaattatcgtatcgtaagtcatggaaaatctgttcattcatcaacaccagaattgggaaataatgcattagatgctttagttgattttgctgctatagaacgtacactttttgatgatgttcctcgcgacccatatttaggtgaactaaaacatagtgtaaccattttaaatgtgggtgaacaagttaacacaattcctgatgaaggggaactttatggaaatattcgtccaactagtgcttttaataataaacaaatagttgaacgtttaaaatcagcggtagatgaagtgaatgataaaaatggggctaaactcacttttgaattaattcatgactggtatcctgttgtttcaaatccagaagatgattttgtacagacagcattaactgttagtcaagaagtattctctaattatgttgaaggtaagcaaccagaattgataacaatgaatggggctactgatgcatctgtttttgtaaaagataacactaacttacctgttataattttagggcctggtgaaagtaatgtaagtcatcagatcgatgaatatacaacaatttctagttatttagcattggtagaaatttacaaacaaataatattgagatattttgaatga

SEQ ID NO: 1476 - DNA, 1182 bp, Unknownn
  isolated from dental, unidentified
ttgaaaaaagaaatatctttattcgctgtattgctaggctctttttgtactagctttgaaatgagttttatttggccattaacaagtgtttatttgcacgataatttacatatttcactagcactggtgggcttagtgttattttttaattctttggctagtgtaattggaaatatatttggtggattaggatttgataaattgaatccatattatttattgttattaggcggaggagttacaaccttatccctagttgttttagtatttttccaccaggctttaccgttttctatctgtctattctttttaggattaagtgcaggatggaatggaactttaataagtgcattaggtgcgatattgaagaaatatgacggtaattatgtgtttaatatgatttattttatccaaaaccttggaattgttatcggatcttcaactgtagggttcttgtatgattggaatataaagttgccatttatagctgctatgctaattagttttggctttttgttagttgtaatgataggatttcgtgcattgaagtacgaaaatatacatggtagtactcataaacatagtaaagttaaggttgttttaccaaaaataaacatgtatttaatctatagtttgtttgcgatgttgttggtgacttggacaatgtatcaacaatggggaagtaatgtttcagtatatattacaagtttagggataccatttcgttattatagtgttttatggactatcaatgcaggattaatattagtaattcaaatttttattgttagattaagacatttaataaagaataattatattccaatttattttggtatatttacttttgcattatcttttgtagttttattttttgctaaacaatattatttatttgtcgtagcaatgatattactaacatttggggaagctttagcctttcctcaagttccagttatcattaatcaactgacaccaaatgaagttaagggtaaatatcttgggttagttaattcatttggcagtgctggaagagcaattgcccctttatttggcggattggttattgaaggttttggatatagaaatctatttttaattgctataattttcaatttagcaatattaataatagtgtatttagttagattgagagtcggaaataatgtaaaaagttattaa

SEQ ID NO: 1477 - DNA, 1260 bp, Unknownn
  isolated from dental, unidentified
atggcaatggaatattcattagattcaagtcaaaatacaggcgcaaatataaaagtaatcggtgttggtggtgcaggtggtaacgctgttaaccgtatgattgctgatgatgttaaaggtgttgagtttattgtagctaatactgatgttcaagctttacaacattcaaacgctgaaacaaaaattcaattaggacctaaattaacacgtggattaggtgcaggttccaatcctgaaatcggtagtaaagctgctcaagaaagtgaagaagcaattgccgaagctctttccggtgcagatatgatttttgttactgctggtatgggtggcggtacaggtacaggtgctgctcctattattgcaaagattgctaaagaacaaggtgctttaacagttggtgttgttacacgcccattcagttttgaaggaccaaagcgtgcaagatttgctgctgaaggtgtagcacaaatgaaagaacacgttgatactttagttatcatcgctaacaaccgcttattagaaatcgtagataagaagacaccaatgttacaagcattccaagaagcagataacgtattacgtcaaggtgtacaaggtatttctgatttaattacatcacctggttacgttaacttggactttgctgatgttaagactgttatgcaaaatcaaggttctgctttaatgggtattggtactgctaacggagaaaatagaacagcagaagctacaaagaaagctatttcttcacctttattggaagtatcaattgacggtgcagaacaagttttacttaacatcacaggtggcccagacctaagtttatttgaagcacaagatgcttcagatattgtggctcaagctgctacaagtgatattaacattattttcggtacttctatcaatgaagaacttgaagattcagttatcgtaacagttattgcaactggtattgataaaaagaaaaaagaagcaccaaagcgtacaagaatgagtaatccccttaacaatgcaggtattaatcattcaacaactggtgtgaatgaaacaacaactagaaatcaaggagatccattaggtgattgggatttaagtcgtgaaatgaataatcctcgtcaagctacacaaaatgaacgtggaaatgatttccaaaacgttgaaaagaaagatttcgatgtgttccaagctgattcagatgcagatgatagcaacgatgattctttaaatacaccaccattcttacgtcgccgtcgtcgttaa

SEQ ID NO: 1478 - DNA, 1371 bp, Unknownn; identical to SEQ ID NO: 209
  isolated from dental, unidentified

SEQ ID NO: 1479 - DNA, 999 bp, Unknownn
  isolated from dental, unidentified
aaggaggtaggagaaatgaatgacagacaaaaagttatcattgactgtgatccaggaattgacgatagtttggccttgatgcttgctttaacatcgcccgaactagaagttgtcggaatcacaaccgtttctggtaacgttccttccgatatgggtgctaagaatgccctcaaaaccttaaatcacttagaccgtctcgatattccagtatatcaaggcgcagcaacgccacttaaacgtgattatgttgatgctatggatacgcatggagaagatggtttaggtgaatcttatctgcctgaagtctcaggtgttcctattcacgataacgctattgagtttattaatcagactctagccgataatcctaacctaacaattattgcgttaggaccactaaccaatattgcattagcttatcaaacacagccagatgtttggaataactgtactcgttttgtttcaatgggtggaaatttcaagagttttggtaattgttcccctgttgctgaatacaattattggtgtgatcctgatgctgctaattatgtttatcaacatcttcccgtaaaaattgaaatgataggacttgatgtcacgcgaaaaattgtacttacaccaaatattttagaactaattcatcaagtcaatccagaacaagctaattttattcaaaaaattacaagattctattttgattttcattggaaatatgaaaaagttatcggctgtgtcattaatgatcccttagcagttgcttatactatttttccagaattatgtactggttttgattctcatactgagattgaaactaaaggtatcagtattggtcaaagtgtcgttgatgaaatgaatttttggcataaacctgtcaacagtcatattttgacaggggtagataatctacgttttatgcaaatcttcttacaacgtacctgttcaattgattcagaacttctagaaaaaattttgccacaattaatatcggaggaataa

SEQ ID NO: 1480 - DNA, 2361 bp, Unknownn
  isolated from dental, unidentified
atgacagattattcatcccaagaatacttagataaattagatgcttattggcgtgctgctaactatgtttcagttggtcaattatacttaaaagataatcctttacttcgccgtcctttaaaggcaaaagacgttaaggttaaaccaattggtcactggggaactatcgctggccaaaacttcatttatgcccatttgaaccgtgtcatcaacaaatatgacttgaatatgttctatgttgaaggcccaggtcatggtggtcaagttatggtttctaactcatatcttgatggttcttactctgaaatttatcctgaaatttctcaagatgaacaaggcatgaagcgtctatttaaacgtttctccttcccaggtggtgtagcttctcatgctgctcctgaaacaccaggttctattcatgaaggtggcgaattaggttactctatttctcactctgttggtgcagttttagataatcctgatttgattgttgctgcagttgtcggtgatggtgaagctgaaactggtccattagctgcttcatggcaatctaataaatttatcaaccctattcatgatggtgctgtcctaccaattttagatcttaacggattcaagatttctaaccctactatcctttctcgtgaaagtgatgaaactttgactaagtactttgaaggtatgggttggcatccaatctttgttgaaggcgatgatcctaagttgatgcatcctgcaatggctaaagcaatggatgaagcaattgaagaaatcaaggctattcaaaagaatgctcgtgaaaataacgatcctagtcttccagcatggcctgttattatcttccgtgctcctaaaggttggactggtcctaaagaatgggatggcgaaccaattgaaaaatcattccgtgcccatcaaattccaattcctgttgaccaaaatgatatgcaacatgctgatgctttggttgactggcttgaaagttataaacctgaagaattattcgatgaaagtggtaagttgaaagctgaaattgctgaaatcacacctaagggcgacaagcgtatggctgctaaccctcacacgaaccctggtaaattaatcagagaagttatcaagcctgatttccgtgattttgctgttgatacatctgttccaggtaaagaagttgctcaagatatgactgttttaggtaaatatcttgaaaaagtactttctgataaccgtcataactatcgtgtctttggtcctgacgaaacaatgtctaaccgtttggcacctatctttgacgtaactaagcgtcaatggttagctgaaattaaggaacctaacgatcaatacttagctccatcaggtcaagttattgattctcaattatcagaacaccaagctgaaggtttcttagaaggatatgttttgactggtcgtcatggtttctttgcaagttatgaatcattcttgcgtgtagttgactctatgttgacacaacacttcaagtggttacgcaaagcaactgaacaaccttggcgtacatcaattccatcattgaatgttattgctacatctactgtattccaacaagatcacaatggttacacacaccaagatcctggtattttaggtcacttagctgataagaaacctgaatatattcgtgaatacttacctgcagatgctaactcattattggctgtattcgacaagactattaatgatcgcgataagattaacttgattgttgcttctaagcacccacgtcaacaattctactcagctgcagaagctaaggaattagttgataaaggtttgaagattattgattgggcttcaactgataagaatgctgaaccagacgtagttatcgctgctgctggtacagaaccaaacttagaagctttagctgcaatttctatcttgcatgaaaaattacctgacttgaagattcgcttcatcaatgttgttgatatcttgaagttacgtagtcctaaggtagatcctcgtggcttaagcgatgatgaatttgatgcttactttacaaaagacaagcccgttatctttgctttccatggttatgaaggcctattacgtgacatcttctactaccgtcacaatcataacgttgctttccacggctatcgtgaaaatggtgatatcacaactccattcgatatgcgtgtgctaagccaaatggatcgcttcgatcttgtaaaatctgttgcactttctcttccaaatgctgacaagtatggtcaacttgttgctgaaatggatgctaaagttgctaagcatcatcaatacattcgtgatgaaggtactgatttaccagaagttgaaaactgggaatggaaatctcttgattaa

SEQ ID NO: 1481 - DNA, 1344 bp, Unknownn
  isolated from dental, unidentified
atggatacagcgcaaatccttgaaacaatcaagatgatttcagaagaaaatttggatattagaacaattacaatgggaatttctttgcttgattgtattgatagtgacagtgataaagcatgtcaaaaaatttatgacaagataacaactaaagctaaagatttagtgaaagttggaaatcaaattgcaacagaatatggaattccagttattaataaacgagtttcagtgacaccaattagtttgattgctgcagcttctaaagataaagactatgttaaatatgctaaagctttagataaagcggcacaaactttaggtattgattttattggcggttactcggctttggtgcaaaaaggttatcaaaacggagatcgtactctaatcaaatcattacctcaggctttagctgaaacaaatctagtatgtgcttctgtaaatgttggttcaacaagaagtggaatcaatatggatgcagttaaagaaatggggcaggttgttaaagcagcttcagaactagattttatgacaaatgctaagatggttattttctgtaatgcagttgaagataatccatttatggcagggggcttccatggagttggtgaaccagatgctgttattaatgtgggtgtttctggacctggtgttgttaaatcagctctagaaaaagttaaaggcgcttctatggatgtagtagccgaaactatcaagcaaacagcatttaaagttacaagaatgggccaattagtaggtagcattgccgcagaaaaattaaacgtaccatttggaattgttgacctatcattagcaccaacacctgccgtaggtgattctgttgcccaaattttggaagaaattggcttagaacaagttggaacacatggcaccacagctgctttagcgatgttaaatgatgcagttaaaaaaggtggcatcatggcatgtagtcatgtcggtggtttatcaggtgcatttattccagtttctgaagacgctggcatgatagatgcagttaatgctggatcacttaatattgaaaaactagaagcaatgacagctgtttgttcagtagggttagatatgattgcaattccaggagatacaccagctgaaacaattagtgcgatgattgcagatgaagctgcaattggtatgattaataataagacaacagctgttagagttgttccagttcccggaaaagatgttggtgaaacagtcgaatttggtggcttattaggacatgctccgattatggcagttaataaggtatcttcagcagatatgattaatcgtggtggacttattccagcaccagttcatagttttaaaaactag

SEQ ID NO: 1482 - DNA, 1824 bp, Unknownn
  isolated from dental, unidentified
atgcaaggacatggcggtagaatgaaaggaccaaaagcggaaggtgcaaaggatttttggggaaccgtaaaacgcttagtaggatttatggggccttggaaatgggcttttgtattagtatttatatttgcgattgggtctgtaatctttcaaattataactcctaagatcttaggtggagcgacgactgaaatctatattggaataaaaaaaggcttagcaagtggacaaagtatcggaaaatatccaattgattttgcagccattaaacgaattttaatgacggtagcagttttatacctagcttcagcagctttatcttttatacagcagctaatgatggctaatatttctcagaaggtagtttatcgacttagaaaggcaatgaaatctaagatgcagtatctgccagtttcatactacgatactcattctaatggagatatcatgtctagagctgttaatgatatggataacatagcgggaactttgcaacaaaatttggcccaacttgtaacaagtacagtaacatttgtaggggccttcttcatgatgctatctattagttggaaactaactttaattgcttgtattacaattccgctaggcttaatcgttgtttcattggtagctccccgttcacaaaaatattttgttgcacaacaaaagagtttaggattgttaaataattatgtagaagaaaattatgccggacacacagttgttaaaacttttaataaagaaaaaagtacaattgaagaatttgaaactgaaaatgaaagatattataaaagttcatggaaggctcaatttatttctggtttgataatgccattgatgaatatggtaaaaaatattggttatgtttttgttgcaatagtaggtggaatacaagtcgctaatggaactgttacattaggaaatgtgcaagcatttttgcaatatgtaaaccaatttactcaaccaattacacaaattgctaatatagccaacacgattcaggcaacagtagcttctgcagaacgaatctttgaaattttagatgaagctgaaatggacactaatctaaaagataacaatgataatagtcaaaataagtataaaattagttttaatcatgtgaactttggatatacttctgataaacaattgatgaaagattttaacttgaatgttagtccaggtgaaaaagtagcaattgttggtcctacaggtgcaggaaagacaacattaattaatttactggaacgtttctatgatatcaatggtggcagcattaagcttgacggacgtgatactagaagtatgtcgagagaagaaattagatctcatttttcaatggtattacaagatacttggttatttactggtacaatttatgacaatataaaatatggaaatgagcaagctacggaagaagaaattattgcagcagctagggcagctcatgttgatacgtttgttagacagttaccagacggatatcaaactatcctaaatgaagaagcatctaatatatcacaaggacaaagacaattgataacaatagctagagcatttttagctaatcctgaaattttgattttagatgaagcaactagttctgttgatacgcgtacggaaattctaattcaacaagcaatggaaaaattgttagctggaagaacaagttttgtagttgcacatagactttcaacaattagagatgcagataatattattgtaatgaatcatggatctattgtagaaacaggaaatcatgataccttaatggaaaaagatggtttttatgcagacctatataatagtcaatttgcgagataa

SEQ ID NO: 1483 - DNA, 915 bp, Unknownn
  isolated from dental, unidentified
atgatttatacggtaacaatcaatccatctattgattatatcgtgcaactagacaagctcaccttaggagaagttaatcgtatggactacgataacaagcttccaggtgggaaaggcattaacgtttctcgtatcttaaaagaattaggtcatgacaatattgcatggggctttcttggagggtttaccggaaattttgtaaaagaagaacttgaaaaagtaggtttgaagacagatttcactccaattgcagctgatactcgtattaatgttaaaatcaaagctcaaaatgaaacagaaatcaatggtcaaggacctaagttgactgaagaagaaatcagtgcttttacagaaaaatttgaccatttaacatcagatgacgttgttatttttgctggaagtttggtacctagtttgaatgatgatttctactttgatttgattaagatcattcgttcaaagggagctcaatttgtaattgatacaactggtgaaagtttacgtaagaccttagttgaaaagccattagttgttaaaccaaataatcatgaattagctgatttatttggtgtcgaatttaacggaatagacgatattgttaaatatggtcgtaagttgctagacatgggtgctcaaaatgttttagtttccatggcaggcgatggtggcttgatgattaccaatgaaggtgtatggagatcgttagctcctaagggaactgttattaactctgttggcgcaggtgattctatgctagcaggatttgttggtacttatgcaagtactaaagatccaattgaagctttccattatggcttagcttctggatctgcaacagcattttctgaagatttggcaactcgtgaaaagatcgatgaaatttatgctcaaatcactattgatgaatataaatag

SEQ ID NO: 1484 - DNA, 2094 bp, Unknownn
  isolated from dental, unidentified
atggcaaacaaacgtgaattcccattggaaaaaacacgtaatatcggtattgttgctcatatcgacgctggtaagacaacaacaactgaacgtatcttgtactacacaggtaagattcacaaaattggtgaaacacacgatggtgcttcccaaatggactggatggaacaagaacaagaacgtggtattacaattacatctgctgctacaacagctcaatggaaagaaaaccgtattaacattatcgataccccaggacacgttgactttacaatcgaagtagaacgttcattacgtgttcttgatggtgcggtagttgttttagatgctcaatctggtgtagaaccacaaacagaaaatgtttggcgccaagctacaacatacggtgttcctcgtatcgtttttgttaacaagatggataagattggtgctaactttgattactctgtaagcacaattaaagaccgtttacaagcaaatccattgcctgttcaaatgcctatcggtgctgaagataacttcgaaggtgttatcgacttaatcgaaatgaaggctgacttgtatgatgaagatgaattaggttcaaaatgggatacagttgatgttccagatgaatacaaggaagatgcacaagctcgtcgtgatgaaatgatcgaagctttagctgatgttaatgaagatatcatgaacaagtatcttgaaggcgaagaaatcagcaacgatgaaattcgtgctgcaattcgtcaagctacattgaacttagatgtattccctgtatttgcaggttctgctttcaagaacaaaggtgttcaaatgatgttagatggtgttaatgattatttaccatctccattagatgttaagccatacaaggctacagatcctgaaacaggtgaagaaattgatttgaaagctgacgactctgctccatttgcaggtttagcatttaagattgctacagacccattcgtaggtcgtttgacattcttccgtgtttaccgtggtactcttgaagctggttcatatgtattgaacgctacaaagggtaaacgtgaacgtgcaggtcgtttactacaaatgcactctaaccaccgtaacgaaattccagaagtattctctggtgatatcgctgctgctattggttttaagaatacaacaacaggtgactctttaactgatcctaagacaccattgattcttgaatctatggaattcccagaaccagttatccaagtttctgttgaacctaaatcaaaagcagaccaagataagatggacgttgctttacaaaaacttgctgaagaagatccaagtttcaaagctgaaacaaaccctgaaacaggtgaaacattgattgccggaatgggtgaattgcacttagatattatcgttgatcgtatgaaacgtgaatttaacgttgaagctactgttggtgaacctcaagttgcttaccgtgaaacatttacaaaacaagtatctgcacaaggtaagtttgttcgtcaatctggtggtaaaggtcaatacggtgacgtttggattgaatttacaccaaatgaagaaggtaaaggtttcgaattcgaagatgctatcgttggtggtgtagttcctcgtgaatacattccttcagtagaacaaggtttgaaggaagctatgcaaaacggtgtattagctggttacccattaatcgacgttaaggctaagttatatgatggtagttaccacgatgttgactccagtgaagctgcatttaaggttgctgcatccttagcattgcgtaacgctgctcctaagggtggtgctgtaattcttgaaccaattatgaaggttgaaatcattgcaccagaagataacttgggtgatgttatgggtcatgttacagctcgtcgtggacgtgttgaaggtatggaagcacgtggtaacgcacaagttgttaacgcatttgttccattggctgaaatgttcggttacgcaactgtattacgttccgcaacacaaggtcgtggtacatttacaatgacaatggatcactacgaaccagttccaaagagcatccaagatgaaattattaagaaaaatggcggtaacgctgaataa

SEQ ID NO: 1485 - DNA, 1599 bp, Oribacterium sinus
  isolated from dental, Oribacterium sinus
atgaccaagtatatttttgttactggtggtgttgtttcctcattaggtaaaggaatcgtagctgcatcactcggacgtttgttgaagaatcgtggcttaaaagttacaattcaaaagtttgacccttatatcaacgtagatccagggacaatgagtccatatcaacatggagaagttttcgtgacagatgacggtacagaaacggatttagaccttggtcactatgaacgttttattgatattaacttaaacaagtattctaatgtaacaacaggtaagatttattctgaagtgttgaagaaagaacgtcgtggcgattacttaggtgcaactgttcaagttattccacatatcactaacatgattaaagaaaaaatcatgcgtgcaggtacaatcacagatgctgatgtagtaattacagaagttggtggtactgttggtgatattgaatcattaccattcttggaagctttacgtcaaatgaagtctgaagtaggtagtgaaaatgtagtttacatccacacaacacttgtaccttacttacatgctgctggagaaatgaagactaagccaacacaacatagtgttaaggaattacgtggtttaggaattcaaccaaatattttagttgtacgtactgaaaagccaatttctcaaagcatgcgtaataagattgctaacttctgtgacgttgaaccagaagcagtaattgaatctatggacgtagatacactctactcaattccattgaatctacaagctcaaaacatggatgaaattgtatgtaagaaattacacttagatacaccagctgcagatatgactgaatgggctgctttacgtgataaagttaagaatctttcaggtgaagttaagattgctttggttggtaagtatgttcaattaccagatgcttacatttctgttaacgaagcattgaaacatgctggatacacaattgacgctaacgttaagattgattacttcgattctgaaaagttaactgctgaaaatgttgctgatgaattgaagagttatgatggtgtcattgttcctggtggctttggcgatagaggtcttgaaggtatgattcaagcaattcgctatgctcgtgaaaatgatgtaccttacttaggtatttgcttaggtatgcaaatggcatgtatcgaatttgctcgtgatgttgctggtattgaagatgcaacaactggcgaagtaaatccaaaggctgctaataagattattgacttgatggctgatcaagaagatgttgaaaacatgggtggaacacaacgtttaggtctatacccatgcaagttgaaagcaggttctgttgcttctgctgcatacggtaaccaagatgtaattcaagaacgtcaccgtcaccgttatgaatttaacaacaagtatcgcgatgaattggcagctaaaggtttagtattctctggtacttctccagacaaccgtttagttgaagttgttgaaattccagaaaacaaattctttgttgctgcacaataccatccagaattcttatcacgtccacaacgtccagaaggtctattccaagcatttattaatgctagtgctggtaagtaa

SEQ ID NO: 1486 - DNA, 963 bp, Oribacterium sinus
  isolated from dental, Oribacterium sinus
ttggaatactttgtaattgtcaatgaatatgccaaaaatggtaatgctaaacaaatctggcaaactattcattcagagttagtaacacagggagtcaaatttacttacaaaaaagttaatgaaaatgctgttgaagttgctaaaaatttcactttggatttagctgaaagaaaaaagagtaaaattgtcgtcttagttgtaggcggaaatggaactttggtcgatgttttaaatggtatcaagcaagcacaacgctttgatctaccaattggtctagttcctgccgggattgaaaatggattcgccaaagcaattggactttcgctcaatcctgtcgtcgctttaaagcaagttatcaatacaacagacaagatatactatacaattggtacttaccaagaaactttacgaaacactcaaggttatttcttgaataattttggtataggcatggatgcttttattacaagtatttataatcgtaagaagaaacgtaaattcttccgtcgaggttttcttccattccttactagcagtataagtgcttattataatcaagaacctttttcggctacggttagagttagtgactcctatagatttttcaaacatgtctatatcatgaatgttgctaaccatccctattttgaaggaggtgtttcactctctcctcaagctaacattaaagataagaaacttgacttgatcgtcactgaaaatatgaatttcatccgtttctttatgttgattgtaagtttatattttcataaacaacttaatttgaagtcattccatcgcttcaaagatgatcaaattcatttaactattaaatcattggaatttctacagattgatggtgaagaacatggcagccagtattttgatattttcttcaaaactactagctatcccttctggttcaatctatctagtgttccctttaaagaaagacgtaaaaaataa

SEQ ID NO: 1487 - DNA, 696 bp, Actinomyces sp.
  isolated from dental, Actinomyces sp.
aagaattctaaccagggtgctaatgaaacgattatgaagagtattcggaatgatcagattgaaataaatccgatattgtcgaatcgagctagtgaaggatattatcttgcaagtcctaatagcgatgatttgaagaataaagctgatactgatttgcgctacgttacctggacatataatgatcataaattgacgggtgattttaccacgttaattaaaataaatgatagcgacaatccacaaaaaactttaaattcagtagttgatgatgcgagtttgataattcatggaaaagactatgcatactctaaagaattatcaagtaaaaatactattgtttatacgcaaatggtgcatggaaagccaatctatacacctgagggtcaattgagatttacggttaaaggtggttatgttgtaggttatactcaacgtcatctcgctaaaattcatcaattaagagaagtgaagaagacgattagccagagacgagcagttattttgttgtatcaatataacaagattccagctaattcaacggttaaatgggtaaaactaggttatacgaagttattgacagcaaataataatacaattttaattccaacatggaatgtgaagattaagagtgattcatctggaattgtgcaatatcgacgcttaaatgcgttcactggtgcaattatggatgattag

SEQ ID NO: 1488 - DNA, 1335 bp, Unknownn
  isolated from dental, unidentified
gtgtccgaagcaattagcagtgaacaattatcaaaatttcatcaattaattgaagatgatccaaaatctagagttttagaacgtgcagtttctaaaaacggaattttagctacaagtgctgatttccactctgaagttaatatggatcctgtcttttcaattgatcttgatacaggagatgtagcaaaccaaaaacaatctggccgttgctggatgtttgctgctcttaatactatgcgccatgatttaaagaatcgttttggtgtagctaaggactttgaattatctcaaagttatacatttttctgggataagctagaaaaatctaattacttctatgaaaatgttattaaaacagcttctcttccaacttctgatcgtaaagtagcttggttaatgacaacacctcaacaagatggtggtcaatgggatatgattactgcaatcatcagaaaatatggtgtagttcctaagagtgtaatgcctgaaagttataactcttcaaaatcaagtgaattaaattctactcttaatttaaaattacgtaaggatgctgttgatttacgtgaattagttaatagtaacgctagttctgaagaagtcgcttctttcaaggaaaagaaactcgctgaaatttatcgtatcttagtttatacattgggtgaaccacctgttaaatttgattttgaatatcgtgattctgataataattatcatatcgatcaagatttaactcctcaaactttctttgaaaaatatgtaaattggaatcttgacgactatgtatcaattattaacgcacctactgatgacaagccatataatcatatgtacactatcgaaatgcttggtaatgtcctaggtgaacgtgaagtaagacatttaaacgttgatatgaacacattccgtcaagtagcaattaaacaacttgaatctggtgaaagtgtttggtttggttgtgatgttggtcaagaatctgatcgtaagaaaggtatcatggatactgaattgtatcacaaagatgaactattcgatgttgacttttcaatgtctaaagctgaacgcttagattatagtgaaagtttaatgactcacgctatggtattaactggtgtagatctagttaatggcactccaactaaatggaaagttgaaaactcatggggagataaagttggtactaaaggattcttcgttatgagtaataattggatggaagaatactgttatcaagttgttgtaaacaagaaattcttacctgaagaattacaaaaagttcttactgaagaacctaaagtcttagctccatgggatccaatgggttcattagcttag

SEQ ID NO: 1489 - DNA, 1383 bp, Unknownn
  isolated from dental, unidentified
atggaggaatgtaaaatgaaaaaatttagtttaaaagagtcagtaggaattttactattattactaattattttagcaggtggagtaaatcaaggcctatctccagaaactcctgtattaacagttattgcaattttaattttaattgctaaactacatggtgctgactgggaaaaaattcaccaaggaattaaagaaggtatcagtactgcattgatcccaatctttatttttatactaattgggatcttaatagctgtgtggattaaagcaggaattatcccagcattaatggttgttggttttaaattaataagcgttaagttctttgtaccttctgttttccttgtatgtgctttagttggtgcttcaatcgggagtggatttacaacgatttctacaattggaattgctctttttggaatgggaatcacaatgaacatgaacccagcattagttgcaggagcaattttatctggtgcgatattcggtgataagacatcgccactatctgactcaactaacttagcttcagcaatttctggaacagatttatttgctcatatcaaaaatttaatgtggactacgattccagctttattaatttctttagtagtttttgtatttattggtcaagggaaaacagaacctgactttgctaaaatagatgcaactatgaaaattcttagtcaaaacttctcaatttcatgggttgctgctattcctgtaatcttaatgtttttatgtgcatggtttaaaatcccggcaattccaactttatttataaatattgctgtttcaaccggaattattttagtaaatgatcctcatatctcactaaaaggcttagctgctttaatggaaacaggatatgtagctcatactaagaatgaagcagtaaatgcattgctgactagaggtggaatctctaacatgatgggaactgtttctttgattataacaacattagcacttggtggtttactaatggaattaggaatcattcaaactgcgatggaaccactaattcaaagattaaatagaccaggaaaattggttctaagtactatccttgcaggaattggaataaatctttttgttggggaacaatacctatctgttattcttccaggtagagcattcaaggatgcatttgatagggtaggtttagccccattagcacttggacgtgtcttggaagatggtggtagtgtaatcaactaccttattccttggggtgttgcaggatcttttgcagcctcaaccttaggggttccagtactagaattcttaccatttactttatttgcattactatcaccaattctttcagtgattagtggatatactggaattggtttaaagatgaagaaagaaaattaa

SEQ ID NO: 1490 - DNA, 918 bp, Unknownn
  isolated from dental, unidentified
atgaaaaataagaggtatttaaataaaatcttattaaccgcaatacttgtattatttgggagttgcatttctgttaaagcggatataaattcaaatgaattaaatgctaaattaaactcagaaataacaacacaaaaagcgcaacttgcaaatggtcagttacctaaagcaaatacgcatcagtctgatggaaagacgatagtaagtagtggaactatggttttgactaatcaagatcaaaacaagaatcgtaattatttaccatggatgagctttgctgctacgccagaaacagtaactacccttaaatatcatataggggaagattattatgatggtaactttcgtttcacattttatttggattcaatagaaggaccagctccttatgcggttgatgcagcaattgttctatacacggagccatcactacaaggaccagtttccataaataagacgaatttgattagtaaagtaggcaacataacaacaggagcaatcggttctgtggaagttcccgcaaagacaacattttgggcagctgggggagaatatggtgcagagtctacttcggggaatgttgctttttatcccataactcaaggacctattgaattacaaaataaattagcccagaatttcccagaatatgttgatccagtctcgcataaagatgcagagtctccgcttagaacagattggactcggctaggtcagtctcctagttggaatggacgccaagcttttattaatcgatttaatgctacttatggtactcaatctgctgattggtggtctgctcgacaaattcatcatattcgtccaagaatttatggtggtacagatgattttaataatttactccctgttcccaatgcaaatcattatttaataacaagttggtttagaaactattaa

SEQ ID NO: 1491 - DNA, 876 bp, Unknownn
  isolated from dental, unidentified
atgaccaccgcacttgaagtaaaaaatatcaataaaaaatataaaaataaagttgttttaaatgatattaatttttcaattcaatctggagaaattgttgccttaattggtaaaaatggtgctgggaaatctactttgatcaatattattacgaagttaattcaacaagatagtggacaaagcaagatttttgagaaagaaaaatttgataaaaatttaattggagtaatgatgcaagaaaatatctccttagatcgaataacagtgaaagaaataattaaattaactagaacatattatcgtaatcctatgtcttatcaagcgatattagctttatcagagttgcaaaattatacaaaccatcctatggataaattatctggaggtcaaaaaagaaagctacagttcgctcttactttagccgggaatccagatttaattttcttagacgaacctactgtaggaatggatgcagaaagtcgcactaaattttggaagcatgtcgatgagttaaagaaacaagggaaaacatttttaattactagtcattatttagaagaattagaaaaagttgctaataggtttatttttctgcataatcaaaagattatttttgatggtagtttaaatgaaatgggaaagcagttaaaaaaggttcaagtaaccttcaatagtgagttgatagaagatatttttaataaattaccagctgtacttagagtaagtgaattgaaccaccattatacacttattacaagtgatgttaatagattaataactcagttagtcccctatttatcagcaattgataatttagaaattagacaacaaaacttagacacattaatggactctttaattagaaacgaggaataa

SEQ ID NO: 1492 - DNA, 948 bp, Unknownn
  isolated from dental, unidentified
atgagggaaataatgagtaagtataaatttgaaagaacagtcaatgctgaatttagtggaatttcattacgagctttattgtctgaaaagtggttacttccacgtaaatttattcattttttgagaattagggaaaatgtaaaaattgatggtaagtattatccaataaatacaattgtacaaggaaatcaaaaaattgaattaatctttgaaggtgatgaatttaggacagctacctcaaattatattgtagataaaggtaggaaaattccaattatttttgaaaatgaggatttattagtagtaaacaagcctcaaggaatcaagagtcatcctaatcaaccatatgaaacaggaactttgatgaattatattgctggatacttggatgcaaaagatgaacatccttatatggtacatcgtttagatatgttgaccagtggggcgatgatagtggctaagaatccagttgtggtaccaatattgacttgtttgattagtacgcacacaatcaagcgtgactatttagctataacagaaggaatctttgatcaaaaagaaggagttattgatctaccaattggtaaggatgaaaatgataagcgtaagcgaaaagtagacggcataggcgcactaccagctagaacacattatcaagtaattaaagaatttggaaataattcagcagtttatttaagattggaaacaggaagaacgcatcaattacgcgtacatctgtcggcaatgggacatcctattgtaggagatgttctatataatcatgtaagtaaagaaaaacatatgatgttacatggctacaaacagaaattaacattgccattttcaatgagagaattagagttaaaggcagatatacctgaatattttgcaaattatgaggaaaagataaaagagaataaaaaactaaatttttacaaaaaatattga

SEQ ID NO: 1493 - DNA, 963 bp, Unknownn
  isolated from dental, unidentified
atggctgaatataaaatgattttagatttagataccggtattgatgatgcactagcaattgcatatgctttagcaacacctgaaagtgacttgattggtattgttggatcatacggaaatatcttagttgaacaaggtgtacaaaatagtttggatttacttgaaatgctgggacatactgaagttcctgtttatcaaggactatctcattcatcaactactgatcatttcgatgttatgccaattagtgctcaaattcacggtaaaaatggtattggagaagttgaaatccctactgctaaaagaaaagttgaaactatgagtggccctgacttctttattgaagcagctcacaaatatggtaaaaaacttttaattgttccaactggtccattaactaatctagcagcagctatcaaaaaggatcctgaaattgttaatttagttggccgcgtaacactcatgggtggtgctttaacagttcctggtaatgttaaccctgttactgaagctaacattaatcaagatcctgcagcagcagattttgtatttagaagtggtattcctcttactatggttggtttagacgttacaactcgtaccttgttaactacaaaagaaactcaaaaatggcgtgatttaggtacatttgctggtcaaaaatatgctgatatcgttgactactacattgatgcatataaagtaacaagtccacaccttggtggttgtgctcttcatgaccctttggctgcaggtgtagctgtcgaaccatctttagttacaacacttgctttagatatgaaggttgatactgaaggcccttatgctggaagaactattggagatgaaactaaagtaaacaacccaaatcctataagtaaagccgcaattggtgttaataaagataagtttttagatgaattcatggaaaaattaactaaattatttgcagaagctaattaa

SEQ ID NO: 1494 - DNA, 804 bp, Unknownn
  isolated from dental, unidentified
atggaaaacaggaatttgcaagatgcgaaacgcatagttgtaaaagttggtacaagttccctgatacgtgccaacggaaaaattaatttacaagcgatagatgagttgtgttataccttgagtggactggtgaatgaggacaaagaagtggttctagtatcatcaggtgcagtaggtgtgggactcgcaaatatgggcttggtacaacgacccaagcaaattcctgaacaacaagccctggcagcgattggtcaaagtcaattgatgactatttatcaacaaagatttgcaatgtacagtcaaaagacaagtcaaattttattgacgcatgatgtattaacttatcctgaaagtagagaaaacgtgttgaatactttcaatgaacttttaaaatggaaagttataccagtggttaatgaaaatgacacagttgcggttgatgaaatggatcatcaaacaagttttggagataatgattggttatctgcagtggttgcttctggaattgatgctgatttactaatagttttatctgatattgatggattatttgataaaaatcctaaaaaatatgctgatgctaacttaatttcagaagtgacagaaattaacgaaaaaatcacaggtgttgcaggtggtacaggaagtcgttttggaactggtggaatggcaactaagattaaagcaatggatagaatgattaatgaaggacgcaaagctgtcttagctaatggtaagagaccttcaatcatttttgaaattttaaacggtaagcaaataggaacattattccataagaaatag

SEQ ID NO: 1495 - DNA, 2172 bp, Unknownn
  isolated from dental, unidentified
ttgagtctaaaggacattgatattagtaaagttacttattttgatttaaataatgaaataaatattcctataaatggtcaaatccaattaggaaaagataaagaggctcttgaagcctttttaaatgaaaatgttaagcctaatactaaacaattttcttcaattaaggaacgaattaattatttaattcaaaataactactatgaagaagaatttatttctaaatattcatttgaatttatcgaaaaattatatgattacctaaaaaaagaagattttcattttaaaacttttatggcagcatataaattttatgctcaatatgccttaaaaactgacgataatgcctactatttagaaaactttatagatagagttgctactaacgctctttattttggtgatggagatgaaaaattagctttagaattagccgatgaattaatccatcaaagatatcaacctgctactccaagtttcttgaatgccggtcgtaaacgccgtggagaactggtatcttgtttcttaatccaaatgactgatgacatgaattcaatcggaagaaatattaattctgccctacaattatcacgtattggcggtggtgttggtattaatctttctaatttacgcggtgctggtgctcctattaaaggaattcatggagctgcatctggtgtcgttcctgttatgaaattacttgaagatagctttacatattcaaaccaacttggtcaacgtcaaggtgctggtgctgtttatttaaatgtcttccatcctgatatagaagcatttttatctgctaaaaaagaaaatgctgatgaaaaaattcgtgtaaagaccctttcattaggattagtcgttccagataaatactacgaattagtagctaaaaatgaagatatgtatctttttgatccttggggagttgaacgtgtttaccacaaaccattttcttatgtggatattactaaagaatatgataatatggttgctaatccaaatattcctaagaaagttatcaaagctcgtgatttggaagaacaaatatctaagctacaacaagaatctggttatccttatgttattaacatagatactgctaatagagtaaatcctatttctggaaagattgtcatgagtaatctatgttccgaaattttacaagttcaacgtgcttcagtaattaataatcgtcaagaatatgaagttctggggacagatattagctgtaacttaggttctactaatattgttaaccttatggcatcacctaacttcggtaaatctgttgaagttatgactagagctttaacttttgttactgataaatcagatattgatgttgttccatcaatccaacacggaaatcgattagctcatactatcggtttaggtgctatggggttacacgcttaccttgctaggaatcaaattgaatacggatcacctgaagctcttgaatttactagtatatatttcatgttactaaactattggactttagtagcttcaaacaaaattgcaaaagaaagaaaagttacttttgataattttgaaaatagtaaatatgctgacggtagttactttgatacttatttaaatcaagaatttgcaccaaaaaatgcacgtgttaaagaattatttgatggtatctttatacctacaaaatccgactggactagtcttaaagaaaatgttatgaagtacggcttgtatcatcaaaacagattagctgtagcacctaatggctctatttcatatattaatgacacaacagctagtctacatcctatcatcaatagaattgaagaacgtcaagaaagaaaaattggaaagatttactatcctgcaccttacttgtcaaatgaaactttaccatattacaagtcagcatacgatactgatatgcgtaaagttatcgatacttatgcagctgctcaacaacatgttgatcaaggtatgagtctaacattatttatgcgttcaacaattccaacaggtttatatgagtggaagaatggaagaactgataaaatgacaactagagatttatctattcttcgcaattatgcacactataaaggtgttaaatctatttactatgtacgtacttttactgatgatgcatctgaagttggtgcaaatgaatgcgaaagttgttcaatttag

SEQ ID NO: 1496 - DNA, 876 bp, Unknownn
  isolated from dental, unidentified
atgaaaaaattaatagtggtaaaatttaaaagagaagaaggtttaattatgcgtcctttacaagagagaattatcaacgaattgaaagtaaagccagaaattaatgcggaagaagaaattcgtcgttcagtagattttctaaaagattatttgaaaaaacatccatttctaaaagcattagtgttgggaatatctggtggacaagattctactttagctggaaagttatctcaaatggcaatttctgaattgcgtgaggaaacaggcgatgatgcttatcaatttattgctgtacgattaccttatggagatcaagctgatgaacaagatgctatggatgcaattgaatttatgcaagctgataagactgttagagtaaatataaaacaagcagctgatgcaatggttcaaagcatcgaagaaaatggtcttgaaattagtgactttaataagggaaatattaaggcacgtgaaagaatgattgctcaatacggaattgctggtgctgtttcaggagcagtagtaggtacagatcatgcagctgaagcaattacaggtttttatactaagtatggtgatggtggtgcagacattactccactttggcgtttagataaacgtcagggaagagcaatgttggaattattgaatgcacctgagcatttatacaagaaagttccaactgctgatttagaagaagatagaccagccttacctgatgaagttgccttaggtgttacttacaacgatattgatgattatctagaaggtaaagaagtagctgatgatgtagcagaaaaaattgaaaattggttcttaaaaacagaacataaacgtcatatgccaattaatgtgtatgatacattttggaaatag

SEQ ID NO: 1497 - DNA, 870 bp, Unknownn
  isolated from dental, unidentified
atggctgtaaaaattgaaaacgaaaaattatttgttacgattaatgaacatggtgctgaattagctagtttaattaataaaagcaatggtataaactatctttggagtggcgatagtaaatattggggaagaaagtctccggtactatttccaattgagggtgcactaaaagatggaaaaatgtttgttgatggaaaagaatatcatatggggcagcatggatttgctagagatatggattttgaagttaaaaaacttactaaggaatctgtatgttttgaattaaaatccaatacagagacactagaaaaatatccttatgaatttattttccgtttagtctacgaactaaaagaagaaactttagttgtaaggtatgaagtagaaaatcctagtgatagtgaaatgttttttggactaggagctcatccagcatttagtgttcctttaggtgaagctgcttatgatgattattatcttgaaattacaccggaaaaaacgcgaaaagttttgactttaaaaggtggattagttgataacattaatactattgatggagaatccagattagaaattagtcatgacgtatttgctaaggatgcaattatttatgacttgggtgaagaacctacaaaatttagtttgaaaaatactaaaaataattacggagtagaagttttcactccaaattctaagtttgcaggaatttggtcgtcttatccagctaaaggacaatttgtatgtattgaaccttggtggagtttagcagatactgtatatacagatggtaattttaaagagaaatttgcaactaataaattaaatggaaaagaaagtttcgatgcgtattttgaaattacagtattttaa

SEQ ID NO: 1498 - DNA, 1014 bp, Unknownn
  isolated from dental, unidentified
atgaaacaacaaacaagaaatatacctaaaattgttgtcataggtggaggtactggccttcctgttattttaaatggtttacgtaagagagatgctgatattactgctgttgttacagttgctgatgatggaggatcttctggaatcataagagattatattaacgtagttccacctggagatattagaaatgtgttagttgctttatctgatctaccagatgtatataaagatatatttcagtacagattcaattccaaagatcagttcttttcagggcatgcaattggaaatcttataatagctgcactatctgaaatggaaaatagaggaatttttaatgcagtgcaagagttatctgaattaatgaaagtagatggacatgtctatccggctgctaatactccgttagtattgaatgcagaatttactgatggtagtgaaatctctggtgaagcagaaatttcagcagctggaaaaaccataaaaaaagtatgggttacaacaaatggtgaaggtaaaccagaggcgatgccagaagtaatagatgctattatgaatgctgatcagattgtattaggaccaggaagtctatttactagtatcttgcctaatttaatgattgaaaatgtgggtcgtgcagtttgtgaaactaaggctgaggttatatatatttgtaacatcatgactcaaaaggatgaaactgaacatttttcagatgcagatcatgttaaagttttgaatagtcatttgggcaaaaactttattgacacagtgttggtgaatactgaaaatgtgcctagtgattatttagacagacaaaaatacgatgaatatttatatcaagtaaaacatgatttttcaggtttacgtgaacaaggaacaagagttatttcagataatttcttattaatgcgtgatagaggaattttccataatggagatcaggttgtagatgaactgatgagacttactggaagaccgaagtcatggaatgacgatgaatttaattag

SEQ ID NO: 1499 - DNA, 1176 bp, Unknownn
  isolated from dental, unidentified
gtggaaacaatgaatataatcaccacaaatgaaaataagaagatagcagataaaatttgggataaaaatgatattaattggatacttaggaagaatggatttaaagcagtgaaagatgcaaaatttgcagactggaaattagatagtattaaagtaaatggactagatttttatgtattagcgcaagaggatctggctacatatgcaatttttgatgaagaaatggcaaaattttcaatttcaattgtagtagatgcattagagcagattgatattattccacaacaacaaatggttttatatgaaaatgcattatttaatggcaatgttatgaagatcaaaacaagaaagaatgttaaggtgaacttgtctgatgatgacctggactttattagtaattatcttgattcgcgtttttataccccaggaatgtcggaaaatgaaaaaatcgagtgtttccttgagataagcggatatttatcttttcgcaaccaaattgatgaaaataagctaaatgattattatcaaatcaaacttggaaaagcaaataaaaaatacagctatgttacattggaacgtaattttagatactttgaaaattgggacaagtatgcagatttaagtaaggatgatgaaaaatacgaaagagtgaagagtaaacttatagaaaataataataagatgattgatcaatatttgaactttgtaaaatcagaaaaaaatttcacaagcatgcctccaattagtcagcaaaaggaaatattggaggattacctaaacaagtatctcctaaaagacaaaatacaaacagttataacaaatgcagctgaattatatacttataaaattagtattggcgaaactggtattacagagtatatcgcgattatgacggaattatttaatttcttgcaaaaaactggtgcggttaagaagaatgatggtaaaaaagtaaaagatatactggaggaattaagcattatcacaggtgataacgaggatcattcaatggaagatagtttacttgatgcattaaatgatttaagtgatgaagagctagatcttttgggagaagtcatgtcttcaatagaaagacctgtcgatccagaagttatttcagatgatagtcaaaatcttgaagttccatacatgagacttttaaaaagagatgaatag

SEQ ID NO: 1500 - DNA, 810 bp, Unknownn
  isolated from dental, unidentified
atgaaaaattataaaagtttaaaagacttaactaataaagttgtgctaataactggagcatcaggtggtttaggtgaacaaatagcttatcaagtagctaaaaagggtgcaatagttgtagcttgtgcacgtcgtaaagaaaagttggatgtagttgtagaaaattgtcaaaatttatctaagagactagcgtatgcataccaactagatatttccaagccagaagaagtagaaaaagttgttaatgaagtagaggaagaagtgggacctgtctcagttttaattaataatgctggctttggactaatggaagacttccttgactttgatatggatagagcagaagcgatgttcagagtaaatgttttaggattaatgtatgctactaaatatgtagctacaaaaatggccgaaagacaagtaggtgcgataattaatattgcttctatggccggtaaaatggctacacctaaatctactgtctattctgcaactaaatttgcagtgctaggcttttctaatgctttacgtttggaattgaaatcattgggaatttcagtaatgacagtaaatcctggacctatcagaacagaattctttgataaagcagataaaacacataattacctaaattctctaggaaatatagttttagacccagaggaagtagcttataaaattgtttcaaagattggaactagtcgacgtgaagtaaatttaccatattacatggaagttgctcatcacttatatgaagtctttccacatatggctgattatttaacaggtggtatttttaacaagaaatga

SEQ ID NO: 1501 - DNA, 597 bp, Unknownn
  isolated from dental, unidentified
atggaaaaggctaaaattagattggttaatttaaatgatgctgaaagaattttgcaaatttatcgcccatatgtggaaaatacagctattacttttgaatatacggtgccaacattagaagagtttaaaaataggatagctagtatagtaaaaaagtatccttatatagtagcagaaatagatggtaaaattatgggatatgcctatgctaacacttttaaaaatagagaagcgtatgattggtccgtagaaacatctatatatgttgatgaaaatagtagaggtaaagggttaggtttgcaattatatagagctttggagaatcttttaaagaagcaaggtgttttaaatgtaaatgcttgtataactaatccaagtaaagaaagcaagtatgtaactaaaggaagtatcttatttcatgaaaaattaggttacagacatgtaggaaccttccataacagtggatataaatttgatgaatggtttgatatgagttggatggaaaaatctttaggagaacataatcttaaacctggaaaagtgatagaaatttctaaattattggaaaaatttacttttgaggagttaatgtcttga

SEQ ID NO: 1502 - DNA, 1794 bp, Unknownn
  isolated from dental, unidentified
atgaaaaggaacatagtacttattctttgttgcatattcctctcgctaataggaataaagaatattcaagctgatgtaaattatgatgtaaagaactatacagttaatgttgatgttcaaaaaaatggatcattaataattaaaagacatattcgctatgattttccagatgaagcacacggtgtatactatcgccaaaatttggaaagtaatcagcaaataagtcaaactcaagtatggattaatggacaagaagctcaacaaaacggtaacgcaggaaataatacatacaaattaacacgcgatgataagggatacttatttaaggtctatcataatgcagacaatcaagaagtgaattttacatatcaatatgtattaaataatgctgttattaattggaaagatacagctgaattgaattttaaagtaattggcgatggctgggaaacagagttaaataatataaaagtgacaattaaattgccaggacaagatgtttctgatttgcaagcttggagtcatggaccgttaacaggaacgacaaaagtagataagaaatcagggcaggtaacacttagtttggcagaattaccagctaaaaattttgtagaaagtcatattctatttccagtagctcttactccggagaatactaatgtacgaaatgaaaagcataaggctgaggttcagaaacaggaaaaacaactagccttagaagctaatcgaaaacgtaaagtgcaggaaagaaaagatagactttgggctggagcgatgtttgtggtaatctgtgtgggatcttttggaagtatcttgtataatttgatgccactaaaggagaagacttaccgtccattatcagttaagaacgcccctcatgtgttcgagctaccaaattatgaagctgcggtagcgcaaagtttatttagagatacagatcctgataacaaggcgttaagtgcttatttgctagagttatcagtaaaaagagtaataaaaattgaaccaattccaaataaaaagaaagactatcttttaaccttactggatgaaacagcgttatccaataatgaaatattagaattattgtttaacaaaataggtgataccaagcaggtaagtatgaaacaaataaagaaatacggtaagaaaaagcatgaacatatgaatgttgtaaatgcgtataaagcttggcagaaatcagttagagatgaagctaacaaactaggatgggtttcggataatgcaaagtcagctatgattagaagagcaattatttccggtattttgctgttaatattaatcgtgggacttattatcactgataatacagctgctctatgggttatgggggtaagcttagtgctactagtggcctcaattctatactttataatgaaaggttcaatttataccaaagcaggtgcagctggaatgacagagctacgaggtttttatcgtatgatggacgatattggtagatttaatcttaaagaagttggtgacattgttttatgggaaggattgttaccatatgcagttgctttaggattatctaaaaaagtatctaaagctttaattgataactttacaagtgaagaactgcaaaatagtaatttcatttactactatccattcatttatcataatggaattgctaattttagtaatgattttaatagtagctttaccagaggaatgggaaattattcctcaccatcaggcggatccggtggcttttctggcggtagttctggtggatttggtggcggctctggtggtggagcattttaa

SEQ ID NO: 1503 - DNA, 1110 bp, Unknownn
  isolated from dental, unidentified
atgaagaagtttctaaaaaagcacgtattatttccaagttacgtaggactagctccttatttctggttactatggttatttccagcagtaagtgtgttacttacattgcccactattatgcgtaatataacgttaattttactaattatttttgtcaaagtttacagagattgttttttagccagagataaaggagtagttattaatatcttttgtcaattaattttggcggctacactctctttctttgcaagatatccatttttatatatttatacgggctttattattggaacctttagtattaatatgaaaaacgccaaattagtgattgttccttattatgttttatctacgataagtttatatctagcttatccattacccagtatggcagtgggagatgtaccagcagctattatcaattatttattcatttttggaacaattccagcttcaaattctttatcaaagagctatcgtttaggaaaacaaaataatcgtttagaattaataactaggcacagtgaacgtgatagaatagctcaacaattacatgataatttgggacaatccttttctatgcttgccctaaaagctgaattagctgagaaattactggagaaagatccagtattggctaaacaacaattaaaagacattgcagcggcttctcgtcaaaatttagacttggttagagaaattgtagcagatatgaaacattctacaatactacaaactttggatatacaacaatctaatctggataaatctggtataatgctacatacaaaaaacgaagagattacagtagattggaataaggatattcaaaatacaataagtcaaattattactgagttggttactaatgctattcgctacagtcatggaaatctctttagtgttacttttagtcagaacaaaaatcaatatttaataactgtacatgataatgggattggttttgataaaaatatatcttacaaaaaatcatttggtttatctggaataaaaaagagaattgattatctagatggtaatgttaattttgataatgacaatggtgctaaaatagatataagtattcctattgtaaagggtgattaa

SEQ ID NO: 1504 - DNA, 1263 bp, Unknownn
  isolated from dental, unidentified
ttgcgtatagaattagtcaaaggcgtgaatttaaatatcattccttctaaacaatttaagacaacaagaatttttatatcatttattaaaaatatagaatcaaaaaaagaattagccgaaagggcattgttggctaattatctagaaatgtgtagccaaaactatcctacacaaattgatattgcacgtaaattatctcaaatgtatggtgctagttttggtagttccgttgatagacgtggaaattatcaacttattaattttagtattgattatattgaaggtaagtatctagtaggcaatgaagatttattttcagaagtaattgaatttttaaaagaaattattttcaatccattgaaagtgggggaaaataaaaactttgatgaagaaacttttactagacagaaaaacaacactattacatatttgaaatctattaaagaagataagcaagcttatgctacagcaaaattaagaaagctttactttgataatgagattcaacaagtaccatcatttggtgaaagtgaagatgttgagaagttaacaatctctgatttaatggatgcttatcaaaaaatgctaaatactgatagagtagaaattatgatttctggagatgttaatactgatgaggttgtaaataagttctctgtgttaccatttaaggcgcgaaatatttcacgagtaagcatgagttatactcaagagataaaacaagagattgtaacacaaattgatgaagaacctttatctcaaagtaagtttgatatggcatttaggttaccagttgtatatcgtggagatttgcattatgcagcacttgttttcaatagtttatttggaggttcagcactaagtttattatttactgttgtgagagaaaaaatgagtatggcatattatgctaatagtaactttgatccatttagacaattattagtagttcaaactggaatttcttatgctaataaagataaggttcaagaattaattttagagcaactagaacgactaaaaaaaggtgattttgaagacgagttgttagaacaaaataagaataatttgattagtagttatatttctcgtttagatagccaaacttcagctttattaagggcgcaatctgcagctttaactggaatcaatgttaccattgaagaatggctggataatttgcaaagtgtaaccaaagacgatgtaatgaaagttgcaaaaatggtcgaactacaggctacttatatgttaggaactaattag

SEQ ID NO: 1505 - DNA, 831 bp, Unknownn
  isolated from dental, unidentified
atgcctgaattaccagaagttgaaacagtacgtagaggactagagaaactagtcttaaataaaaaaataaaagatattagagtgttgtattctaaaactataattaatgaagagacagaattcatagaaaaactaacaaataaaactattaaaaaaattgatagacgtgggaaatatctattatttagatttagtagtgatttgacaatgatttcccatttgagaatggaggggaaatatttcgttgaaccaagtacaaaagaagttgaaaaacatacccacgtagtatttgattttacagatgggacatcacttagatataacgatgttagaaagtttggcaggatgcaattggttaaaacaggagtggaaatgcaaactgctggcttagctaaattagggccagaacctaaagaggaaacatttatagttgaagatttttctaaaaatttgaaaaggagaaaaaaagctataaaaaatgccttattagatcaaacaatagtggcaggtttgggaaatatttatgcagatgaagtgttgtggatgagtaaaatccatcctgaaacaccagcaaataaattaactgaagaggaagttaaagttttacgagataatattattaaagagttagcgttagctaccgaagctggaggaactacaatcagatcatatacagatgcatttagacattctggaggatttcagtttagcttacatgtttatcaaagaacaggagatccttgtgagagatgcggaacaccaattcaaagaattgttgtaggtcagagaggaacacatttttgtcctaagtgtcaggtggtaaaatcatga

SEQ ID NO: 1506 - DNA, 1446 bp, Unknownn
  isolated from dental, unidentified
atgatagaacataatttaaaattttatttaaagaaatattttggatattcttcctttaaagaaggacaagaagaagttatcaaagctttaattgatcaaaaagatgcagttgccattttacctactggaactggtaaatcaatgtgttatcaattaacagggaaacttcttgatggaacagttataattgtttcaccgttactttcattaatccaagatcaagtagaacaattacgatttcaaggtgaacgtagagtcttagctttaacttctaatttaacctattctgaaaaaaattacgctttacagaatttgcatacatataagtacatttatttggctccagaaatgcttcaaaataatgaagtactagcaagattacaacaacaaaagatcagtttgtttgtagttgacgaagctcactgtatttcacaatgggggccagactttaggccagattatttagagttaggtaagatacgtgaaaaattaggtaatccactgacattagctttaacagcaacagcatcgcaacaaacaattaatgcaatcatgtcaggactagagttggatcaatcagcaactaaagttgttcgaaagtctgtagatagggaaaatatttttttaagtgcttttaaatttaataatgaacaagataagttagagaagttatttgatttattaaatacgataaaaggtccaggattgatctatttttctagtaaaaagaaagccaatgagataactgaaaagataaaagcgaaaacttcattaaaagtagcagcatatcatgctgatttagatatgaatgatagattcattattcaacatcaatttttggataataagttagatttgatttgtgcaactagtgcttttgggatggggataaataaggaaaatatcagatatgttattcattatcacttgccaggagaactagaatcgtatattcaagaaattggtagagcaggacgagatggtaaacaaagtatagctattttgctctatcaaaaaggagacgaagggattcaacaacaattatcccttaataatattccagataatcaaatgatagattattacataaataataaacagcaatttgctgaaacagataatgaaagcatccaattacttaataaaataagtaacttatattcatctaaagaagaattacaatcttttttcttgcaaaggaaacgacaaaaatttaattcattgcagcaaatgctacagtatgttgatgctaatgaatgtaaaaggcagtatattttagattattttgaagataataaaaaaaatgaccatcatgaattatgttgccaaaaactaaatgatgatttaccattaaaagaactagggttaatttttgatgaaaatgaacaaaaatctctaaagattgaagaattttataaaataattgatgaaatttttagaacttaa

SEQ ID NO: 1507 - DNA, 1818 bp, Unknownn
  isolated from dental, unidentified
atgtgtggtattgtcggtgttactggtaataatgatgcaacaaacattttattagacggattacaacaattagaatatcgtggctatgattcagctggaatttatgtaaatgaccaaaatggtaaggactttttagtaaaagaaaaaggtcgtatttccgatttacgcgcagaagttggttcagaagttaagggttcaacaggaatcgggcatacacgctgggctacacatggggttcctagcaaagttaacgctcatcctcatgtatcagcaaatggtcgtttcttcttagtacacaatggtgtgattggaaactttgctcaattacgcgatgaatacttacaagatgtaactttggtaagtagtacagatacagaagttatcgtacaattaatcggtaaattctctgatgaaggtttagatacagaagctgcatttaagaaagttttaggcttagttgatgaaagttcatcatactccttcttattaatggataaagaagaaccagatacattatttgttgctaagaacaagagtccattgttgattggtgttggcgatggtttcaacgtagtatgttcagacgcaattgcaatgttaagtcaaactcatgacttcattgaattagttgacggtgaaatcgtaattgtaaaacctgattcaattactatcaaagacccagaaggaaatgttatcaatcgtgaaccattccacgtagatacagacccagcagcagctcaaaagggtgcatatccatactacatgcttaaggaaattgatgaacaaccaggtgtaatgcgtaacttagttcaacattatgtagcagaagatggttctatcaatattgataaagaactattggatgctttagaaaaagcagatcgtttgtatatcgtagctgctggtacaagttaccatgctggtttggtaggtaaggaattatttgaaaaattagctaatattccaactgaagttcatgttgcttcagaatttgcttacaacccaccattgttgtcagaaaaaccattcttcatcttcttgactcaaagtggtgaaacagctgatagtcgtcaagtgcttactcaagtaaatgcacaaggttacccaagtttaacaattacaaacgtacaaaactctactttggatcgtgaagcaacatatacattgttactatatgcaggtccagaaattgctgttgcttcaactaaagcttatacagcacaaattgctttagaagctatcttggttaaagcttatggcgaagctaagaacattgataaagttaaggaattcgatgttgctgctgaattaactaaagtagctaatggtatgcaagaattagttgatgaaaaaggtactgttgaaaagattgctaaggacatgttagcaacaacacgtaatgctttctacattggtcgtggaattgactatgatgtagctcaagaagcagctttgaaattgaaagaagtttcttacattcaaacagaaggctttgcttccggtgaattgaagcatggtacaattgctttgattgaagaaggtacaccagttgtagctgtaattacagatcctaagacagctactcatacacgtagtaatgctcaagaagtattagctcgtggtgctaatgtgctatttattgctagtcgcgatgtggctcaagaaggcgatcaagtggtattaccagaagtaacaccattgttatcaccattattggctattatcccagcacaattattagcttactacgcatcaatccaacgtggatacgatgttgataagccacgtaacttagctaagagtgttacagttgaataa

SEQ ID NO: 1508 - DNA, 789 bp, Unknownn
  isolated from dental, unidentified
atggatagtaacattttgcagcattttagaaaagatgaagaaccattaatttcacaattgtctgattacattatgcaggtagaaaacgaatatcgaccaatattaacgcatttcctgaatccaagggaacaatatattgctcagtcgttgatacacaaaaatcaagatgtaaaagtttcttttagtggtggttatgaaaatgctgaaagaaaacgagcaatattttacccaagttattacgaggtacaggatgatgattttaatttagaattaattatgattaaatatcctgtgaaatttacatcgttaactcatggacaaattttaggaactttggctaatagtgggttagatagagaagtaattggtgatataatagaacaaaatgatacttggcaattcctttgtgaaaaagaagtaagtgactacttcagattgcaaattgatagagtgggtaagattaaagttagacttgaagatgcaccactcgatgaaattgtagttccagagttaaattggcaagaaaaaatggtaacatcttcttctctaagaatagatagtttagttagtgttacgttcaacatatcaagggaaagtagcaagaatttaattaaagctgaaaaagtacagttaaattggatgactgttgctagaccagactatgaagttaagtatggagatatattatcgattcgtggttatggtagacttaggatcgatgacctattaggtataactcgtaaggataaattaagaattagagtttctgtattggagaagaataactga

SEQ ID NO: 1509 - DNA, 780 bp, Unknownn
  isolated from dental, unidentified
atggaacatagaatgttagaattagaagaaggtataaattttagagaattgggcggttatttaaccgaggatggtagaaaaattaaatggcacaaactattacgttgtggaagtatggcacaactaaccaagaatgatgtagattatctagatcaatatggggttcgctatattattgatttgcgctcacccgaagaatctaattattcgccagataagtatccagataaagcacagtatttccaagatactgtatacccattttcttttagcttgtttaaaaatttaggaattatcaacaatatgcgattaggagctagcaatatggattttggaagacaaacttatcttcaaatgttgttagatcctcatgcacaagctgcttatcgtaaaatgttcaatgtcttattggaaaatgataaagagggagaaagtgtggttttccattgcacagctggaaaagatagaacaggagtagctgcatttttaattttgagtgcattaggtgtgagtgaaaaacaaattgtggaagattacttatataccaatctattttttgataattattcttctgaaacaataaatgatgcgttagaaagtgaatcgcaaacagaaatagcacagagattaaacagtaaaacagcagttattgctgaaacaattgaagttttacctaaagcatgtcgagtagtaagtggatctgttgcaaagtttttagaagaaaaattaggaatgacgagagctaaaattgaaagattacaagaattatatttagagtaa

SEQ ID NO: 1510 - DNA, 657 bp, Unknownn
  isolated from dental, unidentified
atgaatagaaaatttttaggacagttaaagattgtgcatcaagattttattgaaatgggattagaagctgcagaagcaataaagttagcaacagaagctttcgaaaatcacgacttaggattggctgataaagttatagaacatgatgaggtaattaacaatttagaaataaaattggaaaaaaagactagtcagttaattgctttgcagcaacctgttgcgacaaatttaagaaaagtaatagcaattttaaaagctagttctgatgtagaaagaattggagatcatgcggtagatgttgccaaggcagtaagaaatattaatgttaaaagaagaaatgttgaaattgaatctttaataagagaagttagtgaacagacgcaagaaaatttagtaaagatagtaagtatgtttgctaagtttgatgaaaaaggcgccgttgagattgctaaaaagaatcaggaaaagagagaaaaaattaatgagatcaggaaactatcaattaatgcaataaaagaagatgcaaactttgcagaagaaggtatagattatttaagcattattgcacatattaaaaggataaatgattatataacaaacttagcagagtggatagtttatgaggaagaaggaaaaattacagaattaaagttctaa

SEQ ID NO: 1511 - DNA, 801 bp, Leptotrichia wadei
  isolated from dental, Leptotrichia wadei
atgataccttttaaagctgtagcgattgatatggatggaacctttttaagagatgataaaagctatgataaaaaattattttctgagttattaaataagatgaaagaaagggatattcattttattgtagctagtggtaatcaatttgaaagaacgagattagattttactgaatattggaaagatatgtccttcgttgccgaaaatggaatgtacttggtagatgatgggaaagatctaagctatgaacaattagatcgaagtttagttgaagagttagtagagtttatggcacaaagacctgaattaacaccagctttatgtgggaaagaaaatgcgtatctagaaaagaattcagattcaaaatttgttaagatgatgaaatattatttacctaagcataaaattgttgatagcttcgagcaacttcctgatgatgtatttttcaaatttacagttgatgttcctaaagaaaaaactttatcaacggttgatgaaattaacaaaaaatttgtaggaagaatttttgctacttcaagtggttttggaaattttgatttaatcttgccacatgtcaataaagctgtcggattagaaaaaatgctagcaagtcggaatttaaccttagatgatttagtagcctttggcgatggcggaaatgatttagagatgttaaaagctgcagggcttagctatgcaatggaaaatggtagcgatgaagtgagaaaggtagctgataaaatcgcccctaataataatgattcaggagtattgaaagttttagctgactatttaatgtaa

SEQ ID NO: 1512 - DNA, 1299 bp, Unknownn
  isolated from dental, unidentified
atgtttgtagatcaaataaaaattgaagtaaaagccggaaaaggtggcgacggtatggttgctttccgccgtgaaaagtatgttcctaatggtggacctgctggtggtgacggtggtaaaggcggaagcattattttaaaagtagaccaaggtttacgtacattaatggatttcagatatcaccgtatttttaaagcaaaacctggtcaaaacggcatgattaagggaatgtatggtcgtggcgcagacgatacttatattagtgttcctcaaggtacgacagttacagatgctgaaactggagaattgttaggtgatttagttgaagcagacgatgaattagttgtagctaaaggtggccgtggtggtcgtggtaatattaagtttgctagtcctaaaaatccagctccagaaattgctgaaaatggtgaacctggtgaagaaaggaaattaaaactagaacttaaagtgttagccgatgttggtttagtaggtttcccttctgttggtaaatctactttactttcagttgtaacaagtgctaagccaaaaattgctgaatatcattttacaactttggttcctaatttgggtatggttcgtctagatgatggtagagattatgttatggctgacttacctggattaattgaaggtgcttctcaaggtgtaggtttaggtattcagttcttacgtcatgttgaaagaactcgtgttattttgcatttgattgatatgtcaggtgtagaaggtagagatccatatgatgattttgtcaaaattaatgaagaattgaaggtatatgatccaactttacttgatagaccacaaatcgtagtagcaagtaagatggatatgccagacagtgccaaaaatttggcagaattcaaagttaagttagctaaggataagactttaaaacaagtgccagaagttatggaaatatcttccctaactcaccaagggttgaaagagttaacacatagaacagctgatgtactagaatctactcctaagtttgaaacattggcagaaaaagaacaagcaagcaaggtttacacctttaaagaagatgaaccagcattcaagattacacgtgattctgatgcaacttgggtactttcaggtgaaaaattggaacgtctatttaagatgactaactttaaccatgatgaaagtttaatgagatttgctcgtcaattgcgtggaatgggtgtagatgatgccctacgcgaacgtggtgctaaaggtggagatttggtaagaatcgaagactttacttttgaatttgtagaataa

SEQ ID NO: 1513 - DNA, 1317 bp, Unknownn; identical to SEQ ID NO: 337
  isolated from dental, unidentified

SEQ ID NO: 1514 - DNA, 1020 bp, Unknownn
  isolated from dental, unidentified
atgcaaaaaagatgtcgcattatttataatccaacttctggtcgtgaagcattaaaaggtgatttagtagaaattttggatatccttgagaatgctggttatgaaacaagtgcatttgctacaacagctgaagaaaattctgctagaaatgaagctgaacgtgcagcaaaagcaggatttagcttgattgttgctgctggtggcgatggtacgataaatgaagttgtgaacggaattgcagggctaaagaaacgtccacagttaggaattattcctgctggtacaactaatgactacgctcgtgctttaaaaatacctagagaaagtccagttgaagctgcaaaagtaattgctgctggtaaaacagttaagatggatataggtatggcaaatgataattattttgtgaatattgctggtggtggattactaactgaattaacatacagtgttccatcagagctaaaatccttatttggatatttagcatacttagcaaaaggcgcagaattattaccacaaatgaagaatgtacctatgcatcttgaatatgatgatggggtatttgatggtgaagcttcaatgtttttagtagcattgaccaactcaatcggtggttttgaacagattgtaccggatgcttcactagatgatggtaaattcacagttatcgtagtaaagacaagtaatcttgttgaaatgctccacttgataacaatggtcttaaatggtggtaagcatgttaatgataagcgtgttttatatataaaaacaaagaaattagttgttaagccagttgatactagaattatgattaatatcgacggtgaatatggtggcgatgcaccaatgaaatttacagctttgaagcaacatattgaattttttgctaatactgatgaaattccaaagggtgcaatcactgctagtgaagatactaagcaattagttaaagatatcgaagaagtaactaaaaaagatttaaatggcgatggaataattggtgaaaaagaagagtaa

SEQ ID NO: 1515 - DNA, 840 bp, Unknownn
  isolated from dental, unidentified
atgaataatccaacattttttgaagtccagaaatgggctttttcttgtataaagggaaatggtggtacattagaagatgtagattacttaatatgtggtcaaatgggttggaataaaacacaactattgatgaattaccggacacgtattgatgataaaaattaccaagaattacaagaaaagatagaattgtataatcaagattatcccctgcagtatttaataggttatcaggatttttatggtttgagactaaaagttacgaaggatacattaataccacgcccagaaactgaagaacttgtggattggattttaaatgataattcaaaaaatgagaactacgatgtcttagatgttggtacaggaactggagcgataggattagcactaaaatctatacgaagtaactggaatatttttttatctgacatttcggaaccagcattaaaagtagctaaagagaatgcccaaaatttaaatttagatgtatcattttctacaagtgatttatttgaaaaaattgaaggaaaaaaagatatcattgtttctaatccaccatatatttcggaaaacgaaaaaatttatatggacaaaagtgttttgaattatgaacctcatcaagctttatttgcaaaaaataatggactagaaatatatgaaagaattgcaaatgaaagtggtaaacttcttaaacaaggtagcaaaatctatatggagataggatttttacagggaaaggcagtaaaaaaaatctttaaagatagttttccaaattcggaaattactttaaagaaagatatcaatggtaatgatagaatgatctgtgtaaaaatttag

SEQ ID NO: 1516 - DNA, 975 bp, Prevotella sp.
  isolated from dental, Prevotella sp.
atgacagtagaaaaagaaataatccaaaaaatagaagagtatgatacgattattattcatcgtcaccaacatccagatccagatgcttatggatcacaaggtggattggcaacagctattatgcaaagctttccagcaaagaaagtatatcaagtagggaaaaacattcctggattaaattggattacagttgaaaatgaagatttaccagatgaaacttacaagaatgctttagtaattgttaccgatacagctaatacaccaagagtggatgatgatagatatgataaaggtgattttttgattaagattgaccatcatcctaatgatgaccaatatggtgacttgagcttagttaataccaatgcttcaagttgctcagaaattatccatgatttaattctagcttcagaaggaaaattagaattgactgctgaggttgctgaaaaactatatgctggtatttccagtgatactggaagatttatgtatgatgcaacaactgcacatacaatggaagtagtagcttctctaatgagaactggtattgatactagcaagataaatcgtcgtttagatagtataactttacccgtagctcgtttatctgcttatgtgtatgaaaatatgaaaattactaagaacaatgcagcttacatcatattaaatcatgataaaatcgaagaatttgatttgggcgatgcaggcacatctgcagtagtaccacttctaggtaaaattaatactacaatttgttggacagtatttgtacaacaaaaagatggtacatatcgtttacgagtacgctcaaagggccctgtgatcaacgaattagctaaagaatatcaaggtggcggtcatccattagcaagtggtgcaagaatagatgatgctaacgaaattccagcttatattgaaaaattagacggattagcaaagaaatttgctgaagaacatgacatgacagactggtaa

SEQ ID NO: 1517 - DNA, 795 bp, Unknownn
  isolated from dental, unidentified
atggtaaatgaatatccgcaagtaatgacaattgctggttctgattcagatggatctgcaggaatgcaagcagacatgaatacttttttggctcgtaaagtatatggtacttcaattttaacagccgcagttgcggggaattcttatggaatccatgctagtcatgctttaccagttgattttatcaaagcagagtttaaggcaattgcagatgattttaaaattttggcgactaaaaccggcatgttgacagatactaagacgattcattctgtaattgaaagttataaaaaatacgattttggaccactaattgttgatccagttattattaccaagcatggagcgatgttactggaacaagaagcatatgagacagtgcgcgatgaattgattccattggcaactgtgattacacctaacttctatgaagcacaaaagttagtagaatctgagcttcaaaatgaggatgaaatcattgaagcagctaagaagttacaagctatgggtgccaaaaatgtagttattaagggtgaacataatggtgactctgaaattgttaaagattatgttttgctcgaagatggtaagaatttctggttagaagatgagtatatcgatacagaacatatcaatggaactggcgatacttactcagcatgtatagctgcagaacttgccaaaggagcaagcattgaagaagcaattaaaatagctaaaaaatatactcatgatgcaattaaaaatgaaattgcagtaggtcataaattcggaccaatcaatcattgggtatag

SEQ ID NO: 1518 - DNA, 1074 bp, Unknownn
  isolated from dental, unidentified
atgacaacttttcaagaacgtagaaataggttaagaaatttaatgtcacaaatgagtgttgatgcatatttgataactaacagatttaatatttattatctaagtggttatacaggtgatgatggagtagttttagttactgaacaaagtgcatatattattactgatagtcgatttgaagaacaaataaaaacagaaaatcctgatatagattcaattattacacgtgactatttgggtgaagcgcttaatgttgtggctaaggaaaattgtgtagctttggcatttgaaagtactttagattatgaatcgtttgattatttagatgaaaatgcaagtagtgatgtagtagctttaactaaagtaattgaagaaatgagagcagttaaggatgaagatgagatttcgacgataagaaaagcttgtcaactctcaagaaaaggttacgaacatattttaactaaagtatatgctggtgtgacagaaaaagaaatggccttagaacttgactattacctaagaaaaaatggagctgcagaagcatcatttgaaactatttttgctagtggagatcgaacagctttacctcacgctacctattctgataaaaaaattgttgaaggagaactggtaacttgtgattttggatattatttcaatcactacacttccgatataacaagaacttttgtagttggtaaggcaagtgatgaaataagaaaaatatatgatattgttaaagtagctaaagaaaaaacaattgaggcaattaaagcaggtattagttcaaaagaattagatgaaattggtagaggatatatcaaggaacaagggtacggaaaatacttcactcatggtatgggacatggaataggcttagatatacatgagttgcctaatattagttatagttatccagatgtcttagaagccggtgaaatagtaactattgaacctggtatctacattccaggattaggtggagtaagaattgaagatgatatcttagttacagaaaaaggatatgaaaatttaactgactttaagcaagatttgatagaaatcagtaattaa

SEQ ID NO: 1519 - DNA, 447 bp, Unknownn
  isolated from dental, unidentified
atgagagtattattgcaaagagtaaagcaagcatcggttgaaatagatggaaacgtaaatggtgaaatcggacaaggattattgttattagtaggttttactgaaaatgatggcgataaggaaattgaatatttagcaagaaaagttttaaacgctagaatatttagtgatgctgatgataagatgaatttaaacttacagcaagtatcaggtagtattttgtctatttcgcaatttactttatatgcacaaactcgtaagggaaaccgacctagctttacaagagcccaaaatccagatatagctagcaagaattatgataagtttaacgaaaagttacgcggatcaggtgtacaagttgaaactggaatttttggagctgatatgcaggtatcattagttaatgatggacctgtaacaattatgtatgatactgatgaggaataa

SEQ ID NO: 1520 - DNA, 537 bp, Unknownn
  isolated from dental, unidentified
gtgagtcgtattggttataaagtagttaacttaccagaaggcgttgaagtaaaacaagatggtaatgtagtaactgtcaagggacctaaaggtgaattgacacgtgaattttctgacaaaattactattaaagtagaaggaaatgaagtttctttcgaacgttcagcagaagataacaaaacaaaagctttacatggtacaacacgttcaaacttccataacatggtagttggtgtatctgaaggtttcaagaaggaacttgaacttcgtggtgttggttatcgtgcacaaatgaagggtaaaacattagtattgaatgttggttactctcatcctgtagaatttgaagaagaagaaggtattacattcgaaacaccttccgcaacttcaattattgtatcaggtatcaataaggaagaagttggcgattgcgcagctcgtattcgtgcaactcgtgcacctgaaccttacaagggtaaaggtattcgctatgttggcgaatatgtacgtcgtaaggaaggtaagacaggtaaataa

SEQ ID NO: 1521 - DNA, 795 bp, Unknownn
  isolated from dental, unidentified
atgaatgaaccaaattcaattttacaaggttcggtagctcaccgtggctggacgtcggtagttgatccggtaacaaaattattgatggcccttgatctggccttactaagcttttgtttcaccaatttgttagttgaaattgcgcttgtattcgttgcgctagtgattctactgatttcgaaagccggcaagtcggcggttcacgcaattgaattcagctcattcttaatttttacaatgctgattattcagggcctcttttacagtcacaatcagactctgttggtttcagtggtcgggattcgattctatcaagaagggctgttatatgcagcaacgatggggtgtcgaatttttgtcattattttagcaaccagcttttttatgacaacgactacagtgtcagaaaattctaaatatttggagcaggtcggtctctcctataaagcggtctatatattgatgtcggtttgctatattttaccggaaatgatggccaacatgaaaaaaattcaaatggctcaacgggcacgtggcattaatcaacagaaaaccattcttgaaaagattaaatcaattttaccagtgctggttccattagtgatcaaaacgcttgatcaatcaatggaacggtcgatcgccctgcgattacgtggatttaatagtccccatcgggtagcactaaaatcggcaaatctttatcggcacgaaatggttaatcatcgtggcttgagtttattagcaattatattgattgggtggaaattatggataatcggcagcaaattcatttag

SEQ ID NO: 1522 - DNA, 2268 bp, Unknownn
  isolated from dental, unidentified
atggttgaaaagactcaaatgcaaaacgttgatgtaaaagatgcttgggaaggatttagaggaaaagaatggaaagaagaaattgatattcgtgaatttattcaagataacttcactccatatgatggagatcaatctttccttgaaggaccaaccgaagctacaacgaagttaaacgataaattaatcgacttaaaattaaaagaacgtgcacatggtggacctcttgaagctgatacaaaagtagtatcaacaattacatctcataaaccaggttatttagacaagtcattagaaaagattgttggtttacaaacagataaacctatgaaacgtgcacttatgccatatggtggtatcagaatggctaaaggtgctttggaagcttatggattcaagattgatccagaaacagacttcgtatttgaaaatctatctaagacgcataaccaaggtgtatttgatgcatacacaagcgaaatcatgaaagctcgccacaacaagattatcactggactaccagatgcatatggtcgtggccgtttgattggagacttcccacgtattgcattatacggtattgatcgtttgatcgaaggaaagaagaaggatttggaaaattgcggcgatggtgaaatgactaacgacgtaatccaaatgcgtgaagaaatttctgaccaaatcaaagccttaaacgatatgaagattatggctgaatcctatggctatgacatttctaaaccagctacaacagctaaagaagcaattcaatggctatactttggttacttagcatctatcaagcaacaaaatggtgctgctatgtctattggtcgtatcgattcattcatcgatatttacattgaacgtgatatgaagcgtggtattttaactgaaaaagaagcacaagaattaattgaccaattcacaatgaaattgagaatggtatgcttcattcgtacaccagcttacaactcactattctcaggtaaccctatctgggcaacattatcaattgctggtatgggcttagatggacgtcaccatgtaactaagacatcatatcgtttcttaaatacattgcataatatgggtgccgcaccagaaccaaatattacattactttggtctgatcgtttgcctgaatcatttaagcactatgctgcaagtgtatctattgcaagttctacaattcaatacgaaaacgatgacttaatgatgaagacatggggaacagactactatggcattgcttgctgtgtatctgcacaaccaattgcaaatggtatgcaattcttcggagctcgtgcaaatctagctaaggctgtattgtatgctatcaatggtggtaaggatgaacttacaaaacaacaagtaggtcctgcatacgaaccaattagctcagaatacattgactacgatgaattcatgaagaaattcgatgacatgatggaatggattgctgatatttacgtaaatgctttgaacacaattcattacatgcatgacaagtattactatgaatcagcacaaatggcattgaaagatacattggtagatcgtagctttgctacaggtatctctggattgtctgttgctgctgactcaatttcagctatcaagtacggacatgttaaagtaattcgtgacgaagatggtattgctgttgacttcaaggcagatcatgacttccctcgttatggtaacgatgatgatcgtgttgacgatattgctgcatggcttgttaaggaactatttactaagatgagcaagcatcatctatatcgtggagctaagttaacaacatccgttcttacaattacttcaaatgttgtttatggtaagaacacaggtactactccaaatggtcgtcaaaagggtgaaccatttgcaccaggtgctaacccagcatacggagcagatacaacaggtgctttagcatcactattatccgttgctaaattaccatacaagtatgctacagatggtatttctaatacatttgctgtaacaccaacaacattgggtcatgatgaaaagatgcaagaagatacattggtaaacatgatcggaggctatatgagaaaagatggtcatcatttgaatattaatgtattcaacagagatactttattagatgctcaagcacatccagagaagtatccaacattaacaattcgtgtttcaggttactgtgtatactttgctgatttaactaaagaacaacaagatgacgttattgcaagaaccttccatgcttcaatgtaa

SEQ ID NO: 1523 - DNA, 1026 bp, Unknownn
  isolated from dental, unidentified
atggcgtattcaacaattgttactaaagatgaaggggcagttattatagttgataatattgatactaaacgaaataaagctgaacataaaataattcaattaaacaaagaagccaaaatatacttagtttcttttggaaagtatgaattagatggattagtttgggatagtctgataaaaggatttcagatgagagttaaccaaccaatagccacgtttaaagaatgtatacttagatttgaagaatatctaagaagtttaaaagataactatagaaaagatctttatattcaaagaataatttggacagctttaaataacctaactttaaatggcggaatacaaagcttggtagaaaatattaaccgaatatataatacattatcaattgatagacaagtaaatgaagaagctactccaattttgattaatgagctagctaactttttaaatcaaaataaaatatccatggatcaagaaagttttaataaattagtcgaaattgttaaagatgcttatttatatcctagaaagaatttacaagattatatgggaatttgtcttgtaggtgtgggcaatgacgaaaccagtattagtgcaacaagctatagattatatggagtaacagaaaataataaattattagctagtgttcaacagataggtaagggtattatcaatcttgaaaaatctgaagcaactgaaattatgattggtggcatttctcaaacttttatggatgatttttactggaatttgaataatagtaataatcctaatctattacaagctacaagttcattatctgaaattgctcaaaatgaatataatatctcacaagaaattttaagaaataagagtttagatgatatcagtgactttttattcaatgtatatgggatacatcgccagttagaaatagcacaggtaggggaagatttacaagcaaataaagtaaagctagtaaaattttctttattagatgaaccgatagtaatagaaaaagagttaggggtgaacaattaa

SEQ ID NO: 1524 - DNA, 879 bp, Unknownn
  isolated from dental, unidentified
atggaggaaaaaatgttagaaaatatcttaggtagagaaattgttgcgaaggtaacagattttaatgataaatatatctttgcgcaagtagacggtttaacttttagaatggcacgtgatgaacttttaaaagcacctaaagttaattcatcattgaaaggttttgcctacatcaatgataatcatcagttgcagttaactaagaaggttcctaaagttcaggttgacagatatgcttggggaacggttgtcagcagccgtaaggacttgggtgtatttgttgatattggtttacctaataaggatattgtagtatcagttgatgatttgccagaattaccacaattatggccacaaaaaggtgataaattgatgattggcttgtcaattgatgctaaagatagaatgtggggtaaattggctacccctgaaatgttccaaactatcagtggaatggccaagaagaatatgcaaaacaagaatgtaacagctacagtctatcgtttgaaactagtaggaacttttgtaataacagatgactactatttaggcttcattcatccatctgaacgagaagttgaaccacgtttaggcgaagttgttaaagcacgtgtaattggagtaaaagatgatggaacattaaatctatctacacgtccacgagcatatgaagcaattagtgatgattcacaaatgatattgatggctttacaacatacatcagccaaacaattgccatttacagacaaatcatcaccagacgaaatcaaggcctacttcggtattagtaaaggtcaatttaaacgtgcagttggtcatttaatgaaagcaggtctagttaaacaagcagacggattcttgattttaaatgaaaattag

SEQ ID NO: 1525 - DNA, 1956 bp, Unknownn
  isolated from dental, unidentified
atggatattcgtagtttgttaatgaaagatatcatgattatggatcttaaggctactactaagtctgaagtaattgatgaaatggtacataactattataaacatggaatcattgatgatgaagatctttataagaaagatatcattaaacgtgaagaagaaggctcaactggtatgggcgatggaattgctattccacacgcacatgacgctgcagttaagaaaccagctgtacaatttgctagaagtgttgcaggtgttgactatgactcaatggacggccaaccagctcacttattcttcatgattgcagctccagaaggtggagataatactcacttgcaagccttagctgctttatcacaagtattgatgaacccagatgttgtaacagcattgaaagctgcagatacacctgacaaagttcaagatatttttgcagaagctgtagctaagaaggaagctgaaaacaaggctgaagaagaagctgaaaaagcagctgcaaatagtaatagtgatcgtccatatattgttgctgttactgcttgtccaaatggtattgcacatacttacatggctgaagaaaacttaaagaagaaagctaaagaattaggtgttgatatcaaagttgaaacaaatggttctgaaggtatcaaacatcgtttaacagcagatgaaatttcaagagctgtcggtgttgttatcgctgctgataagaaagttgaaatgaaccgtttcgatggcaagccacttgtaaataagcctgttaaatctggtatccaggaaccagaaaaattaattcaacaagttttagatggaaaagcagctatttatcacgcaacaggtgatgatagtagttcttctactgaatctgatggaactgtttggggtaacatctacaagcaattaatgaatggtatttcacacatgctaccatttgttattggtggtggtatcttaatggcgatctcatttattgttgaacaatatatgggtggtgccaaagctccagcatttattttcttaaatagtgcaggtaatttagcatttgcatttatggtacctgtgttggcagcttacattgctgaatcaatcggcgatactcctgctttaatgcctggtttcgttggtggattcatggcttctatcgctaatgcttccttaggtggatcatatcatgttaacttccaagctaactcaacttcacctgctggattcttaggtggtattgcagctggttttattgctggatacttgattttaggtatgaagaagatgtttgcaggattaccacgttcagttgaaggtatgaaaccaatgcttctttatccagtatttggattgctattcattgctttgattatgtacttcattgttaacccaatcttcagtacaatcaatctatggattactcacttcttgaatggtatgggtactggaaacttagttctactaacattagtattagctggtatgatgtctattgatatgggtggtcctttcaacaaggctgcttatgtatttgcttcaggtgctttcgctaacgatcctaagtctacaactgctgctattttgatggctgccgtaatggttggtggtatggttcctccatttgcaacagctatcggtactgcattcttcaagaacaagtatactgaagatgaacgtcgtgcaggtgttacaaactggatcttaggattctcattcattacagaaggtgctattccatttgcaacagctgatccaggtcgtgtaattccatcatgtatcattggttctgctgtttctggagcaatcgttggtgctatgagaattggtattcctgctcctcacggtggtttctgggtatcacctctagcaacaaacatttggggttacttcttagctgtaatcgttggttctatcgtagcagctttgattatgagtttctggaaaaaaccagttaatgaaaaataa

SEQ ID NO: 1526 - DNA, 1383 bp, Unknownn; identical to SEQ ID NO: 251
  isolated from dental, unidentified

SEQ ID NO: 1527 - DNA, 804 bp, Unknownn
  isolated from dental, unidentified
ttgaaaaaagttcttatttctatattatcagggatcattctctccttggttatattaatttcagcacctacacatatttctgctgatactttaaaagttggcattttagctgataataaaccttatagctatctgactaataaaaaagtaactggttttgaagtagagttaagtaaaaaaattgctcaagaaatggacgctaacattaaatttgttaaggtttcagatcgcaaaaaattgcaaaaattagttagtgagcatcaaattgatcttgctttgggacaatttgataagactacactttcatctaaattgatcacaactgacacttatttatatccacaaaatgtcttgtttactggcacacatcgccatatctcatctattgaagatttacaaaataaaaaagtaggtattctagttaatggtaatcaacatcagcttttaacaagcctacaaatgaaacctaaagtttataacagcatatcttcattaatgaaagcattggaaaataaaaaaataaaagctggtatcctcacagattatgaatatacagcttatcttaataaacatcctgaattaacttctgcttatttacaagcacttaattctaccaaaaaatctgatttacccaagttgactttaacacgcataaaagatcctcaaatcacctcgcaacaattagtgggaattactgataagaggaatactaaactaaaccaaactttagataagttaaaagatggtaatgacattatagacttatcacaaaaatacttttcacaggatttaaccaaaccataa

SEQ ID NO: 1528 - DNA, 3537 bp, Unknownn; identical to SEQ ID NO: 159
  isolated from dental, unidentified

SEQ ID NO: 1529 - DNA, 1437 bp, Unknownn
  isolated from dental, unidentified
atggcgaatttttttaaaagattgtttgctaaagaagaccctagtgtttatcaaaagaaagatgcacatttaattcaagtgttaaccgtaaaggatttcttagcattaggggtcggtacgattgtttcgacttcaatctttactctacctggtgttgtagcagctaattatgcaggccctgctgttgctatttcattcttggttgctgcggttgttgctggcttggtagcattcgcttatgcagaaatgtcctctgccatgccttttgctggttcagcattttcatggataagtgtcgtttttggtgaatttttcggttggattgctggttgggcattattagctgaatattttattgctgtagcattcgttggttctggatttagtgctaatattagaggtttgttggcaccaataggtttcaacttaccagcttctttatctaatccttttggaaccaatggtggtattgttgacttaatgtcattagttgtaattcttttagttgcatttctattatctagaggtgtatcagaagctgctagagtagaaaatgctttagttattttgaaagtatttgctattattctatttattatagttggtgctactgcagttaaagcaagtaattatgttccattcattccagaacatcgtttaaatactgatggtactcattttggtggttggcaaggaatatatgcaggtgtttcatctattttcctatcttatatcggatttgattcaatagctgcaaatgctgctgaagctaagaatccatctaagactatgccgagaggaattttaggttcattgttaattgcggttgttttatttgtggctgttgctttagtattagtaggaatgtttaaatactctagttatgctggaaatgctgagcctgttggttgggcattacgtaaagctggtcacggtgttattgcttcagtagtacaagcaattgcagttttcggaatgtttacagctttgatcggaatgatgatggcgggttctcgtttactttattcattcggacgtgatggcttgctttctaaatggttaggtgttttaaatgaaaacaacttgcctaatcatgcactttttgtcctaacagttattgctgtaatattaggtgctttcttcccattccaagtgttatcacaattaatttctgccggaacattgattgcgttcatgtttgtttctttgggtatttatgcattaagacctcgtgaaggtaaagatttaccagttccaggatttaagatgccactatatccagttttaccagcattagcatttattggtgctttaattgtgttcttaggattggatatcgaagctaaagagtattcattatattggtttattattggtgtagtagtatacatagtttatggaatgcatcattctaatttacaaaagaatcttaagtaa

SEQ ID NO: 1530 - DNA, 1950 bp, Unknownn
  isolated from dental, unidentified
atgctacttttacaagcacagcaagttgcccgacattttggagcagatattctttttgagaatgtcaatcttgatataaaagataactccaagatcgcacttgttggtcgcaacggagcaggaaaatctacactaattaaaatgttaataggtgaatcacttccagatgaaggaaaaatcgttactaaacgagatttaaccattggatatttagcacaacatacaggattagaatctactaaaaatgtattagatgaaatgttaagtgtctttgaacccttgcaaaagatggaagctaagattcatcaacttgaagaaaagattgcttctccgtcaattccacatgaatctaaagaatatcaacaattattaaatcaatatgatcaattacaacatgacttccaagaaaataatggttatggctatgaaaatgaagtaaaagctgttttacatggtttccaattttttgaagatgattatggaaaaatggtttctgacttatcgggtggacaaaaaacacgtttagctttagccaaattacttttagaaaaacgtgatttgttaattcttgacgaacctaccaaccaccttgacattgaaactttgacttggttagaaaattatatccaaggttataccggtgcccttttaatcgtttcacatgaccgctatttcttagataaagttgttaacgaagtttacgaattaagtcatcaacattctagtcattatgttggaaattattctcattatattgaagaaaaagcttctcgcttgcgtactcaatggaaggaatatgaaaaacaacaagtaaaaattcaaaaattagaggattttgttaataaaaacttagttcgagcttctacaactaaaagagctcaaagtaaaagaaaacaactagagaaaatggatagattagaacgtcctgaaggtgaagaaaaaggtcctcattttaaatttcatgctagcaaggaaagtggaaatgtagttttaaaggttacagatgctgctattggctatgattcaaaagttatttcaaatcctatcactttcgaattacgtaaacatcatgcaatggctattgtcggacctaatggaattggcaaatccaccttactaaagagtattttaggaaatattccttttatccatggatctgctacttttggtactaatgttcaaactgggtactacgatcaggaacaacaaaacctacatgataaaaaaactgtcctaaatgaaatatgggatgatcatcctaatatgttagaaaaagatgttcgctcattattaggtagtttcttatttgtcggtgatgatgttaaaaaagtagtacataatctttctggtggggaaaaggccagattaacattaacaaaacttgctctacaagaagataatttcttaatgcttgatgaaccgactaaccatttagatatagatagtaaagaggtattagagagtgctttaattgattttgaaggaaccattttatttgtttctcatgaccgttatttcatcaatcaagtcgctgatactgttcttgaaatcactccagaaggaagcaacttataccttggtaattatgattattatttagagaagaaagctgaattagaagcaattgaagcggctaaaaaggctgaacaatctcaagatgatcaacaagtttcaaaaacatctcaaaagcaacttgactataagaaaagtaaagaattacagaaacagcaacgtaaattacaacgtttagttgatgatgctgaatctgaaatggaacgtcttgaagaattaaaagctaatatagagcaagaaatgacactacctgataatttcaatgatccacaaaaaatggatgagttacacacaaaactatctaaaacaacaaatgatttaaataaatccgaaagcaaatggactgaactaagtttagaattagaagaattacaataa

SEQ ID NO: 1531 - DNA, 1281 bp, Unknownn
  isolated from dental, unidentified
atgaatccaaaatttgaagaacaattccgtcaagaaggatttaccgaacctacgttaattcaaaagtatgtatatcccaaattagctgaaggaaagaatgtagtaggtttagctccaactggttccggtaagactttagcatattcattaccattgctagaaaaaatattacccaaagatggaagtcaattattaatcatggctccttctcaagaattggctgcacagttaacaaatacgataagaccatgggctaaattattagacttaagtgttattggtttgttaggtggtgctaatgtaaaacgacaaattgaaaaactaaagaaacatcctgaagtagttattggaactccaggtagattgttaaatttaataaaactaaagaaactgaagcttcataaaattgaatctattgttattgatgaagcagatgagatgttaggtgatgaagatagcttaaacgatgtacgcgaaatcgttagtcactgtccatctgaagcacaaattagctttttctctgctactgaagcacctattctttctgaattgcatcgttggtttggtgttgatgtagaaaaaatagatgttcgaaaagaagataatacacgtggtgaagtaactaactatatgatagaaaccccaacacgtaaacgaactgaaatgttaagaagattaggacatgttgatgatttttatgctttagttttctttaaacaaacagctactttacgtgatgtagcagaaaagttacttcatatgaaagtaccagtagctattttgtctagtgaacaaagacaagtagatagacaaaaatcattaagacagttacgtaagagagaaataagatttgttttaacaactgatgtagctgctagaggattagatttacctgatttaccagcagttgttaattatgatttacctaaggatactaatacttacattcatcgcgcaggaagaactggtcgtatgggtgcagatggtattgttgttaacttggggaatgaacatgatttgcgtttattcaaacaattaatgtctggaacagattttgtgatagaaaaaggtatattatatgctggaaaattaattctagaatctgaaaaagcattgattatagtagaagatgaaagacctaataaaaaagcaacaaagaaaaaaattaaagataagaagcctacttgtaaggaagaaaaggctacagaaaagaagaagaaaaagcgcaagcgtaatttgaaaaataagggcaagcgtcatggacgtaaaaaagataagtag

SEQ ID NO: 1532 - DNA, 879 bp, Unknownn
  isolated from dental, unidentified
atgtttaaaggggaaatttttatggtagcaacaatattagatgggcgaatgttatctaaaaaaataagaactaatgtatctgaaaaagttagcttattaaaacaagaagggataactccaaaattagtagtaattttagtaggcgaagatcctgctagtcaagtttacgtaagaaataaaagaaaaactgcacatgcgttaggtatagaggctgtagatattagattgcctgaaaatgttgaagaagatgaattaattaggttaattgatgaattaaatagtgacagaactgttcatggtattttagtgcaattgccgttaccaaaacatataaatgaaaataaagtaacccatagaattatacccgaaaaagatgtagatggatttcatcctttaaatatcggaaaactatttatgaatatacctggaccattaccttgtactccaagaggaattatggaatttttcaaggaatatgatattcctgtttcaggaaaaagagttgtaattgtcggcagaagtaatattgtaggtagaccaatggctgcattgctggtaaatagtgatgctactgtaacaatagcgcatagtaagaccaagaatttagctgaagtgacaaggcaagctgatattttgattgttgctattggtaaaggtgagtttatagatgaaaattatgtaaggaaaggagctgttgtgatagacgtgggtatgaatagaaatagtgatggaaaattagtaggcgatgttaatatggagagtgtgagcaaagtagccagttatataacaccagttcctggtggcgtaggaccgatgacaattgcaatgttgatgaaacaaacagtagaattagcagaaagaagtgttactggtgagtaa

SEQ ID NO: 1533 - DNA, 1365 bp, Unknownn
  isolated from dental, unidentified
gtgcttaatttagatttagattcactttggcaatatattattgaatctttcagtaaatctttaaatcctgctagctacaaggcgtggtttggtccagcagaacctgttcaatatatcgatcaaacactaattgtaaatgttcctacacctttacatagggattattggactcaaaagcttaatggacaaatttcagatctaatccaagaagtatctggtgaaaaaataactgttttagctaagctacctagtgatcctaatcctctagcaaattcagaaagtgtaactacaccaaaaaaagtttctgttgcagaaaataataatagttcttcttttctaaaagaaactcaacttaacgatcgttacacttttgatacttttgttgttggtaaaggtaatcaattagcacatgcagcagcactagccgttgctgaagaacctggcgttttttacaacccgctcttcttctacggcggtgttggtttgggaaaaactcatttaatgcacgctattggacatcaaatgttagaaaatcgtcctgatgcaaaagtaaaatacgttactagtgaatcctttgccaatgatttcattagttctatacaaacaaaacgtcaagaagaattcagacgtgaatatcgaagtgtcgatttactacttgtagatgacattcaattttttgcagataaagtaggtacacaagaagaatttttccatactttcaatgcactatatgatgataaaaaacaaatcgtactttcatcagatagattgcctaatgaaattccaaaacttcaacaaagactagtttctcgctttaaatgggggctatccgttgatataactcctccagattttgaaacgagaatcgcaattttaagaaataaggctgaggctgagcatgtttctattccagatgacactctcagttatatagctggtcaaatagattcaaatatcagagaacttgaaggtgctttaatgcgagtagaagccttttcttcaatgactcgcaccccaatttctactagtctagcagctgaagctcttaaaaatttaaaagttagtggcaaatccagtaaattaactattcctatcattcaagataaagtagctaagtattatcatgtaacaattgctgatttaaagggaaagaaacgtgttaaatctatcgttattcctcgccaaattgctatgtacttatcacgtgaactaacagatgcctcacttccaaaaattggaaatgaatttggtggtaaagaccatacaactgttattcatgctcatgagaagattgctgaagctcttcatacagacactactcttcaaaaagaagtaaatgaactgcgcgctgagctgcaagattag

SEQ ID NO: 1534 - DNA, 1194 bp, Unknownn
  isolated from dental, unidentified
gtgattcttacattaggttggaagcgctatcaacaaaaaacgagaaattatttgaatatttattcattatttggaaaggagtatcctattatgttaatcggtgtacctaaagaaatcaagaagccagaagaacgtgttggtgctactccaagtgctgtagcaagcttagttcatgcaggccattcagtaattgttgaaaaaggagctggggttggctctggtttcccagatgaagaatacatcgctgctggtgcaaagatgggttcagcagaagaagcatgggacacagaaatggtcatcaaagttaaagaacctttggaaaatgaataccaatacttcaaaccaggccaaatcatctatacttatctccacttggccgcagataaaccattaacagaagccttaatcgaaaagaaggttacaggggtagcatacgaaacaatggttggtagaggcggcggacttccacttctcttccctatgagtgaaatcgctggccgtatgtcaatccaagttggatctcatttcttagaacaagcacatggtggcaaaggtattcttttgagtggtgtttccggtgtacatcgcggtaaagttgctattatcggtggtggtactgtaggtttcaacgctgctaagatcgctgttggtatgggcgcacaagttacaatccttgatattaatgctcaacgcttagccgaaatcgacaacattttcgatggaaagattcaaactttaatgtccaatactgctaacatcaagaaagctgttgaagaagctgacttagtagttggtgctgttctaatcccaggagctaaagcaccaaaattagttacagaagaaatggttaagaacatgaagcctggttctgttatcgttgatattcctatcgaccaaggtggtatcttcgaaacaacagtgagagcaacaactcacgaagatccaatctatgtaacacatgatgttattcattacacagttgctaacatgcctggtgctgttccaaagacagctacagaagcactttccagcgcaacagtacattatgcaattgaaattgctaataaaggtattgataaagcagctgctgaaaacaacacaatccttacaggaattaatacacaccaaggagaccttacttccaaggctgttgcagatagtttagacctaccattcacaccctataaaggttaa

SEQ ID NO: 1535 - DNA, 1347 bp, Unknownn; identical to SEQ ID NO: 219
  isolated from dental, unidentified

SEQ ID NO: 1536 - DNA, 1149 bp, Unknownn
  isolated from dental, unidentified
atgatcaagtactatcgctatgtattcaatgatcattttgtaattgcgttactctttttactgggtggaataagctacacatactctaatttcataaagtccttaaatgtagatctatcgtacccatgggccaagccggtagtaatcattgccttgcttgtgatgttgcaatttggaaaggtagggacattaattgatgagcctgataaagtgttccttttgccacaagaaaagggtatgagagagtatttgatgaaagcacaaaagcgagcttgggtgtcaaacagcgttattcaaatcgttgtctggatcgttttactgcctttcatttactacggtgtccatttaaacttagtagaaagcataatcctattattaagtcaggtagctttaaaggttgcccaggtaaacttattctttatccgagcctttgaagcgaagtatcaagcaggcaaatatagtcttatccttaattatgtggtacctttaatcgtttatacgcttggcttgtatgcatccatatatttcgcattggggattaccgttgggctaattctgtatttgaaatcattgcctaaaaataaaatcattcaatggaattatttgatagacgtagaaaaactaagactgatgagaaaatacagtttcttcaacctatttacagatgttccccaagtaaagaagaaagctaagcgtagaaagtacctagactggctcatacctaagtttaaaaacgtatatggctacctattcattagggcaatcatccgaaatggtgaatatagtggcctgtatgtacgcctaaccgttatcgagttcattgtcctactctttatccctaaattctggcttagcctggtaataggaatgttgttcatctacttaatcggtttccaaatgttaccactatacaagtactttgacgataatgtattcgtacacctatacccactcgaaaccaacagcaaaggcaaagaattcaaaagcattctattagctttattgataatcaatgcctttatatcagccatagccgtatatatcgctatccaaaacctactactctcaggagccttccttgcccttgtattagtcgaaagcatcctgtttgtttatggatatgcaaatttaagattagaaaaatcttga

SEQ ID NO: 1537 - DNA, 498 bp, Unknownn
  isolated from saliva, unidentified
atgacagctgaaagtattatttcgatgttgaaagaaatatcagataatggaaataagaaatatcctgtcactgattttggtggagtatttaattttagaataactttttttgataaaattcctaatgatgtagcaaataaacttattgaacttaatttacctgatgaagtaattgaactactaaggtatactaatggattgaatttattcgaagatgaattcaaaggtatggaattaggtggacctgtttgtaaaatttattctggacaggaaattttacaaagatatcaagaatcaatagataaagacttaattcctatactacttttccgtgattatggtgaaatgtgtatcaatatcagaaattataagcaaaaaaaggattatttaacttatccaggtatggaaatggataagtgttttaaatgtacttttctaaaatggttagagatgtttattgtagcgaatggcaatgctttttgggaatggaatttttaa

SEQ ID NO: 1538 - DNA, 597 bp, Unknownn; identical to SEQ ID NO: 907
  isolated from saliva, unidentified

SEQ ID NO: 1539 - DNA, 1119 bp, Unknownn; identical to SEQ ID NO: 1466
  isolated from saliva, unidentified

SEQ ID NO: 1540 - DNA, 2658 bp, Unknownn; identical to SEQ ID NO: 1061
  isolated from saliva, unidentified

SEQ ID NO: 1541 - DNA, 465 bp, Unknownn
  isolated from saliva, unidentified
atgtcgattgaagtaggagctaaactttccggaaaagtttcaggaattacagattttggtgcatttgttgatttaggggataagaagactggattagttcatattagtgaagtatccaatacttttgttaaagatatccatgaagtcttatctgttggtgatgaagttactgttaaagttttatctgtcagtgatgatggtaagatcggtctttccatcaagaaagcagtggataaacctcaaaagcaaaacaaccaacgtcgtaacaataatcacgaacaacataataatagggataaagtaaagaaaaatcataatacttcttttaagccaaagcatgaagaaaagaagaaagatttcgattccttattagctggatttttgaaggaaagtgaagatagattgacttccttgaaacgtaatacagaaggaaaacgtggcggtcgtggcggtcgtcgcagctaa

SEQ ID NO: 1542 - DNA, 1143 bp, Unknownn; identical to SEQ ID NO: 1273
  isolated from saliva, unidentified

SEQ ID NO: 1543 - DNA, 516 bp, Unknownn
  isolated from saliva, unidentified
ttctatgtttgtctaggagggataattttgaaaagagaagtagcaattgtaatgggtagtatttctgattgggatactatgaaagaggcagctgaaattttagaaaattttggagtaaactatgataaaaaagttatttcagctcatagaatgccaaaagaaatgttcgtcttttctgaaactgcaaaggataaagggttaaaagtaattatagctggagctggtggcgctgcacatcttccgggaatggtagcagctaacactatactaccggttattggagtcccagttaaatctcgtgcattaaatggaatggattcattattgtcgattgtacaaatgccagctggaattccggtagctactacagcaattggtgcttcaggtgctaagaatgcagcattattggcgttgcaaattttgggaattaatgatgaaaaaatagctgaaaaattagttttatttagaaaaaaacagcatgatgatgcagaaaagagcggtgagcaacttggatag

SEQ ID NO: 1544 - DNA, 594 bp, Unknownn
  isolated from saliva, unidentified
atgaaaattataaaaaataatatactggtcataattctgattttgatggtactgatatcaatcgctgtatatgatattttaccaacacgtttgcctatacattttaccttaactggaacagttgatggtacagcacctaaattggagggtatcagttttatgccggtcatggaactaatcttgtggttgataagtagtttggggattaaagatatcaatctaaaaaaggtaatagatggcataggaataatattatttctagcacagttaacaataataggtgtagctttgaaacctacagcaaatattaacatgattaattcgattgctttatcctgtatgatcatcatcatagctttaataacaagaaataacaaaattaatcgctatattggcattagaactactagaactatgagtagcgataaaatttggaaaaagaccaatacttttgcaagtaacttgttattggtggtaggtagtataggatttgttttaggtatctttttaagtagtgtatcatttataatcataattgcactactattaatagctgtggtaggttcaatagtatattcatactatgtaaaataa

SEQ ID NO: 1545 - DNA, 552 bp, Unknownn
  isolated from saliva, unidentified
atggataacattattcgtgatggaaatccaactctaagagccagagcaaaagctatcgaatttccattaagcgaagaagataaaaaattagcacacgatatgatggagtttctcgaaaatagtcaaaatcctgaaattgccaaaaaatatcatcttcgtgcgggtgttggtttagcagctcctcaagtagatgtttctaaaagaatgactgctgttttggttccaggtattgaagatgatgacgaaccaatttttaaacatgttctgatcaatcctacaattttaagtgaatccgttcaattagcagcacttggtgaaggtgaaggttgcctttcagttgatcgtgatattccaggatatgtccctcgacacgatcgtattaaacttcgctggtatgacctagatggaaataagcatgttgaaagacttcgtgactaccctgcaattgtagttcaacatgaaattgatcacttaaatggtattttattctatgatcatattaataaagaacaacctttaacagttccagaaggtactattattttagagtaa

SEQ ID NO: 1546 - DNA, 693 bp, Unknownn; identical to SEQ ID NO: 1395
  isolated from saliva, unidentified

SEQ ID NO: 1547 - DNA, 369 bp, Unknownn
  isolated from saliva, unidentified
atgttacactttaatttcaatagtaccgaaccaatatacttacaagtagctaatcagttagaggaagcaatttttacaaaagctttcttagatggtacacaagttccttctacgactgaaatttcaaaagaattccatattaatccggcaacggtattaaagggaatgaatattttggttaatgatggactattggaaaaacgaagaggtttaggaatgtttgtaacagagggtgcttatatgaagttactagaaagaaggaaagagtctttttatcaagattatattgtaaaaatgatacaagaagctaagaaattaggcatgaatgaagatgatttaattgaattagtgaagagaggtgtggattag

SEQ ID NO: 1548 - DNA, 408 bp, Unknownn
  isolated from saliva, unidentified
atgatttatggaaatggaatagatatacaagaaataaggaaaattcaaaaagcgcaagagaagcgtgagagttttgctaaacgtatactaactgtaaatgagttagctatatttgaaaaatataaaggaaatcgaaagtatgaatttttagccggtcgtttttctgctaaagaagcatttagtaaggcatatggaactggaattggaaaaaaggttggctttcaagatattgagattttaaatgatagtcagactggaagaccagaaattgtaaaatttcctggagataataaattacaggccaagatttcgatttctcactctggtgaatatgtagttacagaagtgatattagaaaaattaacatggcagactaagatgaaaaaattcttaattaagcaaaagtaa

SEQ ID NO: 1549 - DNA, 996 bp, Unknownn; identical to SEQ ID NO: 697
  isolated from saliva, unidentified

SEQ ID NO: 1550 - DNA, 972 bp, Unknownn; identical to SEQ ID NO: 1044
  isolated from saliva, unidentified

SEQ ID NO: 1551 - DNA, 2553 bp, Unknownn; identical to SEQ ID NO: 1207
  isolated from saliva, unidentified

SEQ ID NO: 1552 - DNA, 933 bp, Unknownn; identical to SEQ ID NO: 1089
  isolated from saliva, unidentified

SEQ ID NO: 1553 - DNA, 978 bp, Unknownn; identical to SEQ ID NO: 977
  isolated from saliva, unidentified

SEQ ID NO: 1554 - DNA, 1242 bp, Unknownn; identical to SEQ ID NO: 872
  isolated from saliva, unidentified

SEQ ID NO: 1555 - DNA, 1779 bp, Unknownn; identical to SEQ ID NO: 1186
  isolated from saliva, unidentified

SEQ ID NO: 1556 - DNA, 498 bp, Unknownn
  isolated from saliva, unidentified
atgattattttaataggattgattgttgtaggggcgtttctcttacaaggattgtttggaatctttcaaattaaaaatttttccagaaattatcgtgaactaagattactaggaccttatcgcattctgattggtaaaaatcctaaacgcttcttttcaggttcattgatgttgatagcgatagataatgatggaaatataaaagaagctcgtttaatgcaaggggttacagtgttcgctaaatttagaacattgaagaaactcgaaggtaaaaacatcgcggttttagctgcagattatcaagagttaaagagaatgaataaattgactagacaatgtttattgaatgcttacaaaacttttgttgattttaagacacaaaaattgtcagcaagtgcttacgatacaagtgtaaatgtgttcaacatgccattatttacaaagattggtttaatggcaaacaatttgaaggcaaatatgtcaaagaaatttaattag

SEQ ID NO: 1557 - DNA, 1848 bp, Unknownn; identical to SEQ ID NO: 1008
  isolated from saliva, unidentified

SEQ ID NO: 1558 - DNA, 1500 bp, Unknownn; identical to SEQ ID NO: 1451
  isolated from saliva, unidentified

SEQ ID NO: 1559 - DNA, 1047 bp, Unknownn
  isolated from saliva, unidentified
atggtaaaggtgaaaacaaattcaatagtaaaattatgtttaagtattgtactatgtatttgttttttacagataccgcatgtaaatgcagataacgtatctaataatgtagctgaatttacaataagtcctgtatatcctcgtgagcaaaaagaggatgatgcaggatattttgatttaaatgtaaaaaaatcaacaacggtacctgtaaaagtaaaaatttctaatttgaataaaaatcaagatatagaatatctgattaaagttggaaatgcaactacaaacgataatgggacaatcaattatactaatttcaaaaataaaaaagatacaactgcaaagtatcaacttacagatttcgtttctaaaacagattcaaaacaaaaaatcacagtaaaagctggctcaagttctgaagttacggttaatttaaaggtgccaaagcaaaaattccctggaacgattgctggaggagtttacgtagaacgcttaactaattcttataccaatgagaaaaatggtatgaatacaagaaatcatttttctatgacattgccagtcattttaacagaacaggctaaagctaaacgtatagctaagatggaattagacaaagtaatggtgaagaatggacctgaagttatagctaaactacacaacgtgaagccagtaatgtttggtaagttgtcaatagattcaaagataactaaaaagaatcatgttaaaacattaattcacaagaatgtaaataattaccaagtggcgccaaactctagttttaacttcttagcttctgatagtagcaatcaacttggggcaggaaaatatacgatagatatgcatttacaatcaggaaaaagaaagtggcacttagtaaaagactttaccattacagctaaacaaggtgtgccattgactaagcgcacaggttggttaggaatttcaatggtaatgtggatagtaatactaattctagtaattatcattgtaggattggtagtagtgatagtaagacaaaagcaaaatttaaaaacaaagaataagtag

SEQ ID NO: 1560 - DNA, 1068 bp, Unknownn; identical to SEQ ID NO: 665
  isolated from saliva, unidentified

SEQ ID NO: 1561 - DNA, 951 bp, Unknownn; identical to SEQ ID NO: 1242
  isolated from saliva, unidentified

SEQ ID NO: 1562 - DNA, 2061 bp, Unknownn
  isolated from saliva, unidentified
atggcaatttttcatatgagttttagtaatattagtgctggaaaaggacgaagtgcaattgccagtgccgcttatcgaagcggtgaaaaattatttgatgataaggaaggacgccactacttttatacccgcgcggttatgccagaaagctttattttaaccccaaaaaacgcaccagaatgggccagtaatcgagaacaattatggaatgaagttgaaaagaaagatcgtaaatcaaactcacggtatgcaaaagaatttaacgtggctttaccggtagaattaagtgaatccgaacagaaagaattactgacaaaatatgtgcaagaaaattttgtcgatcaaggcatggtagctgacgtagcaattcatcgtgatcaccaagataatccgcacgcacatgtgatgttaacgaaccgaccatttaaccccgatggtagttggggattaaaagcaaagacgcagtacattaaagatgaaaatggcaagcaacttttaaccaaaagtgggtttccaaaacaaagaaaaatttggttggttgattgggataaaaaggaaaaaattaatgagtggcgaaaaaattgggcgttgagtgttaatcagttcttagcacaaaaaaatattccggatcggattagtgaaaaatcgtttgtggaacagggaatagctgatacaccaatgcaacacgagggaatcaatagtaaacggcatgaaagaaaggcatttaatcaacaagttaagacctatcgtaagtccaaagctggctataaaaatatgcaggaaaaagtaattaatcgaggtcatttagatagcctaagtaaacacttctcatttaatgaaaaaaggttggtaaatgagttaagtcatgaactgaaaacttatatcagtctggagagtttagatgataaacggcgtctgctatttaattggaaaaacagtaccttaattaagcacgctattggtgaagatgtcactaagcaattattgacgattaaccaacaagaaagttcactaaaaaaagcagatgaactcttaaataaagtagttgatcgcacgactaaaaaactttatccaaagcttgattttgaacagataaccgcggctgaacgacgggaattgattaaagaaactaatagtgaacaaacgattttcaaaggcagtgaattaaacgaacgtttaatgaatattcgtgatgatttattgacccgacaattattgacctttaccaaacggccatacgttggttggaagttattaatgcaacaagaaaaggaagtcagaatcaagcttaaatatacgctgatgattcatgatgatagcttagaaagtctagaacacgttgatcaaggtctactagaaaagtattcaccaaccgagcagcaaaagattactcgagcagtcaaagatttacgaacaatcatggctgtgaagcaagttattcaaacccaataccaggaagttttaagaagagcctttcctaacggcgattttaatgaattaccaatgattaaacaggaacaggcctatacagcagtgatgtactatgatccagctttaaaaccgtgcaagattgaaacaatcgcacaatggcgggaaaatccaccgagggtattcaatactcaggaacatcaacaaggactagcttatctatcgggacagctgagcttagatcagttagataatcaccatttacaacgggttttaaagcatgacggtactaaacaactctttttgggtgaatgcaaagccgatccaatgattaagaacagtcagatcgagaaaatccaaaagcagttaaaagagcaacaagccaaggacgaccagtatagaaaagtaaatatgggacattatcaaccgctaaattacaagccagttagtccaagctactacttaaagacagcctttagtaacgcaatcatgactgccctatatgcccgtgatgaagattacgaacgacaaaaacagacacacggcttaaaagagactgagtgggcaatgacgaaaaagcagcggcaacaccaaacccataatcggcatgaagatgggggtatgcacttgtaa

SEQ ID NO: 1563 - DNA, 1206 bp, Unknownn; identical to SEQ ID NO: 1336
  isolated from saliva, unidentified

SEQ ID NO: 1564 - DNA, 2646 bp, Unknownn; identical to SEQ ID NO: 1249
  isolated from saliva, unidentified

SEQ ID NO: 1565 - DNA, 1500 bp, Unknownn; identical to SEQ ID NO: 854
  isolated from saliva, unidentified

SEQ ID NO: 1566 - DNA, 765 bp, Unknownn
  isolated from saliva, unidentified
atgtctaaagaacctgttgtccaacaggaaattgtaacagccttccctaataccaaggaagttcgttacgataatgaattaaaccgtattcctattgggtttatgaatgaaagtgaacagaatattttcttcgctatcctaagtcaggttaaagaaactagtgaaagaaagaccaaattatcttttactcaaattcgtgaattagcaagttttcagaagacttcaaacaaagagttaatcaagtctcttgataatatgacaacaaaactagcctctttaaatgttcgaatccataaccaacaacaaattattaagtttaccctattcccaacttttcaaatagatggggatcagcagactctaactgttgctgttaacgaagattttcgctatatcgttaatgatttagccaaaggattcgtaactaactttgacattgaagaatttacttctatcaaatctaaatatgcgaaaacagcttttcgtttagctagagaacacgaaaatgaagtctttgatgttgtattaaaggattttaaagaacttttctctattcctaaatcttatcgaccaacggatatcaatagattaattttaacaaaagttagtaaaatcctacaggagtattttactgtttttgaaattacacctgtacaagatgaaaaaggtaaagctcatcgaatcatagcttaccgttttaatattggaaaacgtattttaagaaatcttgacgaaccacgtcaaatttcattattggatgactaa

SEQ ID NO: 1567 - DNA, 2085 bp, Unknownn; identical to SEQ ID NO: 167
  isolated from saliva, unidentified

SEQ ID NO: 1568 - DNA, 1230 bp, Unknownn; identical to SEQ ID NO: 1134
  isolated from saliva, unidentified

SEQ ID NO: 1569 - DNA, 2961 bp, Unknownn
  isolated from saliva, unidentified
atgaataatttcaatgttagtgatgtaatgatacgtaatacaattcaaacatatgaaaaaagtcaaaatttcaataattataaggaatttattgaaattattaaaaatgataatatttttcttgaacaaatattattggctaatcctaagctgtatggaatgcttaaaaagtataatgcaggaaaactaaagaaaaagaaagaaaaaaatttttttgaatcaatatataaatattataaaaggagctattatcgagcaactccttttggactatttagtgaaacttctaatggtaaatttaccgttaagggtgataagaaagaattagggaaaacacacaaagtagtttttatagatattaaatggttaacagatgtaatttttaaattagaaaaggactatcaatcaaatttatctttcatatctaataatggaaattacattagtggaaatcgtgttatgcaattatattcaataaatgatcaagatttagaggaagttagtattaataactctaaagtttatcgaattatatcagaagagtgtagccaaacttataagacatatagtgaaatcatagaaaaggttataacaatatatggtaatgaatacttaaatttaacaaaagaatatattaatgatttagtagagaatcattatctaatatcaaatttacaagaaaatatactaattaatttttctatgtcagacttcataatgaaagttagggaaatagatgttagtaaaaaatatgtagaaatattaacaaagatacaagagttaattgaagaatatacacatattgaaataggttcgggttctgataaattaattgaaatatatcaccaaatggctagacttaataaaagtgataattatattcaagtagatttatataatgatggaaatatatatattgataatagtaataaacaaagaatagagaaattttcaaattttataactaatactgttaaatcagtaactaggacttattttgatgactataaagataaattcattgaaaaatatggtattgatcaagatgtgcagttaatagaactatttgatccaataaaaggaattggcgcaccgtatgattatacgcatcctcagaatgaagtttttgaattagagcctccaacgtcatattattcccatgatgaaaaagaaatgtatattaataaatatatagaagctttattaaatagagaggaaattaatttgaaatgcttttctaattattatagaaatctgaattccaaagaaagtacctcaatacaaggaatagaattattttttcatatggtccaaattaataagaagaaaactttagcattaagcaatattataggcagtaataatatagggggatcctctggaaggttctcattattatcagataaattaagggattatcacatgaagacacttaaacaagtgaaagctgcaaatattgaagaaggggtgacgtcttgtgaaatagtttttcttcctgaaaatatacgacacgctaatataatgcgaacatcttttgtaagagaaaaagttcttcctattttctcaagtactgatcaatctgaagtaaggctaactaatatttatattggattagatgaaaatgaaaatttttatgcgtatgatgtgtctactcaagaaaaaatgaagttttatgtaacaagcatgtataacaagacattatttagtaatgaactaagatttttatgtgaaatttcaataaataataattttggatatgtaccatgggatttaatctataaagatatgaattttattccacgaattatgtttgaggatatagtagtcagtcctaagacatggagaatatttaaatttgaattaagtaatatagcaatagagtcgattataaagcagagaaatataccgaatgaaatttatattgttgacggtgataacaaactatatattaatcgtaaaaattcacttgatgttgaactgtttatgtcagaaataaaaagaaatatagaaaagaatggtcatgccattatacaagaatattttaataataaagacatgatatataaagatagtgaaggaaaaatatcagagatagtggttccagttattaatagtaaattcgatgttaaaaaagtaaacaaggaaaaacaacagagaatctccaaacatgttcgagagaaattgccattcaatgattggttatatctaaaagtgtatatgtcgactaggagacaagaagagtttatacgagtttacatacctctgattcaaaaaaaggtagaaaaattagacagaaaactatttttcttacgttatatggatccagtaccacaaataaggataaggataagtggtaataatttatataaaatatatgaagttattaaaaaagatttggagcaaggtcatagaaatggtattttatcgacttttgatatttctacatatgatcgcgaaattgagagatatggaggagttaatgcaatagatatagctgaaaatattttctgtgaagattctaaacttgtaataaagtatttgaaatttataaaagaaaagaacatggaagataaacttgatgatattgcagttgcaatgatttatttttatttaaaaatattttataaaacaaatgaagacattttatgttttctagataaagtctgtcccaataaggtagataaaaatgtaaggtctaaaatacaatactataaaagtgtagtatttaatcagttaactgacatatatgagattgacaaatacaactttaatagacttaaggaagagattaaaaaactaaaattaataattgataaaaaaaatgctgacactattatggatagtattatacatgtacataataataggttatttggaattaatagggttagggaacaaaatctgtattttattgtaaaaaaaatgattatgtctgaaaaatatattttgaaagggaaataa

SEQ ID NO: 1570 - DNA, 1449 bp, Lachnospiraceae bacterium; identical to SEQ ID NO: 813
  isolated from saliva, Lachnospiraceae bacterium

SEQ ID NO: 1571 - DNA, 2847 bp, Unknownn; identical to SEQ ID NO: 1210
  isolated from saliva, unidentified

SEQ ID NO: 1572 - DNA, 807 bp, Unknownn; identical to SEQ ID NO: 1094
  isolated from saliva, unidentified

SEQ ID NO: 1573 - DNA, 846 bp, Unknownn; identical to SEQ ID NO: 1334
  isolated from saliva, unidentified

SEQ ID NO: 1574 - DNA, 672 bp, Unknownn
  isolated from saliva, unidentified
atgaaattatattataccgggcataagaatcttgaaataaatgctggaaaaatcactgtattgggaacgaataatgtgaatgtgtataaagaatttattgatacttttttaaatgggtatggaagtaatattcaattaagtgatgataaatataatcgaaaagatataagtacgagtattgattgggatggggatgtaatgttaacagaccgaattagtaaaaagtatatgaatgtattaattaagaagattattgaagacatcacagacgatgaaagacaagcaatactaaaatcagtaaatagtttgtatgatcgtattcgagaggttttgtataaaattgatataccattacaagtagattatgacaatgatttaacaagactatttaagtattgtcaggtacatacagaggcattgctatggaaaaatgcgtatgatagaatatcttcagatgttaaattgcatgtggaactaaatagagaaagaattataggtctaaccaatgtcgcacattatctcactaaagaagagtttcaggaacttgtaggtcttgttaaggcgactaactcatcaatgtttataattgaattcacagaaaagaatggtcagagattctttgaaagctgtgataattactacattgatgaggattatattgattggtactaa

SEQ ID NO: 1575 - DNA, 888 bp, Unknownn; identical to SEQ ID NO: 1045
  isolated from saliva, unidentified

SEQ ID NO: 1576 - DNA, 1284 bp, Unknownn; identical to SEQ ID NO: 992
  isolated from saliva, unidentified

SEQ ID NO: 1577 - DNA, 1251 bp, Unknownn; identical to SEQ ID NO: 957
  isolated from saliva, unidentified

SEQ ID NO: 1578 - DNA, 963 bp, Unknownn; identical to SEQ ID NO: 31
  isolated from saliva, unidentified

SEQ ID NO: 1579 - DNA, 1830 bp, Unknownn; identical to SEQ ID NO: 784
  isolated from saliva, unidentified

SEQ ID NO: 1580 - DNA, 993 bp, Shuttleworthia satelles
  isolated from saliva, Shuttleworthia satelles
atgaaagttatttgttatgctgttgcacctctagaagatatttatattgaaaattgggctaaagaaaatgatgttgaaataaaaattctacgagaagatttaaatgaggaaactgttcatttagcagaaggatttgatggtatttcatccgaaggcattgaacctgtaactgaagaagtttacgctcagcttgaaaagtttggtttaaagcaattagctattcgacaagttggtttcgacaatcaagatttagaagctgcaaaaaaacacggtattaaaattaccaacgttgcttcttattctcctagagctattgctgaaatgggagttactcatgctatgtatcttctaagacaagtgggtatctattacaatagaatgaaccatggtaatttcaattttgaagaaagtactctaagtagagaaatcttcaattgtacagttggtttaattggaggaggacatatcggtggagctacagcacagatttatagtgcattaggtgctaaagtactattatttgatccatattatgatgctgctttagaaccatttgtagaatatacagatttagatactatctttaaaaaatctgatattatttccctacacacacctttacttccaagtacagcaaatattattaacgctgaatctattagtaagatggaaaaacaacctattttaattaatatggcccgtggaggtttagttgatacttcttccttaatagatgcactaaaatctggcaagatttcgggtgctggcttagatactctagctaacgaagctgaattctttggaaaagaacatgttgaaaattccgacctacctgatgactataaagaattagtaaacatggataatgttttaataactccacacgttgcattctttactaaacttgctgtaaaaaatagtattgagattgcattaaatgacatgaagtctataattaatggtaaaggttcaaaaaatatcgttaatttatag

SEQ ID NO: 1581 - DNA, 537 bp, Unknownn
  isolated from saliva, unidentified
ttgtttaatagtcaaactgataaacttacggtattaaaagctcaagctcaagatatctgtcgtaaatataataataagataaatttcgaaaataagtatgattactcattactgtcatctttatttaaaaatttaggagataatccttacattgaatctaatttttattgtgaactaggtactaatatttcatttggaaataactcttttctaaatcatgatgcaactattgtagattatgcaccagttaagattggaaataatgtcaatattgccccaaaggttggtatctatactactatttatcttgatgatcctaaattgagaaaacaacattatcttttagctgctccaattatcattgaagatggcgtatggattggaggacatgctgtaattggtgctggagtaacagttggtaaaaactctattatcggtgctggcagcgttgttacaggagatattccagctaattcagtggctgttggaaatccagccagagttattcgtaaaatcaacattgatgataaaccataa

SEQ ID NO: 1582 - DNA, 873 bp, Unknownn; identical to SEQ ID NO: 751
  isolated from saliva, unidentified

SEQ ID NO: 1583 - DNA, 1623 bp, Unknownn; identical to SEQ ID NO: 1118
  isolated from saliva, unidentified

SEQ ID NO: 1584 - DNA, 843 bp, Unknownn; identical to SEQ ID NO: 819
  isolated from saliva, unidentified

SEQ ID NO: 1585 - DNA, 993 bp, Unknownn; identical to SEQ ID NO: 1440
  isolated from saliva, unidentified

SEQ ID NO: 1586 - DNA, 1116 bp, Unknownn; identical to SEQ ID NO: 1160
  isolated from saliva, unidentified

SEQ ID NO: 1587 - DNA, 510 bp, Unknownn; identical to SEQ ID NO: 1038
  isolated from saliva, unidentified

SEQ ID NO: 1588 - DNA, 543 bp, Unknownn; identical to SEQ ID NO: 648
  isolated from saliva, unidentified

SEQ ID NO: 1589 - DNA, 408 bp, Unknownn; identical to SEQ ID NO: 710
  isolated from saliva, unidentified

SEQ ID NO: 1590 - DNA, 1320 bp, Unknownn; identical to SEQ ID NO: 1184
  isolated from saliva, unidentified

SEQ ID NO: 1591 - DNA, 1251 bp, Unknownn; identical to SEQ ID NO: 822
  isolated from saliva, unidentified

SEQ ID NO: 1592 - DNA, 1038 bp, Unknownn; identical to SEQ ID NO: 1441
  isolated from saliva, unidentified

SEQ ID NO: 1593 - DNA, 933 bp, Unknownn; identical to SEQ ID NO: 1101
  isolated from saliva, unidentified

SEQ ID NO: 1594 - DNA, 1062 bp, Unknownn; identical to SEQ ID NO: 1281
  isolated from saliva, unidentified

SEQ ID NO: 1595 - DNA, 1107 bp, Unknownn; identical to SEQ ID NO: 631
  isolated from saliva, unidentified

SEQ ID NO: 1596 - DNA, 1221 bp, Unknownn
  isolated from saliva, unidentified
atggaagaaataaaaagaaaaattttaaaaaataaatttggcagagtgatattagaatgggacaggagaattgaacagaatgcttatcgatacaatttcgaagaattcacgctttcttcgggattaccaggggttattttactgttattagagatggaagatttagataggacatataagtccaaaattgatcagtattgtgactatttatatggaaagttatcaaaatatggacttttaacaggttctctatattcaggtgcagctgggattgcattaagtttattaccactcaaaaaagatttgagatttcaaaatttaattgcaagtctaaatgattacattagttattatgtagacaaagaaattggagagtttaatattggaaatgttactccacctaattatgatgtgattgaaggattatcaggaattctcatgtatctgcttttaatagataatatagatatcaaattagtgacaaaaattattatttttttattaaccttattagatgataatgattcattgatagcgatgtatattaaaacaggtgaccaaatgtcagaggcagaaaacgaaatttatcctaatggttgtctaaatacaggtatgtcacatggacttgctggtgtaggaagtgtattggcttatgcgtataaaaagggctttatgaaaaaggaaatattacacggattagaaaggattattcagatttatgaaaaatttgaattagttgataagaataaatttcattggaaagatggaatagattataatgaattggttaataatagaacaattttaaaagataatgatttatttataagagacgcatggtgttacggtagtccaggaataagtgttttatatttatatattggactaattcaagataattcataccttataaaaaaagcaatagaaatactatatagagctactaaggaaatgcggaatgtagattccaacatgatttgtcatggcaagtcagggatagtttcgatatgcattttatttaggaaacttacaaaaacgagaaaatttgatacatttataaataactatactgatgaaatagaaagtatttttgacaaagatattcgaaatttaggctttcttgagggaacaacgggtattattttaactttaaatgagtgtttttcaaataaagggaaaacgcaatggatgaaatcattaatgttatttgatgatttttaa

SEQ ID NO: 1597 - DNA, 1464 bp, Unknownn; identical to SEQ ID NO: 1447
  isolated from saliva, unidentified

SEQ ID NO: 1598 - DNA, 1146 bp, Unknownn; identical to SEQ ID NO: 1028
  isolated from saliva, unidentified

SEQ ID NO: 1599 - DNA, 2424 bp, Unknownn; identical to SEQ ID NO: 931
  isolated from saliva, unidentified

SEQ ID NO: 1600 - DNA, 657 bp, Unknownn; identical to SEQ ID NO: 1076
  isolated from saliva, unidentified

SEQ ID NO: 1601 - DNA, 915 bp, Unknownn; identical to SEQ ID NO: 754
  isolated from saliva, unidentified

SEQ ID NO: 1602 - DNA, 747 bp, Unknownn; identical to SEQ ID NO: 1219
  isolated from saliva, unidentified

SEQ ID NO: 1603 - DNA, 1230 bp, Unknownn; identical to SEQ ID NO: 1169
  isolated from saliva, unidentified

SEQ ID NO: 1604 - DNA, 408 bp, Unknownn
  isolated from saliva, unidentified
atgtttttaacatttggtcaattggcaggtttaattgctgcacttgcatttttagtattagtgatatatttatgtcgagttttagcacgtttgacaagtacagtatctgagttgacaaagagcataaaaactttgacagaggatgctgatgatatttcagaaaaaattgaagacttattagtgaagactaatagtttaatggatgatgttaatcaaaaatcatcaaaattagatccattatttcaagcaacatctgatttaggtgaaagtgtttcggatttaaatcaagcaagtagaaattttgttgaaaatatggggaattcaactcatggtcttgtaagaacttcaacaatgttgaaaaatggattaagagcaattaagcttattaacaaattacgcaaaaaataa

SEQ ID NO: 1605 - DNA, 1311 bp, Unknownn; identical to SEQ ID NO: 708
  isolated from saliva, unidentified

SEQ ID NO: 1606 - DNA, 1314 bp, Unknownn
  isolated from saliva, unidentified
gtgaaagataaaattatttcatactttggtattgataagcacggttccacaattagacgtgaaattttagccggctttaccacattcatttcaatggcgtacattttgttcgttaatccgacagttttaggagctgcccatatggacaaaggagctgtatttacagctacagctttggctagtgcctttggatgtttaatgatgggactttatgctaagtatcctattgcaacagctccaggtttaggtgttaatgctttctttgcttattcagttgttatcggaatgggtattccttggcaaacagcattggctggtgtattcgtcgcagctattattttcttattaattacagtatttaaattgcgtgaaatgatcattgattctattccgcaagacttgaagtatgctatctctgctggtattggtttattcatcgcttttatcggtatgaagagtgcaggtattatcgttgctaataaatctacattagttggtttaggaacattccaaggtcaaacttggttatcaattattggttttgttttaatggcagtattaatgttattgaatgttccaggtgcaatctttatcgctatgcttgtggctgcaatcattggtatggtaacaggcttaattccagcaccacatcaattcatctcatctgctccaagtttagcaccaacatttggtcaagcaattaaacatgttacagatattaatacaatgcaattagtcgtagttgtaattactttcttattggtaacattctttgatacagctggtacattagttggtttagcacaacaagctggttttatgaaagataacaagatgcctcgcgtaggtaaggctttactatctgactccagtgcgatgttagttggttctgttttaggtacatctccaattggtgcctacgttgaatcatctgctggtattgcggtaggtggtcgtacaggtttaacagctgttacaactggtgtattgttcatcttaggtatgttcttctcaccattgttgacagtagttacatcatacgttacagctccagctttaatcatggtaggtgttttgatggcaggtaacatggcacgtattagctgggataagttggaaattgctattccatcattcgttatccttgcaacaatgccattaacatatagtatcgctgatggtattgcattaggtgttatcttctacccaatcacaatgattactgcaaaacgtggtaaggaagttccaccattgatgtatgtattattcttcgtgttcttgatcttcctatggatcttgcaaacaggtgaataa

SEQ ID NO: 1607 - DNA, 438 bp, Unknownn; identical to SEQ ID NO: 1131
  isolated from saliva, unidentified

SEQ ID NO: 1608 - DNA, 1791 bp, Unknownn; identical to SEQ ID NO: 1137
  isolated from saliva, unidentified

SEQ ID NO: 1609 - DNA, 1587 bp, Unknownn
  isolated from saliva, unidentified
atgattaaatacatagataatcaggaagttatcatgattaaagctgggcactgggaggtacttatgcagacattaatacagacatttatggatcggcggagtgatttgctcactgcgttgtggcaacacttggggatttctttggccgcgctagtcattgcaatggtgattgcgattccactggcgatttgggtcgttcgccgaccacggtgggccgaggggttattgcaattgaccagtgttttgcagaccattccgtcgctggcactattgggattgctgattccgctagtcggtattggcacggtgcccgcggtgattgcgctagtgatttacgcgttgttgccaatctttcaaaatacttatttagggatctcggaaatcgacgcgtcaattgaagaagcggccgatgcgtttggaatgtcgcggatgcgcaagttgttcaaagttgaactgccgattgccttgccacaaatcattgccgggattcggaccgccctagtgctcattatcgggacggcgacgttagcggctttgattggtgctgggggtctagggacgtttatcatgcttgggattgaccgtaatgatacgtcgttgctgttgattggggccatttcgtcagcgctattggcgattctgttgagtgcactcgtgcgctggttccagacggccaaaccccaccacgcgttgatcgtgttcgtgggtattttggcgttactcggtggtggcgcgtacagcgtttatgccaatcgagttgaaacaattacaattgcaggtaaactcgggtccgagcctgacatcttgatcaatatgtacaaacaattgattgaagctgaagacgaccacatccacgtgaccttgaaaccgaactttggtaagacgaccttcttattcagcgctctgaagaataatcagatcgacatttacccagaattcactggttccgtattggaaactttggcgaaggacaataatccggccagtcaaacggctaatcagacttatcagttagccaaaaagcggctagctaagcaggaacagatgacttacttgaagccgatgcagtacaacaatacgtacgccctggccgtcactaagaagttccaacaagaacaccatttgaagaccatcagcgatttaacacaagtcgaatcgatcctcaaaccagggatgacgctcgaatttatcgaccgcgatgatggcttgaagggaatcaagaagacgtatggcttggatgttacggccaaatcgatggaaccggcattgcgctatgaagcgattagcaaggggaaaatcaatctggtggacgcctacgcaacggatagcgaattacgacaatataacttggcgctgctgaaggatgataagcacttcttcccgacgtatcaaggggcgccactcatgaagaccagctttgctaacaaacacccgaaagtcgtccaagcattgaataagttagctgacaagatttccgaaaccgatatgcaagagatgaactatgaagtcaatgtcaaaaagaaatcggcttccacagtcgcacataactatctcgtcaaacacggcttgttaaaggaggaacgctaa

SEQ ID NO: 1610 - DNA, 1113 bp, Unknownn; identical to SEQ ID NO: 646
  isolated from saliva, unidentified

SEQ ID NO: 1611 - DNA, 318 bp, Unknownn
  isolated from saliva, unidentified
atgttagttgtaacaacagaaaatattccaggtaaaaagtatgaagttttgggtgaagtattcggtgtaactactcaatctaaaaactttgtcagaaatatcggagcaggtttgaaaaatatcgttggtggagaaattaaagattacaccaagatgttacatgaagctcgaatggtagcaattgaacgtatgaaacaggaagctactgaaaagggtgcggatgcgattgtgatgatgcgtttcgattccggatctattctacaagatatgcaatctgtcgtagcttatggaactgcagttaaatttatcgaagattaa

SEQ ID NO: 1612 - DNA, 1902 bp, Unknownn; identical to SEQ ID NO: 695
  isolated from saliva, unidentified

SEQ ID NO: 1613 - DNA, 765 bp, Unknownn; identical to SEQ ID NO: 1066
  isolated from saliva, unidentified

SEQ ID NO: 1614 - DNA, 1950 bp, Unknownn; identical to SEQ ID NO: 202
  isolated from saliva, unidentified

SEQ ID NO: 1615 - DNA, 642 bp, Unknownn
  isolated from saliva, unidentified
ttgaactttttaattgatttcattctacacatcgatgcacatttagttaatattgttaatagctttggtaatttaacttatttaattgtttttggagttatttttatcgaaacaggtgccgttataatgccatttttacctggtgactctctattatttgctgctagcgctctatcagctagtagtgagtatcatctaaatatttggctttttattatactattttggcttgcttctgttactggcgactcactaaactatttcattggtcataaagttggacgctctgtttcacaacatcacttttttggtaaatttattaaagaagaaaacatgaagaaaactgaagcattttttgaaaaacatggtggcattgctatctcattagcaagatttatgcctattatcagaaccttatctccttttgtttctggtggtacaggagttaaatattctactttcattaaatataatttactaggagcaacagcttgggttctcatttgttgtggtgccggatacttttttggtaatattccggttgttaaagaacatttttccttagttattattggaataattgtagtttctttaattcctgctattgtaggagctctcaaaagtaaactttcaaaaaattaa

SEQ ID NO: 1616 - DNA, 1128 bp, Unknownn; identical to SEQ ID NO: 1133
  isolated from saliva, unidentified

SEQ ID NO: 1617 - DNA, 750 bp, Unknownn; identical to SEQ ID NO: 1141
  isolated from saliva, unidentified

SEQ ID NO: 1618 - DNA, 840 bp, Unknownn
  isolated from saliva, unidentified
atgaaagttttaattactggtgcaaatggacaattaggtcaagaaatgcaacatctgttagatgaacgtgggcaagaatatctagcagaagattcacaaggactagatataacagataaggaagcagtagatgcttactttgaaaagaacaaaccggaagtagtttatcattgtgcagcttatacggcagtggataaggctgaaggggagggaaaagaacttaactggaaagtcaatgttgatggaacagaaaatattgctaaagcatgtcaaaaagttggggcaacattgctttatgtaagtacagattatgtctttgatggtaatcgtacaagtggtgaatatttaccagatgatcccaaaggaccacgtaatgaatatggtaaagcaaaacttgctggtgaagaagcagtacaaaaatattgcgataagtactacataattagaactgcttgggtatatggacaatggggacataatttcgtatacactatgataaatctagcaaagaatcatgataagttgacagttgttgatgatcaggtaggacgccctacatggactagaacattagcagaattcttgacatacttagtagataataaggttgaatatggtgtatatcattgttgtaatgatgggcaatgttcatggtatgaatttgctaaagagatattgaaagatacaaatgttgatgtacaacctgtaacttcagatcaatatccaacagctgcatttagaccacattatagtgtaatgaagttagctaaagaaacgggctttgtatttccggattggaaagaagcgttggatgaatttttaagtgaagtgaaaaaataa

SEQ ID NO: 1619 - DNA, 1119 bp, Unknownn; identical to SEQ ID NO: 828
  isolated from saliva, unidentified

SEQ ID NO: 1620 - DNA, 1758 bp, Unknownn; identical to SEQ ID NO: 966
  isolated from saliva, unidentified

SEQ ID NO: 1621 - DNA, 513 bp, Actinomyces oris
  isolated from saliva, Actinomyces oris
atgaatgaaattgaattagcccatgtaaatgatgttgacagatgcttgaaaattattaatagtggtaagaaatttcaaaatgatcagggatttgttgaatggacagatgattatcctaatcgtgaaagtatattggaagatattctagctaataagggatttgtgttgcgtgtagatggtatcattgccggctatttacgaatagattttacaggcatgccatattataaggaaatattgggagattggcatacggaagaaccctacgcaacaattcatagttttgcaatagcagaagaatatcgtaatcaaggcctagcaagcattgctttggaattggtggaaagattgacatatgcttgccaaatctatggagttagattagatacagctcttgaaaatgaacgaatgaaacatattttgaagaagaataattatcaaatatgcggaaaagttaattttaagggtgcagatagagtggcctttgataaggtattgaaagaaagattttaa

SEQ ID NO: 1622 - DNA, 897 bp, Unknownn; identical to SEQ ID NO: 771
  isolated from saliva, unidentified

SEQ ID NO: 1623 - DNA, 2475 bp, Unknownn; identical to SEQ ID NO: 790
  isolated from saliva, unidentified

SEQ ID NO: 1624 - DNA, 1452 bp, Unknownn; identical to SEQ ID NO: 1462
  isolated from saliva, unidentified

SEQ ID NO: 1625 - DNA, 798 bp, Unknownn
  isolated from saliva, unidentified
atggaacaaaaactactattactagatataaaacatggatttaattttcgtgatttaggcagttataaaacattagatggacgtaagattaaaaagcataaaattctgcgttctgctaatttggcatatttgtctgaacgagatgttaactatttagatgactatggtcttagatatgacgtagattttcgttcaatatctgaaaaggaagttgaacctgatcggattagcaataatgttcattatcattttaatccagttttttcagaggatgagactcgtagtactaagaaagatcaagagactagatataagacctacagcaagattaaaaatgctggttttgaggatatgttgaaagcatataaagatattgtacttacagatggagctaaaaaagcatatcgccaattcttcgatttattgttagctaatgataaagaaaatgaagctctattgttccattgtacagctggtaaagatagaactggtatgggagctgtttatttgttaactgcactaggtgtagatagtaaaataattcatcaagattacttagcatctaacgtttatacagaaactgttcgagcaaagaaaatagctgatgtaagtggaatgggtccagtgatgtccgcgaatattaaggccctatttgaagttaatgaagcttatttaaatcatgctttgcaattgatgaaagataactttggtgggataaataattatttgcatacagaattgaagttgaatgaacaagaagtttcagatttaagaaagatatacttgacagacaaataa

SEQ ID NO: 1626 - DNA, 834 bp, Unknownn; identical to SEQ ID NO: 1090
  isolated from saliva, unidentified

SEQ ID NO: 1627 - DNA, 1116 bp, Unknownn; identical to SEQ ID NO: 186
  isolated from saliva, unidentified

SEQ ID NO: 1628 - DNA, 666 bp, Unknownn
  isolated from saliva, unidentified
atgctaaataatttagaaaaaacgccgttaagaccttattggtatctttcagtacttttcatcgctctaggagtttatggttcattatctggagttcttcctctaacttggatctggttcattgttggaggggctctagcaattgttactcaattcaactttgaaactttaaaagtatctatgggcaaaatggaaaaaggtagttggaagattattttttggtcgattattttgacttttattacttcatttgccactatggcactaggaaatttacttttccatactggttttgttgaaaactctaatgctgttcatacgggacctattcttgctcgtatacaacacttagttcttctttccatctctttgataggcgaagaattaatcacagcttcagttgcatttccgctatatcatttacttgctaaaaagatgtcttctaagcaagcctggatcatagctggattaattagtgccattttatttggtttaatgcacttgaaaatttatcatggaaacttatatcaatgtatcgtagtaattggtttaactcgtttaccatttaactacgcttggagaaaaacaaacagtttatggggtggaattatcggtcatattatctatgacttggtaatttttattcctgcgatgtttatcgtttaa

SEQ ID NO: 1629 - DNA, 1263 bp, Unknownn; identical to SEQ ID NO: 1100
  isolated from saliva, unidentified

SEQ ID NO: 1630 - DNA, 765 bp, Unknownn; identical to SEQ ID NO: 1107
  isolated from saliva, unidentified

SEQ ID NO: 1631 - DNA, 987 bp, Unknownn; identical to SEQ ID NO: 1091
  isolated from saliva, unidentified

SEQ ID NO: 1632 - DNA, 1248 bp, Unknownn; identical to SEQ ID NO: 997
  isolated from saliva, unidentified

SEQ ID NO: 1633 - DNA, 681 bp, Unknownn; identical to SEQ ID NO: 1247
  isolated from saliva, unidentified

SEQ ID NO: 1634 - DNA, 1854 bp, Unknownn; identical to SEQ ID NO: 1351
  isolated from saliva, unidentified

SEQ ID NO: 1635 - DNA, 1431 bp, Unknownn; identical to SEQ ID NO: 952
  isolated from saliva, unidentified

SEQ ID NO: 1636 - DNA, 1101 bp, Unknownn; identical to SEQ ID NO: 1036
  isolated from saliva, unidentified

SEQ ID NO: 1637 - DNA, 1332 bp, Unknownn; identical to SEQ ID NO: 1166
  isolated from saliva, unidentified

SEQ ID NO: 1638 - DNA, 2367 bp, Unknownn; identical to SEQ ID NO: 1209
  isolated from saliva, unidentified

SEQ ID NO: 1639 - DNA, 1146 bp, Unknownn; identical to SEQ ID NO: 1011
  isolated from saliva, unidentified

SEQ ID NO: 1640 - DNA, 957 bp, Unknownn
  isolated from saliva, unidentified
atgacagaagaaattaacttcaatgaagctactaaaagtttaatgaagaaagttgaggcaatttttcctgaaggtgtaggaattaatgtaaaaaaagattctaaattaggatatgttcgccatgaccaggctcaacaatacttacgtggtggacagttgatgattgatatatatgatatgacacgtcctgactatactgtagcccatgaattacttcactttttacacatgtttaatggagcaccacaaatttcatttaatttaacaactaaaaagaaagacttagatactaagttcatggcaacaggattggaattgtacgatattgtaatgcatgactatgtctatcgtgaacaagcagaacttggaatgatgacagatgaaattaaagaattatattttaaaggtgttctttcagttttaaaaccagaacaaggagaacgcgatcagtggatggttttaagaattttgactttacttgataccttattattctttaaagatgagcaagactctgttaaggataaattaatggaactttatccaatttcatttgaagctgcgcaaagactatacgaaattttgattgaaagaagtttggattctgcttttgcaattcgaagaacagttgttaagttatttaaagcttttgatgatgaattgagtaagttgggaatggtactgatgaatatgacagaattcgctactttatcagttgttttaagtgaaagacaaatgagattgcaagttcgccaattatttaatattgttcattctccattggatgataatttaacatttaagtcagcatatgttggacaatggaaaaatgatgggcaaaactcgtttgttttagctgatccaggcaaagattccgctaagaaatttgttgaatattataatatgaaagtaacagacttcttagattcaattgggattgaatatttaaagcgttaa

SEQ ID NO: 1641 - DNA, 1308 bp, Unknownn; identical to SEQ ID NO: 1218
  isolated from saliva, unidentified

SEQ ID NO: 1642 - DNA, 690 bp, Unknownn
  isolated from saliva, unidentified
atgttaaataagagaaaaaagaaagcgacaatggaagaaaaaatgaatgtattgagagcaggagtattaggttctaatgatggtattttaaccgtagttggagttctttttagtgtaggtgctgctacttccaatagatttactattttgattgcaggtttagctgacttggtagcatgtgctttgtctatgtcagctggtgaatatgcatctgtaagtgttcaaagagataccgaaaaatcagctgttgaagaagaggctacaaatcttaaaaataactactcagaacaaattaatattgttaaacaatattatcaaaataaaggagtatctttgcaaacagcaaatttgattgccaagcaattaatggagaaggaagacagagttgctactttagttaatattaaacatggaattaatatgggacagtatttgaatccgtggatggcagcttggtcatcgatgttttctgcagcattgggtggtttatttcctttagtagcaatgacttatgctcctagcaatagtagatggttggctacaattttagcagtaataatttctgttgggttgacaggaatgattagtgctaaactaggaaagagtaatattaaatatgcagtgttaagaaatatagttgttggaattataacaatggcaattcactattatgttggacaattaatttaa

SEQ ID NO: 1643 - DNA, 1467 bp, Unknownn; identical to SEQ ID NO: 1032
  isolated from saliva, unidentified

SEQ ID NO: 1644 - DNA, 1128 bp, Unknownn
  isolated from saliva, unidentified
gtgaaagacaagagtcaaattcgtgtcgttgtgggaatgagtggtggagttgattcttcagtttctgcttacttattgaaacagcaaggatatgacgttgttggtgtatttatgaagaactgggatgataagaatgatagtggtgtctgtacagtaacagaagactatcaagacgtagctaaggttgctagtcaaattggtattccttattactcagttaactttgaaaaggaatattgggatagagtattcacgtatttccttgatgaatataaaaatggacgtactccaaatcctgatattatgtgtaacaaggaagttaagtttaaagctttcttagattacgcaatgtctattgatgcagattatattgcaatgggacactatgcacaattgcgtcgtgatgaagatggcagagtgcatttactacgtggagcagatgataacaaggatcaaacttatttcttgagtcagctttcacaagaacaattacaaaaagtaatgttcccaattggacacttacaaaaatcagaagtgagaagaattgctgaagaagcaggtttagcaactgctaaaaagaaagattcaactggaatttgctttatcggtgaacgtaactttagtaaattcttaggtgagttcttacctgctcaaccaggtgaaatggtaactcttgacggtgaagtaaagggaaatcattttggcttgatgaactatactattggtcaacgtaaaggcttaggtattggtggcgatggcaagagtaatgaaccatggtttgttatcggtaaagatttgaagacaaatactttattagtaggacaaggctaccacaatgaacatttatatgctaatagtttagatgcttcaaagttaagttttgttgacgatatttctgatcgcggtgatgaattccattgtacagctaagttccgttatcgccaaaaggatacaggagttacagttaaatttaatgaagatcgtacaaaggttgaagttatttttgacgaacctgtacgtgctattactcctggacaagaagttgtattttatgatggcgaagaatgtctaggtagtggaactattgaccacgcatataaggaaagtaaattattacaatacgtataa

SEQ ID NO: 1645 - DNA, 1152 bp, Unknownn; identical to SEQ ID NO: 1067
  isolated from saliva, unidentified

SEQ ID NO: 1646 - DNA, 1923 bp, Clostridium sp; identical to SEQ ID NO: 1030
  isolated from saliva, Clostridium sp

SEQ ID NO: 1647 - DNA, 1143 bp, Unknownn; identical to SEQ ID NO: 1048
  isolated from saliva, unidentified

SEQ ID NO: 1648 - DNA, 3426 bp, Unknownn; identical to SEQ ID NO: 1409
  isolated from saliva, unidentified

SEQ ID NO: 1649 - DNA, 1566 bp, Unknownn; identical to SEQ ID NO: 876
  isolated from saliva, unidentified

SEQ ID NO: 1650 - DNA, 966 bp, Unknownn; identical to SEQ ID NO: 584
  isolated from saliva, unidentified

SEQ ID NO: 1651 - DNA, 471 bp, Unknownn
  isolated from saliva, unidentified
atggcagaaaaaacatttcctatgactttagaaggtaaagaaaaattagaacaagaattagaagaattacgtactactaaacgtgcagaaattattgaacgtattaagattgctcgttcattcggtgacttgtctgaaaactcagaatatgaatctgcaaaagatgaacaagcatttatggaagctagaattaaagaaattcaaaatatgctaaaccatgcagaaattattgacaataagtcaattgatgaaaatgaagttgcagtaggtaagacagttacattccaagaagatgatgatgaaccagaaacatatcaaatcgtaggtgctgcagaagcagatccatttgaaggcaaaatctcaaatgaatctccaattgcaagtggcttaattggacataagttaggcgatatagtatccatcgacacaccaggtggaactatgcaagtaaaaattattgatgttaagtaa

SEQ ID NO: 1652 - DNA, 459 bp, Unknownn
  isolated from saliva, unidentified
aatttaaaatgtgaggtgttcaaaatgaaagaaacaaaagaagaattgagacaaagaattggcgaagaagcttaccaagttacacaaaatgcagcaactgaacgtgcttttacaggtaagtatgatgaattttttgaagatggaatttatgtagatgttgttagtggagaaccgctattttcttctaaagataagtataattcaggctgtggctggcctgcttttactcaaccaattaataatcgcatggtaacaaatcatgaagataattcattcgggatgcatcgcgtagaagttagaagtcgtcaggcacaatctcatcttggacatgtttttaatgatggtccacaagatcgaggtggcttacgatactgcataaattcagccgctttacaatttattccagttgctgaattagatgaaaagggatacggagagtataagaaattatttgaatag

SEQ ID NO: 1653 - DNA, 960 bp, Unknownn; identical to SEQ ID NO: 647
  isolated from saliva, unidentified

SEQ ID NO: 1654 - DNA, 1722 bp, Unknownn; identical to SEQ ID NO: 633
  isolated from saliva, unidentified

SEQ ID NO: 1655 - DNA, 1155 bp, Unknownn; identical to SEQ ID NO: 1389
  isolated from saliva, unidentified

SEQ ID NO: 1656 - DNA, 924 bp, Unknownn; identical to SEQ ID NO: 344
  isolated from saliva, unidentified

SEQ ID NO: 1657 - DNA, 894 bp, Unknownn
  isolated from saliva, unidentified
gtgaagttaaactatgttttcctttttctatctgatcctttagactcaagaattccagatgttgaatatgaaaaggaatataaaacagcaagcaagtatttttccgtaggtttgataaatcaggaacgattatttgaagataatgtagtaactacaacgtataaaattagtaatgacgacattattatttatcgtggttggatgctgaaacctcaattgtatgatagattagttacttatgttgagaagaatagtggacagatgtttactaatttgtcagagtatgaatatacacatctaattccaaattgggttaaggacaatagcaatcacgtaaaaactaaatggacaatagatttgtcagataaaagcataataaaacttctcgaggaatttaatggagctgttactataaaagattttgtaaagagcagaaaatatgaatgggatgatgctttttatattcctgatgtttctgatactaagaatgcactgcgagttatccataactttattaatagacagggtagtgagctaattggaggattagtaattcgtgattttattgagttaaaaaatataggcagacatcctaaaagtcatacgccaatttttgaagaataccgagtgttttatataggtaatgagccacttgtagttattaattattggaatgatagaaaaattaatctttctacagaagataaaaaagtcattatgaatgctcctaaagaggttaaagcaaaattttatacaattgattttgcaaggaagtctaatgggaagttggttatcatggaaatgggggatggacaagtttcaggacttcaaggatttgatgaacaaaaattttatgatttattatgggaaaatttacctgagagtagagcttaa

SEQ ID NO: 1658 - DNA, 1824 bp, Unknownn; identical to SEQ ID NO: 823
  isolated from saliva, unidentified

SEQ ID NO: 1659 - DNA, 1182 bp, Unknownn; identical to SEQ ID NO: 1476
  isolated from saliva, unidentified

SEQ ID NO: 1660 - DNA, 678 bp, Oribacterium sinus
  isolated from saliva, Oribacterium sinus
ttgaatacaagaaaaaatagctcagattttcctgtgcgtcgttggtatggcgatgcttttgggattagtggagcagtcttcttattaacattattactagtaatatttaatgtaaaggtatttgttaattttgaagataatattactgctactttccaatctatgtttggtttaccaaaaatggattatagtggtggattattaaacgatatcatgacatttgtggcatcgtattttgatactaagccaattattgcaatcacaattgtagtgggaattgtattgattttaagacgtcaaatcaaaataggtatttggttgatgtatgttgtagcaagtggtggcattataggattagtattaaaagctttgatcaagcgtccacgtccacttcatcatcttccaattgacaatggctactcatttccaagtggacattctctagcaagtactttattgatttgggcaatcatcttcgttgttcttcccttaatcaagaaggaaaatgttcgtagaattgttggttggttgttagtcttattgtgggtattaatcttattctctagactatactttgcagctcatcactttggcgatgtcctaggtggcgtaagtttctcacttgcttggttatggttgaatatggcattatatcccaagatttttatgagaaattag

SEQ ID NO: 1661 - DNA, 1845 bp, Unknownn; identical to SEQ ID NO: 1073
  isolated from saliva, unidentified

SEQ ID NO: 1662 - DNA, 1227 bp, Unknownn; identical to SEQ ID NO: 1002
  isolated from saliva, unidentified

SEQ ID NO: 1663 - DNA, 897 bp, Unknownn
  isolated from saliva, unidentified
atgagtttagtaacatcagcaataggtcaaggcttattatggggaatattagcgttaggtttattcttaacatttagaattttaaatttccctgatatgacagttgaagggacattcccatttggtgcagctgtatgtgtatcagccttggttcatggagttaatccaattgtcgcaactgcattatcttttggcgcaggattattaacaggattaatgacaggtttactttatacaaaaggtagaattcctattttactagcaggtattttagtaatgacaggtatttactctattaacttacgcatacttggaagagccaatgttggtttgatgcatcaaaagacattattctcaccagaatttttaaagaatttaccagatggttttgacagtgtctgtgtgggaattatttttacaatagttatcgtaattttattggcagtttttctaaatactgatattggacaagcatttatcgctactggtgataatgaaaaaatggcacgttcattaggaatccatactgacaatacaaaaatattagggctcatgatttctaacggtttaattggtttagcaggtggattgatttcacaaaataacggttatgctgacgtaaacatgggtgtgggaacaatcgttattggtttagctgctattattattggtgaagtagcatatggggaattgagtttgactgcacgtttggtggccgtagtagtcggaagtattttatatcgtttcgtgctattaattgtcttgaaactaggcttcagcactaacgactacaaattactttcagcaataattttggcattctgcttgatgctaccactattacaaaagaaatttcacgttaataaaattttgaagaaaggggttgaacgtccatga

SEQ ID NO: 1664 - DNA, 1830 bp, Unknownn; identical to SEQ ID NO: 1157
  isolated from saliva, unidentified

SEQ ID NO: 1665 - DNA, 4590 bp, Unknownn; identical to SEQ ID NO: 888
  isolated from saliva, unidentified

SEQ ID NO: 1666 - DNA, 609 bp, Unknownn; identical to SEQ ID NO: 996
  isolated from saliva, unidentified

SEQ ID NO: 1667 - DNA, 1131 bp, Unknownn
  isolated from saliva, unidentified
gtgggaactactttaggtataggtggaattcagagagtaatttcactttttgcaaatgaattagctaaaaggcatgaggttacaatttcttctttcgatacgcctgaaaaaatatctaattcaagttacaaattagataaaaatataaattttgttgaatttccaaaaagcaaaattgcgtctaatattctttatagaattatgaggaaaatactatttaaagttgtaaggaacgacaaatttttagagaggatagattttcctaaatttatgcgaaaaagactggtaactttttttaatcaaggtgaatatgatgtcgtaataggtgttgcttggcttcacagtctttggctagcaatggttgctccagaaataaaagctagaacgataggttggcaacacaattcatatgatgcttatttttgtacacctgggcgatatgcctggaagaaagataatctttttagaaagtatctttcaaaccttgatgaatatgttgttttgaatgaaataactaaagaaaagatagatgctaactttggaattgattcaactgtcatttacaatcctaagagttacatttctaaagaaaaatcagacatgagaaataaagtctttctagcagctggccggatggtttatgccaagggagttgatactctggtcgaagctttcaaaatttttgctcaaaaaaattcagattggaagttattgctagtcggtgatggagaggaacttccaacaataaaagataaaattaaagaatatgggctagagaaaagaatccttactcctggaaaaactagtgatataaagaagtacttcttgcaatcttcggtattacttttaccgtcaaggtgggaaggaatgccaatgatagtgcttgaatcacttgaaatgggatgtccaattgttgcatttgatattgatgcaatgagactcctagttactaatgggattgaaggattgattgttaaagaaaaacaagatgccaatgcttatgctcaagcaatgttaaaaatagctgaaagtgaagatttacgaaagcaaatgcatcaagcagcacttcagaaagcaaatcaattttctgtaggtaagataatgagtgaatgggaaaagatacttaagtaa

SEQ ID NO: 1668 - DNA, 600 bp, Unknownn
  isolated from saliva, unidentified
atggataaaaaattaacaggatttactaatattcaaaagttagatccagatattattgttgatctaaaatatgcaacagaggataactttactgggaaagtaatttatgattttactactgctatagccagaactggaaccgcatacaaattagctaaagcaagtgaaattgtaaagaaacaaggatataggttaaaagtatgggatgcctaccgtcccgtaaaatctcagaaaagattatttgaagtttaccctgatcctaaattcgttgctgaacctaatccaaatttcagccatcaaaaaggtgttacatttgacttaactttaactgataagttaggaaatgaagtagagatgcaaactggatttgatgatttctctgaaatggctgctagaaaagcaccaagaacccctgaacaagagaaaaattataagatcctaaatgacgcgatgcttgaagcaggctttgtgggatatgaaaatgaatggtgggattaccgcgatagtcaaatggatgaatatgagcctttagatgctgatcctaataaatataaattaaaaaagttgcacaaaacacttgcactaaaagtaagtaagtag

SEQ ID NO: 1669 - DNA, 798 bp, Unknownn; identical to SEQ ID NO: 711
  isolated from saliva, unidentified

SEQ ID NO: 1670 - DNA, 1635 bp, Unknownn; identical to SEQ ID NO: 26
  isolated from saliva, unidentified

SEQ ID NO: 1671 - DNA, 1935 bp, Unknownn; identical to SEQ ID NO: 858
  isolated from saliva, unidentified

SEQ ID NO: 1672 - DNA, 2646 bp, Unknownn; identical to SEQ ID NO: 1124
  isolated from saliva, unidentified

SEQ ID NO: 1673 - DNA, 780 bp, Unknownn; identical to SEQ ID NO: 95
  isolated from saliva, unidentified

SEQ ID NO: 1674 - DNA, 1056 bp, Unknownn; identical to SEQ ID NO: 1221
  isolated from saliva, unidentified

SEQ ID NO: 1675 - DNA, 924 bp, Unknownn; identical to SEQ ID NO: 1267
  isolated from saliva, unidentified

SEQ ID NO: 1676 - DNA, 1164 bp, Unknownn
  isolated from saliva, unidentified
ttgtcaagaagttttaatagagaagttgagaaaattgctgtatcagatatccgccaatttgattcagatgtaagtggaattccgggaattattaagttaacattaggagaaccagattttaatacgcctgaacatgtaaaaaaagctgcaattaaggcaattgaggataataaatctcactatactcctaatgctggttttatggaatcaagagaagaaacagctaagtatgtgaataaaaaatataatttgaattacagtgggacacaagttgttattacagttggcgcaactgaagctattaatgcaagtttacaagctattttaaatccagatgatactgtgttagtaccaacacctatttttccactatatttaccaattagtaatttaaatcatggtaattatattttaatggatacaagtgaagataattttgtcttgactgccgataaattacgcaaggttattgcagataataaggataaaaatattaaatgccttgttttgaactatccttctaatccaacaggtgttacatacaatagaaaacaattagaagaattagcagaagtgattaaagaaaatgatatttgggtattaagcgatgaaatttatgctgaattaacatatacgggcaaacacgtttctttagctgaattaatccctgataatgtaattttaattagtggattatccaaatctcatgcgatgacaggctggagaattggctttatcttagggcctcaagactttattgatcaagtagtaaaatctcatcaatacatggtaactgcacctactactaatgcacaatatgcagcattagaagctgttacaaatggctttgatgatgcagtgcctatgaaagaagaatatttgaagcgtagagatttcattatagaagaattacaaaaagtgggctttgaaattgcaagtcctgatggtgcattctatatctttgctaaaattccagctaattgtcctcaaaactcatgggactttgttagagatttggctaaagaagctaaagtagcacttattccaggtgtatcttttggaccaggtggagaaggatatgtaagaatgagctatgctgcaagtatggaaaacttagtagaagccgttaaaagaataaaagattacgttcaagctagaaagtaa

SEQ ID NO: 1677 - DNA, 1578 bp, Unknownn; identical to SEQ ID NO: 1343
  isolated from saliva, unidentified

SEQ ID NO: 1678 - DNA, 1716 bp, Unknownn; identical to SEQ ID NO: 121
  isolated from saliva, unidentified

SEQ ID NO: 1679 - DNA, 1599 bp, Oribacterium sinus; identical to SEQ ID NO: 1485
  isolated from saliva, Oribacterium sinus

SEQ ID NO: 1680 - DNA, 702 bp, Unknownn; identical to SEQ ID NO: 545
  isolated from saliva, unidentified

SEQ ID NO: 1681 - DNA, 1371 bp, Unknownn; identical to SEQ ID NO: 209
  isolated from saliva, unidentified

SEQ ID NO: 1682 - DNA, 2196 bp, Unknownn; identical to SEQ ID NO: 1171
  isolated from saliva, unidentified

SEQ ID NO: 1683 - DNA, 1203 bp, Unknownn; identical to SEQ ID NO: 895
  isolated from saliva, unidentified

SEQ ID NO: 1684 - DNA, 1728 bp, Unknownn; identical to SEQ ID NO: 1190
  isolated from saliva, unidentified

SEQ ID NO: 1685 - DNA, 807 bp, Unknownn
  isolated from saliva, unidentified
atgataaagcatatatttacagatatggataaaaccttgttgaatgataaggggcaaattaatcctaaaacagcagaatatctacaaaagatagatttgccattaactttagtaactgcacgtgctcctaaagaaatgcagtttgcgattgatgatttaaatttaaaaggtgaacaaattgcttttaatggtggattgatattcttcccacataaagatggaaatgaagtaatttcttctaatccattacaagcagaagctgccaagcgagtaattgaagaaattcaagacaaatatgatggtgtatcagtaagttggtataccaaggacgagtggtatgctcaacaagaagatgatggtacaaggtatgaaacaagtattactaatattaagccaactttgaagaagtacagtgaaatcgactataccgaacctatttataaaattatgattgttggaacaaatatggaaaacttcgataaagttgtagatataattagaggaatgaaattagatggcgttagcgcaaatcattctaactataattactttgaaattactaatgaagttgcggttaagagttttggaattgagtacattagacaaagagataacttaaagaaagaagaattattagcatttggcgatggagaaaatgacattaagatgttcgaaacagttggtacttcagtagcgatggggaatgctaacgataaagttaaatcaattgcgacatataccactctatcaaatgaagaagatggaattgttcatggtttagaaaatgtcgttaatcatttactataa

SEQ ID NO: 1686 - DNA, 1092 bp, Unknownn; identical to SEQ ID NO: 767
  isolated from saliva, unidentified

SEQ ID NO: 1687 - DNA, 882 bp, Unknownn; identical to SEQ ID NO: 1307
  isolated from saliva, unidentified

SEQ ID NO: 1688 - DNA, 924 bp, Unknownn; identical to SEQ ID NO: 1005
  isolated from saliva, unidentified

SEQ ID NO: 1689 - DNA, 1251 bp, Unknownn; identical to SEQ ID NO: 817
  isolated from saliva, unidentified

SEQ ID NO: 1690 - DNA, 1761 bp, Unknownn; identical to SEQ ID NO: 1040
  isolated from saliva, unidentified

SEQ ID NO: 1691 - DNA, 648 bp, Unknownn
  isolated from saliva, unidentified
atgacacctaagaaagaagattatttaaaaattatttttgaacttggtggaactaagaaaaaggtttctaacaagcaaatagcgatgagtttaaatgttgctgctggttctgtgactgaaatggttaataaattagttaaagaaggtttagctgcacatacgccatatgcaggaatttcattaactgatgaaggaattgaagtagctgaaaaattagttcgccgtcatcgtttatgggagacttttttagtagaaaaattggattatcaattatcagaagttcacgatgaagctgaaattttagaacatgtagctagcgataagttaatgaaaaagcttgatcaatttcttaatagcccacgtgaatgcccacatggtggagttattccaacagaagctggggaatatgaagaagaaagtcatgaatatttggctgaaattaaagttggagaaacggttgaagttgacagatttattgataaccatgagttgctaacttatttagatgatttggaacttaaactgggggacaagattgaagttttagaacatcttccatttgaaggaccaattaaggttaaaaggttggctgatggggctgaattaagcattggatataaagctgctcattacattttcgtgaaataa

SEQ ID NO: 1692 - DNA, 2280 bp, Unknownn; identical to SEQ ID NO: 660
  isolated from saliva, unidentified

SEQ ID NO: 1693 - DNA, 651 bp, Unknownn
  isolated from saliva, unidentified
atgccaaaagaaacattttttggaattgataaagaaaagcagaatcgcataattcaagcggcaattaaggtattctcgagtcataactataacgattcttcaattaatgaagttataaaattagccaaaatccctcggggaagtttttatcaatattttgaagataaaagagatctatatctctatattactcaaaaaattatgcaaaactttagagatgacttttttaaagaattagatgaacaaaatggagatatttttgcgactgtaaaaatagtctttccaaaacagattcatgaagtactaggaggagaatattctaatttttattactatctattacaagcaagttttatgaaggattttagacaaaaggaagttaaatccaaggataatagtaagcatggttggaatgtgaaacaagattttgatgttatatataaaatgatagataaagaaaaattaaaaataaaaagtcgaagtgactttgatatgtttatcagaattttaattaccccatttatcatagtaataaccgatacattcttgcaaatgaagcatgaatcagacattcctaaaatagatattgaagaaaaaaagcaagaatatttacacaaattagaatttattgagtatggtttttctaaataa

SEQ ID NO: 1694 - DNA, 1098 bp, Unknownn; identical to SEQ ID NO: 1269
  isolated from saliva, unidentified

SEQ ID NO: 1695 - DNA, 1179 bp, Unknownn; identical to SEQ ID NO: 1282
  isolated from saliva, unidentified

SEQ ID NO: 1696 - DNA, 1221 bp, Rothia dentocariosa; identical to SEQ ID NO: 1422
  isolated from saliva, Rothia dentocariosa

SEQ ID NO: 1697 - DNA, 999 bp, Unknownn; identical to SEQ ID NO: 730
  isolated from saliva, unidentified

SEQ ID NO: 1698 - DNA, 1695 bp, Unknownn; identical to SEQ ID NO: 688
  isolated from saliva, unidentified

SEQ ID NO: 1699 - DNA, 642 bp, Oribacterium sp.; identical to SEQ ID NO: 1255
  isolated from saliva, Oribacterium sp.

SEQ ID NO: 1700 - DNA, 483 bp, Streptococcus suis
  isolated from saliva, Streptococcus suis
atgaaagttatttttccaggaagttttgatcctattacaaatggtcatatggatttaattagtcgtgcaagtaagttatttgatcaagttgtagtagttatttccaataatactagtaaacactcattatttactcctgaagaaaaatatcatcttgtcactgaagcattatcaaaatttagtaatgtatcagttgagcttattcaaactgatttaactatcaatgtagtaaaaaaatttaatgcggatgcgattattcgtggaattagaaatacaagagatttcacatatgaacaagaaatagctttaatgaataaaaagttagatagtgatattgaaacaattactttattttcaaatccggaagtaagttttatttcttcaaccttagttagagaaatttcacagtttaatttagacaaattggttggaacggtgccagataatgttattgaggcattaagaaagaaggttaagaattga

SEQ ID NO: 1701 - DNA, 909 bp, Unknownn
  isolated from saliva, unidentified
acgttaaaaatattgaaagtaatgatgaatttgaaagaaaaattgcataaatttcgtgatttatttctcttaattgttgaacgtgcgagtgaagcggatataaatagtacatctataacaatcgcttactatgcattactagctatcttacctacaatcattttgttagggaatattctttcgataattaatttaaaagaagcagatattttaaatggattgcaagtaatagttccaagtaatgtttttacgactttaaaaccaattattgaaaccatgctaaagaaaggttcaggtggaatagcctctgttagtggtattttagcactttgggcggttagtcgaggaatcaatgctttaaaaaatggtttaaatatggcatatggagtaggtaaggggactggaacaggtgcagtattaggaagaatattctctatttttattacagtagttttgggcttgctaatagttgcgctatttttagtattcagttttggacagatagccttggattatattacacctttgttgaatctttctactaattggatagatttattcatgcgttggaaatggccaacagctgcaattggtatttttgtaattataatactgatttacacactaatccccaacgctaaattacattttattttagtattaccgggagctattttggcaacaataggttggctggggttatcgcaaggcttttctatttatgttagatactttacgcggactttgttaagttatgaagccctaggtacatttatagttctgttattatggttaaattataccggttgggtaataatgctaggttcggtagtaaatgcaggtttagaatattatttctttggcgaagtaaagactaagagtagtacaataagaaaaatttttcagtaa

SEQ ID NO: 1702 - DNA, 717 bp, Unknownn
  isolated from saliva, unidentified
gtgataaaattggacagtacattaagagaatttctacgtcaaggaaatatagtaatttcaaacctggtattgaaaaattataagaaattaggaatgactgatacggaattcattttgtacttgcaactcaatagttatcttcaaaaaggagaaacatttcctgaactagaaaatatagctaaaagtttgcaaatatctgttaatgatgtatatacacaattacacaatttaatagagaaaaaaatattgaagattgaaacaattgtaaatcaacaaggacaaaaaactgacagttatagttttgatttcttatatcaaaaactagattcattgatagatgaagaaaaaaaagaactattaaatgtatcggtagaaaatgacagacaaaaaatatttaatgcttttcaagtagaatttggtagggatttatctccaatagaattagaaacgataaatgattggatagaagaagataaatataaaacagacctgatattacttgctttaagggaagctgttttaagtcaggcgtataatttgaaatatatcgacaggattttactcagttgggaaaaacaagggattagatctaagatagatgtagaaaatctaaagaaagctagagaaaaacggaaagaaaacatcaatacaatgagtaacaataatagaaataaagagaacaaacctaaaataccattgacaaagtggttagattaa

SEQ ID NO: 1703 - DNA, 1134 bp, Unknownn; identical to SEQ ID NO: 962
  isolated from saliva, unidentified

SEQ ID NO: 1704 - DNA, 993 bp, Unknownn
  isolated from saliva, unidentified
atgaaaagtcttacatctcgtgcatttttaccaataaacactgatttattcaacaatcctaagtatcaagaattaagttgcgatgctatggttttatattcactatattctcaaagaaaagaagtatctgcttttcattctcaaaccggtaatgacacttttacagattcagaaggtatttttatctatttttctaatgacgaagcttcaaaaatccttcgtatgtctgtaagaaaaatctctactttacgctctcaacttattgactgtggcctaataagtgttgttcgtcatggtcttaagaattttaagatctatgtaaatacaccagaaacaactccggctgaaacagatcttgttttgccttgggccaattttgactttgaaaagcctattaaatccgttcctgcaaattctgctagtacgaagtcgcaaaaattgcctataaatcaatctaacaataatcaaaccaaattattattatcaaaagaatcaaatgaatcagtaccacaaaatcagagtaatactccggttacacctaaaaaatccgaaaaagatggtttaaatgatctatctttagattcaattattacaagacttaaagatacatttagtcttcctgtagtttctagattgaaagtattagcaaacaattcatatacaaaattaaaatggtttagtgacactatttttaaagctaaaagtcaagtaactaaaaaattattatctaatgctaaatggctatataatcctgctagtcaagaagcaactcattttgaatccaacgagttgttaaaacgaggattggaatctgctttacttcagattgctgaaatagtctataagggtaaagaaaaagtacaaaatgaagccaagtttatttatgtttacttacgtaattttatggcaaatgcagtaaaacaatatttgatagacaattatgaattaactgaggatgatgaaatagatttgaatttattattaagattctaa

SEQ ID NO: 1705 - DNA, 3747 bp, Unknownn; identical to SEQ ID NO: 1365
  isolated from saliva, unidentified

SEQ ID NO: 1706 - DNA, 1563 bp, Unknownn; identical to SEQ ID NO: 407
  isolated from saliva, unidentified

SEQ ID NO: 1707 - DNA, 1629 bp, Unknownn; identical to SEQ ID NO: 802
  isolated from saliva, unidentified

SEQ ID NO: 1708 - DNA, 1233 bp, Unknownn; identical to SEQ ID NO: 367
  isolated from saliva, unidentified

SEQ ID NO: 1709 - DNA, 1431 bp, Unknownn; identical to SEQ ID NO: 721
  isolated from saliva, unidentified

SEQ ID NO: 1710 - DNA, 1863 bp, Unknownn
  isolated from saliva, unidentified
atgtatgagatgaatacatcaaataaaagaaaagaagtgaattttatgtctgaaaagaaagcaaaaagattacttcagagaaatgaagttccagaagaattaacgtgggatttaacaaaagtatttaaaagtgatgaagagtttgaaaaggagtaccaagctgtaaaagatgaagtacagaacttcagaaaattacaaggtacaatggatcaaggtagtcaaagatttttacaaatcattgaaaatttcttaagtattaataggaaatttgaaaaagtttatgtatatgcaagtatgaaaaatgatcaagatactacaaacgctaagtatcaaggatataatgaaatggttgatgcattagctgctgaattttcagaatctatatcctggttcgaacctgagttactagaattagatgaagataaattaaagcaatattttgtagaaaaaaaagaattaaaacagtatgaacatttaattgagagtatgttggtcatgagaaagcatacgcttgataaaaaaagtgagtctttattagctggagctagtgatatctttgggacatcgcaaaatgtttttggcattttaaacaacgcagatctaaagtttccaatagtaaaagatgataatggtgatgatattcaattatcgcatggtgtttatggaaaattaatagaatctacaaataggaaagttagaaaagctgcattcaagggattatacagtgtttatgaccaatttaagcatacaatggcgacaacattaattggaaatgttaaggtgcataactttaaagcaagagttcgtaattataaagatgctagagaagctgccacaacatctaatcatattccaacagaagtctatgatgtattactggaacaagtacacaaaaatcttccattattacatcgctatgtaaagcttagaaagaaaatattaggtgtcgatgaactccatatgtatgatatgtatacaccgttaactgaagatagtaagcttacttataattatattcaagcgcaaattgaagcaaaaaaggcacttgaagtattgggaatggattatttaacgcacgttagtgaagcatttgaaaatcgttggatagatgtagttgaaaataaaggaaagagaagtggagcatattcatcaggagtttatgatactccgccatatatcttattaaattggcaagataatttagaaaatctttttaccttggtacatgagatgggacatagtatgcatagttattacactagtcataatcaaccctatcagtatggagattacccaatatttttggcagaaatagcttcaactactaatgaaaatattttgacggattatctattaaagaataacgatgaaaaagagatattaatctatattttaaatcattatttagatggatttaaaggtacggtatatcgtcaaacacaatttgcagaatttgaaaaatggattcatgaacagaattcaaaaggagtaccactaactgctaaatcaatttctgaatattacttagaattaaataagaaatattatggcaatgatgtagtaagcgatcctgagatagctttagagtgggctagaattccgcatttttattataatttctatgtttatcaatatgcgacaggatttgcagcagcaactactttagctgaaaatattttatctggcgatgaaaataaattaaacaaatatttaacttacttaaaagctggtagtagtaaatatccattggaagtcatgaaagatgcaggtgtggatatgacagattcttcatatttggagaaagcatttaaagtttttgaagaaagattaaatcaattagagacattattgtcagaaaaataa

SEQ ID NO: 1711 - DNA, 954 bp, Unknownn; identical to SEQ ID NO: 985
  isolated from saliva, unidentified

SEQ ID NO: 1712 - DNA, 2979 bp, Unknownn; identical to SEQ ID NO: 459
  isolated from saliva, unidentified

SEQ ID NO: 1713 - DNA, 987 bp, Streptococcus sp.
  isolated from saliva, Streptococcus sp.
atgacaaataaacctactaattgcttgttaggtggtgctttaggagattcattgggttacccagtggaattttctagctatcgagaaattcaacaaaataatcccagtggcatcacttttattaatttttctgaaccagttttaatttcagatgacacacaaatgtctctatttacagcttctgccttattaatatcggataattatttgactaatctttgggattgttatcaagactggttagaaactcagtggaaaactgacaaacaaagtatgtcccataagcctgttagtaaattggtagattttcaggaactatttaattctcgtgaaccaggcaggacttgcttaatgacactagcgcaacaaaaaccaggaagcttacaacatccaattaataatagcaaaggatgtggtggtattatgcgtgtagctccaattggacttattgatgaagatgaaaatataattgctcaacttggagctgaaagctctgctttgactcatggtcatccactaagtagtctttcttctgcttatttagcagtacttatccatcgtttactcacatctaatatttctcctcaacttgtattagatactcttaattttataaaatcaaaattcagtactatggattatttatccgattttacagaaataattaaattagcaacaaatttaagtcaaacaacagataacgatttcataaattttcaacgcttaggaaagggatgggttgctgaagaaacactagctattgccctctattgttctttgaaatatcaaaaagatccatgccgtgctatcgaaatttctgttaatcatgatggagattctgattcaaccggttcaataaccggacaaattgtgggtgttcaacaaagtaactcactctggcttcctgcttcttatctaaataaattggaattacgagatgtaattatatctcttggtaaaaaattaagtcaaaaattcaatacataa

SEQ ID NO: 1714 - DNA, 1272 bp, Unknownn; identical to SEQ ID NO: 657
  isolated from saliva, unidentified

SEQ ID NO: 1715 - DNA, 918 bp, Unknownn; identical to SEQ ID NO: 1205
  isolated from saliva, unidentified

SEQ ID NO: 1716 - DNA, 2400 bp, Unknownn; identical to SEQ ID NO: 951
  isolated from saliva, unidentified

SEQ ID NO: 1717 - DNA, 1182 bp, Unknownn; identical to SEQ ID NO: 667
  isolated from saliva, unidentified

SEQ ID NO: 1718 - DNA, 1053 bp, Unknownn; identical to SEQ ID NO: 1083
  isolated from saliva, unidentified

SEQ ID NO: 1719 - DNA, 867 bp, Unknownn; identical to SEQ ID NO: 1226
  isolated from saliva, unidentified

SEQ ID NO: 1720 - DNA, 996 bp, Oribacterium sp.
  isolated from saliva, Oribacterium sp.
atgttttcttcggcaactaaggttaaaggacaaggtgttggaagtgcatatacagagttaataaatttattaaaaaaatattattcacaagaacttaatatagagattaataaatttaaccgtgtaaatattagccattatcacactattgatccgcaattttatttatctacttttcttccgggaagaggctgcaaaattggatatgtacattttttgccggaaacgatagatggaagtttaaaattgccttggttggcgaaaaaagttttttttaagtatataatttctttttataaaagaatggatcagctagtagttgttaatccatcatttattgagaaattgacggcttatggaataaagagagaaaagataacttatatacctaattttgtatccagtgatactttttataaaatttcagattcaaaagagaatttgagaaagaaattgaatttagataataaatttacaatagttggtgtaggacaagtacaagaacgtaagggagtacctgactttgtaaaactagctaaactaaatcctgaaatacagtttgtttgggtaggtggattttcttttggagctattactgatggatatgacgaactaaaaaaagttataaagaatcctcctgcaaatttaaaatttccaggaatagttgatagggataaaatgaatgagtactataacgttgctgatttattcttacttccttcatacaatgaattgtttccaatgagtgtattagaagcatttagttcaggtcttccagttatgttacgtgatttagatttatattattcaatcattgatggttactatgagccagctaaggatgtagatgatatgaataaaaaaattatcaatttatcacaagatagaaaaaaattagaaaagttagaagaaaagtctaaaaaagctgcagaatattattctgaaagaagactagcaaaaatttggctagcttattatcaaaaatttagtaggtaa

SEQ ID NO: 1721 - DNA, 2592 bp, Unknownn; identical to SEQ ID NO: 1063
  isolated from saliva, unidentified

SEQ ID NO: 1722 - DNA, 1146 bp, Unknownn; identical to SEQ ID NO: 932
  isolated from saliva, unidentified

SEQ ID NO: 1723 - DNA, 1488 bp, Oribacterium sp.; identical to SEQ ID NO: 1228
  isolated from saliva, Oribacterium sp.

SEQ ID NO: 1724 - DNA, 1299 bp, Unknownn; identical to SEQ ID NO: 1217
  isolated from saliva, unidentified

SEQ ID NO: 1725 - DNA, 1911 bp, Unknownn
  isolated from saliva, unidentified
atgacgattaaatcaagattttggatttcattgatattctcattaccaatgttttttgaaatgatattaaagccatttggctggatgctgccaggacatacctatacaatgtttattttaacaacaattgtaatggcaatttcagcaagaccattccttcatagtacatgggcggcttttaaaaatcatcatgctaatatggatacattggtagcaattggaacagctacagcttatgtgtatagtatttatgcgatgtttacaggccaagatgtgttttttgagagtgcagcttttgttataacattcatcctgttaggtcaagtttttgaagaaaagatgagaaacaatgctaatagttcagttgaaaaattattaaacttacaagttaaagaagctgaagtaatagtagatggtaaatctcaaatggtaccattagatgatataaaagtaggcgacgttattcgtgtgaaacctggtcaaaagatagctgtagatggagaaataatcgaaggaagttcgacagtagatgaatcaatgataacaggtgaaagtatgccagtaatgaaaaaagtgggcgataaagttattggttcaacattgaataatactggaacttttctttttaaagctaataaagttggcaaagatacaatgctggctcagattgttgagatggtcaaaaaagctcaaaatagccatgctccaattcaaaaaacagcggataagattgcaaatatctttgtaccggtagtgttaattattgctattcttacttacctggtatggtatgtatttttaggaaatagtaatgttacttcattgttatttgcggtatcagttgttattattgcatgtccatgtgccttgggaattgcaactccaacagctctaatggtaggaaccggacgtagtgcaaagatgggaattcttattaaagacggtgaagtactagaagcaactgataaaattgatacagtagtctttgataaaacaggtacaattactgaaggtaagcctaaagttacagatattatcggtaataaagatgaaatattacaaattgctgctagcttagaaaaaaattctgagcatccattagccactgcaattatggataaagcagtagaacaacagataaaattatttgaagtaaataattttacagcagttgaaggaaaaggaattacaggtataattgctgagcaacgagtagtagtgggtaacactaagcttattgaggattggaatatatctcaagaacttcaagcacaaatgaagaacttacaatctgatgcaaagacagttgtagttgtaggtaaaaacgatgaagtcataggtttaattgcaattcaagacattccaaaggcaacttcagctaaggcaattagtgatttgaaaaaacgtgggctaaaaacagttatgttaacgggtgataatcaacaagtagcagaagttattgccaatgaagtaggaattgatgaagtgatagcggatgttttaccacaagataaggcacatcatattgaaatgttgcaagatcaaggtagaaatgttgcttttgttggtgatggaattaatgatgcaccagctttaacaactgctaatgtcggaattgctatgggagcaggaacagatattgcaatcgaatctggtggcattgtcttagtgaaaaatgacctagaagacgtagtcaaagctttaatgatgagtgaaaagacttttaatcgcattaagttaaatctattctgggcatttatctataatggcttgggaattccagtggcagcagggatcttttctggcattggtttaactctaagtccggaattagcaggattagcaatggcatttagctctatatccgtaatgataagttctttgatgttgaataaggtaaaaattgcataa

SEQ ID NO: 1726 - DNA, 1347 bp, Unknownn; identical to SEQ ID NO: 1240
  isolated from saliva, unidentified

SEQ ID NO: 1727 - DNA, 861 bp, Unknownn
  isolated from saliva, unidentified
atgcaaaaattatcaagtttaacatcgccattagttctagcgaatggtgttgaaattccaggactaggctatggtacttaccaaactccacctgaagatacatacaaagtagtatcagaagcattatcaatcggttatcgccacattgacacagctgcattatatggcaatgaaagtggtgtaggtaaggctgttaaagatagtgggttgaagcgtgaagaagtatttattactagtaagttatggaatactgaacgtggatacgacaaagcaattgcttcctttaataagactttagaaaatcttgagacagattatttagatttattcctaattcattggccagctaatgaaaagcaatttggggatgaagctaataaaattaatttagatacatggcgtgcttttgaagacctctacaaagaaggtaaaatcagagcaattggtgtatctaatttcatgccaaatcatttggaatatttattagaaaatgcagaaattaagccaatggttaaccaaattgaagttcatcctggttggccacaaacagaagcaattcgttattgccaaagacatgatattttagttgaagcttgggctccattgggtgaagcagcagctttaagtaatgaagttttacaaagaattgctaaaaaatacgatcatacaactgcacaagtatgcttacgttggggaattcaacaaggaatattgccattaccaaaatctgttcataagaatagaattgaagaaaacacacatatttttgattttgaattaacagatgatgaaatggatgttattggttcacttcgtaatcttggtggacaatgcaaagttccagatcaagtggatttttaa

SEQ ID NO: 1728 - DNA, 1761 bp, Unknownn; identical to SEQ ID NO: 1167
  isolated from saliva, unidentified

SEQ ID NO: 1729 - DNA, 2073 bp, Unknownn; identical to SEQ ID NO: 970
  isolated from saliva, unidentified

SEQ ID NO: 1730 - DNA, 741 bp, Unknownn; identical to SEQ ID NO: 830
  isolated from saliva, unidentified

SEQ ID NO: 1731 - DNA, 435 bp, Oribacterium sinus
  isolated from saliva, Oribacterium sinus
atgaaagttaacattaatattgatgaaaatttagtagaagatagagcagaattttatctacaagaaatgactgataaaattacaagaattgccaaagagttaactaacgataatagcggattatggtgctataaaaatagagatattattcccgtgaaatatgaagaaattattctaattcaaagtgaaaataatatacttatggtctatacagatgaagatagctatgaataccatggcagattgtatcaggtaaaagatgagttaccaaatatgtttatagaagcttctagaagtgcaatttttaattatcaaaagattgatcatttggaaattctaggaagtggcatgattgacgtaatcttagaaaatcaaatgagagtaggaatttcaagaaggaaaattaagattttgaaagggaggttagggctatga

SEQ ID NO: 1732 - DNA, 1350 bp, Unknownn; identical to SEQ ID NO: 652
  isolated from saliva, unidentified

SEQ ID NO: 1733 - DNA, 1680 bp, Unknownn; identical to SEQ ID NO: 1392
  isolated from saliva, unidentified

SEQ ID NO: 1734 - DNA, 2268 bp, Unknownn; identical to SEQ ID NO: 693
  isolated from saliva, unidentified

SEQ ID NO: 1735 - DNA, 1011 bp, Unknownn
  isolated from saliva, unidentified
atggtaaagatgaaaaaaattgctgttgacactatgggtggagattttgcaccacaaagtgtagttgagggtgtagaaaaagcgagaaataaatatccggatctcagatttatgttatttggtgacgaacagaagataagagaaattctgacaagtgataaaaatattgaaattatccaaactactgaagttattgacatgaatgatgaaccagttaaagcaattagaagaaaaaaagattcttctttagttagagcagcatatgctgtaaaagaaggaaaggctgatgcattattttcttgtggaaatacaggagcattattagcggctgggttattaattgttggtagaataaaaggaattgctcgtccaggattactgtcaactctaccagtattaactaaagaaggtggagcatttaatcttttggatagtggagctaatgctgataacaagccagaacagctatatcaatatgctttattgggaaaatattatgctgaaagtgttagaaatattaaaaatccaagaataggtttgttaaataatggaactgagccacacaagggaagtaaattaacacttgaagcacataatttaatagcagctgatagtagtattaattttgttggtaatgtagaatctaaggatattttgaaaggtgtttgcgatgtagtagtagcagatggctttactggtaatgcagtcttaaaggctatagaaggcacagctggtacagctatgcatctcttaaaagatacaataatgtcagctggtttattaggtaaaattggtggtttattactaaaaccaagtattatgaagatccgtaataaaatgagtgcatctcaatacggtggtgcagtattattgggagctaaggccccggttgtaaaggctcatggtgcatcagatgcagaaacagtatattatacagttaaacaaatcaatgatatgctagaaaatgatatgttatcgaaatttacagattattttaacaagaatgtataa

SEQ ID NO: 1736 - DNA, 1371 bp, Unknownn; identical to SEQ ID NO: 287
  isolated from saliva, unidentified

SEQ ID NO: 1737 - DNA, 666 bp, Selenomonas sputigena
  isolated from saliva, Selenomonas sputigena
atgtctgtgattataaaagagaagaagaaaagagagccattagcgtacctttttacaatactattctttatcaattattttcttgtatttcaacaggctcaatggttgcatagaatagatacagtagtttattttaaattaactcgtaacttaaataatttacaagtgatgttttacaacgttattagtgaactatctagttccagaatggcaattgtttatacgatagtactactaggaattttatggtttataagatggcaaattcctggtgtgtggattacttttacagttggaacaggattagttgtaggatgggtagcacgatggatattgcgttatggaagtaaaagagttgaaccggaaatgggatatgctttcccaggtttacacgttttagggatgacaattctggtggctattgtatatatcatctttttaccatatttcaaagaaaaggctttggcttacttagtaggattcattttaggaatttggttaattgcgacaagtgtagcttgtatatatttaggtcaattacatgttagtgatattacaggcgcattaacattaggttttgcctgggtatattactgcagtaatttatacataaggtatgctgcaaagttaaagaagattaaggggtttagaaattcaaattattaa

SEQ ID NO: 1738 - DNA, 450 bp, Unknownn; identical to SEQ ID NO: 1287
  isolated from saliva, unidentified

SEQ ID NO: 1739 - DNA, 1479 bp, Unknownn; identical to SEQ ID NO: 1026
  isolated from saliva, unidentified

SEQ ID NO: 1740 - DNA, 1359 bp, Unknownn; identical to SEQ ID NO: 821
  isolated from saliva, unidentified

SEQ ID NO: 1741 - DNA, 639 bp, Unknownn
  isolated from saliva, unidentified
atgatacatatactatcagaaaattggcaaactttcctaacggggtttgaaaatacgattttatgtagtgtgattgcactattcttcagtttgataattggatcaatatttgcaattttgcaaacagtcccttctaaattagtgaggacaatagctaatatttatattgaaattttcagaaatattcctttattagttattaccatggtgttttatgtagtagtaccacaattttttattaaattaagtggatttactgcaggaacaatcggtttaacattatatacctcagcctttattgcagaaactgtaagagctgggattaaagctgttggagttggacaaatggaaggtgcacgagcaaatggtttaacttactggcaaacaatgcgatacattattttgccacaagcttttaaattagtaatacctccattgggaaatcaatttattaatctgattaaaaactcatcagtattagcgtttgttgctggctttgatttgatgtatcaaggtgatgtaatagcttcagcttcttttgaaacaattaatacttatttagttgtaggtgtgttttatttgattttgacattgcctttaagttattacatgcgttatttggaaaagaaattggcataa

SEQ ID NO: 1742 - DNA, 1518 bp, Unknownn; identical to SEQ ID NO: 1369
  isolated from saliva, unidentified

SEQ ID NO: 1743 - DNA, 3294 bp, Unknownn; identical to SEQ ID NO: 796
  isolated from saliva, unidentified

SEQ ID NO: 1744 - DNA, 1173 bp, Unknownn; identical to SEQ ID NO: 1470
  isolated from saliva, unidentified

SEQ ID NO: 1745 - DNA, 780 bp, Unknownn; identical to SEQ ID NO: 1109
  isolated from saliva, unidentified

SEQ ID NO: 1746 - DNA, 642 bp, Unknownn; identical to SEQ ID NO: 1284
  isolated from saliva, unidentified

SEQ ID NO: 1747 - DNA, 1257 bp, Unknownn; identical to SEQ ID NO: 1303
  isolated from saliva, unidentified

SEQ ID NO: 1748 - DNA, 1422 bp, Unknownn; identical to SEQ ID NO: 1362
  isolated from saliva, unidentified

SEQ ID NO: 1749 - DNA, 1353 bp, Unknownn; identical to SEQ ID NO: 902
  isolated from saliva, unidentified

SEQ ID NO: 1750 - DNA, 1044 bp, Unknownn; identical to SEQ ID NO: 1191
  isolated from saliva, unidentified

SEQ ID NO: 1751 - DNA, 1863 bp, Unknownn; identical to SEQ ID NO: 943
  isolated from saliva, unidentified

SEQ ID NO: 1752 - DNA, 1527 bp, Unknownn; identical to SEQ ID NO: 922
  isolated from saliva, unidentified

SEQ ID NO: 1753 - DNA, 879 bp, Unknownn; identical to SEQ ID NO: 1524
  isolated from saliva, unidentified

SEQ ID NO: 1754 - DNA, 2802 bp, Unknownn; identical to SEQ ID NO: 1123
  isolated from saliva, unidentified

SEQ ID NO: 1755 - DNA, 1143 bp, Unknownn; identical to SEQ ID NO: 995
  isolated from saliva, unidentified

SEQ ID NO: 1756 - DNA, 1566 bp, Unknownn; identical to SEQ ID NO: 820
  isolated from saliva, unidentified

SEQ ID NO: 1757 - DNA, 1041 bp, Unknownn; identical to SEQ ID NO: 938
  isolated from saliva, unidentified

SEQ ID NO: 1758 - DNA, 876 bp, Unknownn; identical to SEQ ID NO: 1274
  isolated from saliva, unidentified

SEQ ID NO: 1759 - DNA, 963 bp, Shuttleworthia satelles; identical to SEQ ID NO: 1368
  isolated from saliva, Shuttleworthia satelles

SEQ ID NO: 1760 - DNA, 1152 bp, Unknownn; identical to SEQ ID NO: 1275
  isolated from saliva, unidentified

SEQ ID NO: 1761 - DNA, 318 bp, Unknownn
  isolated from saliva, unidentified
atgaggccaattatgactgatgtactattaataatttgtgaagctttactagctgttattgttttgtatactggattttacttacttacccatcgcaatcgtaagttcttactttttgatcctacttctgagcccagtttaaaaattattatgactatctggggaagtttgcttattattttagggttattaactatacttgctatctttattattaaaagtatcgtttttatttcaattatcctagttttagatgcgattgtagaagcttctctctcatttattatgttgatttactataacactacaaataaatag

SEQ ID NO: 1762 - DNA, 1323 bp, Unknownn; identical to SEQ ID NO: 835
  isolated from saliva, unidentified

SEQ ID NO: 1763 - DNA, 873 bp, Unknownn; identical to SEQ ID NO: 1047
  isolated from saliva, unidentified

SEQ ID NO: 1764 - DNA, 1623 bp, Unknownn; identical to SEQ ID NO: 1416
  isolated from saliva, unidentified

SEQ ID NO: 1765 - DNA, 1266 bp, Oribacterium sp.; identical to SEQ ID NO: 1295
  isolated from saliva, Oribacterium sp.

SEQ ID NO: 1766 - DNA, 882 bp, Unknownn; identical to SEQ ID NO: 683
  isolated from saliva, unidentified

SEQ ID NO: 1767 - DNA, 921 bp, Unknownn; identical to SEQ ID NO: 1279
  isolated from saliva, unidentified

SEQ ID NO: 1768 - DNA, 879 bp, Unknownn; identical to SEQ ID NO: 954
  isolated from saliva, unidentified

SEQ ID NO: 1769 - DNA, 1128 bp, Unknownn; identical to SEQ ID NO: 1387
  isolated from saliva, unidentified

SEQ ID NO: 1770 - DNA, 564 bp, Rothia dentocariosa; identical to SEQ ID NO: 110
  isolated from saliva, Rothia dentocariosa

SEQ ID NO: 1771 - DNA, 342 bp, Unknownn
  isolated from saliva, unidentified
atgactgtgaaaaaactgaacttacaattgctttttgctctgcttattgtcctttgtcctttatttttgctcatcttctatttaaaaaggaagtatatcaaaaatagcgagactgttttatcaaagataagagacgaattttccaaacagtatatagtcaaagattcctggatccacgtataccctcgtcaaaattatcaatttaatcaaccattaacttatgctggtggtgtaaaatgtattgatccttcaggaaaaaccattaattatacctttactgcagatgcaaaaaccggaaaaattattgactcacatattatcaacttagaaatgggcttctaa

SEQ ID NO: 1772 - DNA, 900 bp, Unknownn; identical to SEQ ID NO: 659
  isolated from saliva, unidentified

SEQ ID NO: 1773 - DNA, 414 bp, Unknownn
  isolated from saliva, unidentified
atgaaagcagtaacgactttacatgtttcagctaaatatttatttgaaagaattgctgataaaacgttgtatgatatttttcaaacaactggtcaggaactttctttgaatgaattacaggggtattcttatttgactaagattgatatgtataatgaagctcaaattacaattactagtgtcctcccttactcaaagtttcagtatattactgatacagctgatagtcatgttacagaaacctataaatttaagagtttagctcaagataaagtagaagttacatttgagcaaatagaagttacatctaattttttgaaagctgtagctaataaaataactaatatatctttgggctggttaaagaaacataactttaaaaaggttttaaaacatctagaaactggatattag

SEQ ID NO: 1774 - DNA, 810 bp, Unknownn
  isolated from saliva, unidentified
atgaaaaactttgaacccaatcgggcatttaatacagaagtcgcagcagctttaggaatttatcaagcaattttgattcaacaaattcgctattggcaagagaagtcaacacatgaaatcgatggaagaaaatggatttataatacttatcaagattggtccaagcagcttacatttatttcagagcgaaccattaggagagaactaaagaaattagctgaattaaagattgttagagttgcaaaatacaatatttcaaaatttaatcatacaaagtggtattcactagatgaggagaagctacaagaatatttagacaataaaacacctgagtgtcgaaatggacaaattggacaggtagagtgtcccagggaagataatggaaatggaaaatctggccaattcagaactggacaagttgaccacttcaaagacaataaagtacctaagaatacatcattaaataatcaacaaaagataaaagaaatcctggaatgtttcaaagaagttaccgggcaggtatttgataaagataaatggggaataaagctaattaaagagagattagcagctggaaatgatgtagaacaatgtaaaagtatgatagttttgaaagctaaacagtggaaaggaacacatgttgaaaaatttattcgcccccgaacattatttggtgataatttcagtaaatactatgctgaatgttatgcatatcatcgtgaaaacaactattttgttgataacaaagaagaaaacattgatcgagacaaattaaatcaagaaatagatatgcttttagccaagatttga

SEQ ID NO: 1775 - DNA, 4356 bp, Unknownn; identical to SEQ ID NO: 1080
  isolated from saliva, unidentified

SEQ ID NO: 1776 - DNA, 996 bp, Unknownn; identical to SEQ ID NO: 636
  isolated from saliva, unidentified

SEQ ID NO: 1777 - DNA, 993 bp, Unknownn; identical to SEQ ID NO: 1467
  isolated from saliva, unidentified

SEQ ID NO: 1778 - DNA, 678 bp, Unknownn; identical to SEQ ID NO: 803
  isolated from saliva, unidentified

SEQ ID NO: 1779 - DNA, 1092 bp, Unknownn; identical to SEQ ID NO: 1352
  isolated from saliva, unidentified

SEQ ID NO: 1780 - DNA, 1347 bp, Unknownn; identical to SEQ ID NO: 219
  isolated from saliva, unidentified

SEQ ID NO: 1781 - DNA, 459 bp, Oribacterium sinus
  isolated from saliva, Oribacterium sinus
atgaccattaaaaaaattgctagacttggaatcaatggtatcacttatggtgtaacagtagggatgattctctcattaatcttctcttatttagctggtagcagtagttactacccttccactccagcttttgtggcagagtttaataataatctaacagcaacacttatttcagtattgttatggatggtaattggattattttcagcatattcaagcataatttttgaattggaaaatatatctttgctaattaaaactgtgattcatttttgcttagtatatgcgattgtgttggcagtaggaatatatttgaagtggttcacgactaatggatttatcttagttactatctcgtttgtagttgtttatactgctatctgggtaattacatggttaacgataaagaatgacattaaaaggataaataaacaaataacaaaattaaaagaaaaataa

SEQ ID NO: 1782 - DNA, 846 bp, Unknownn; identical to SEQ ID NO: 1386
  isolated from saliva, unidentified

SEQ ID NO: 1783 - DNA, 876 bp, Unknownn; identical to SEQ ID NO: 1220
  isolated from saliva, unidentified

SEQ ID NO: 1784 - DNA, 600 bp, Unknownn
  isolated from saliva, unidentified
atgaatatcggtgtaatttacattcgtgtttatgaagaagcggaggattttcttatgatgaatatatctggtccgcgagagggcgatttcataactattaaaagttataagcatgacggtagtttacatcgaacgtggcgagatacaatggtacttaaaaccagtgagaatgcgttaattggttgcaatgaccatactttagtaacagaatctgacggaagaagatggattacaagagaaccagctttagtttattttcataaacattattggtttaatattgtgacaatgattcgtgagaacggagtatcatattattgtaatttagcctcacctgctgtattagataaagaggctttgaagtatattgactatgatttagatgtcaaagtctttcctaatggtgaaaaacgtttgctagatgtcgatgaatatgaggatcatggaaataagtggcattattcggcagacattgataagattttgaaacataacgttagggttttagttgattggataaataatggtaaaggtccattttcaaaagaatatgttgaaatttggtataaccgttatttagaattgtcgcgtcaacagtga

SEQ ID NO: 1785 - DNA, 357 bp, Unknownn
  isolated from saliva, unidentified
atggaacaaacagctcgtaaacttaaccaacaaccaagaatagtacataataacgagcctgagaaaaaatacatagttcaatcatctccttacagaagtaagatgatgaaattgtttgctggatcaatggtatggataggagttatgactaccatggtaatttcagcaaatgttaaattaacaaatgcacagttgaatttacaagatacaacaagcaaaattacaaaaatccaaggttctaatactaatatgaaacaggaaattagtgagttatcaagtaaatctcgtctaagcaaaatagctaaagatagtggtttaaagatgaatacaaagaatacaaggaatgttactaaatga

SEQ ID NO: 1786 - DNA, 1113 bp, Unknownn; identical to SEQ ID NO: 1419
  isolated from saliva, unidentified

SEQ ID NO: 1787 - DNA, 1200 bp, Streptococcus anginosus; identical to SEQ ID NO: 1443
  isolated from saliva, Streptococcus anginosus

SEQ ID NO: 1788 - DNA, 999 bp, Unknownn; identical to SEQ ID NO: 1270
  isolated from saliva, unidentified

SEQ ID NO: 1789 - DNA, 1395 bp, Unknownn; identical to SEQ ID NO: 1039
  isolated from saliva, unidentified

SEQ ID NO: 1790 - DNA, 837 bp, Oribacterium sp.; identical to SEQ ID NO: 1175
  isolated from saliva, Oribacterium sp.

SEQ ID NO: 1791 - DNA, 687 bp, Unknownn
  isolated from saliva, unidentified
atgaaaaaagtaatttatttaggtatcacaatgttaagtgcaatggtattagtgggatgcagtaatacaagtagtgctcctaatacaactagtcattcaagtaacgtaaaaacagaagttaagagtagttctactagcaaaaaagaaaagaaaattactgctaaagcagttgatgaaagtagtgtagtagcagaaagttcttctgtagacagcaataataacaataacgtaaatacaaattcaaatgttcaaactgctactagccaagttgcaagtgcaaatagttctgtggcaaaagaaagcagtagtgttgctactggtaatactaatgttgcagaaaatgcagtagctccaagtgtagcaacagagtctagccaaaaggtacaagaagtaaatgaacaactaacacctgctcaaattgctgctttggctgcttactatatgggtaatgatgctaattcattaactgttcataatatgggtaattataacgctgtaagtggtactgacggtaagttgctatttgcttatagtgcagatggaaacaacttaaaagttggtggctttggtgatactccttgggacagtgttaatgcaaacgatgtaatgcaaaaggcacaacaacaaggtaataaggattcaattaaccaagttgcaaataatacaacatttgaaaaaggttattaa

SEQ ID NO: 1792 - DNA, 873 bp, Unknownn; identical to SEQ ID NO: 1277
  isolated from saliva, unidentified

SEQ ID NO: 1793 - DNA, 300 bp, Unknownn
  isolated from saliva, unidentified
atggcacaacgtaaaattcctatgagaaaagacattgttacaggtgagatggtacctaaaaaggaattagtccgtgttgttaaaaataaggaaggcgaggtaagcatagacccttctgggaaaaaatctggtagaggtgcatatatccatctaaatgttgatgtagcaaaaaaagcaaaagttgataagacttttgataaaacttttggtattagtatttctgatgatttttatgatgaattgattgcatatgttgatcatcaagtagaaagagcaaaattatttggtaatggaaaatag

SEQ ID NO: 1794 - DNA, 765 bp, Unknownn
  isolated from saliva, unidentified
atgatattttcattaaaagattattttagaaaggtaggaattaagatgcgaccaagaatagcaattccagctgatacgctaacagaagcaacaaatgttattaatgaaagaatgtcaccctatgcgcctaaaccagtaattgaagcaattgttaaatcaggtggtgttccggttatttttccgagtgtttctccagaattggtaccagattatctcgacctttttgacggagttctttttgcaggaggagctgatgttgatccaacattttttggagaggaacctcatcaaaagttaggggcaacttatcgtaagcgagatttatttgaaattgaattactgaaacagtccttaaaagctgataaggcaattatgggaatttgtcgaggattacagctaataaatgttggtttagggggaactttatatcaagatttatctgaaaatccagaagcaacaatcaaacattctcaagatgcaccaggaaattttccttctcatcacgtcaatgtacaagaagatagtcgtctctattctttagtagggaagcgaccttatgtaaattctcgacatcatcagttactaaagaaaattgcaccaacattacgtgtttctgcctttgccgacgatggagtgcctgaagcaattgaatcaaaagaaaataaccaaattttagctgttcaatggcatccagaaaatatgtttaagcattatgaatattctcaaaagatattcgctgactttattgaaagagctaagcactag

SEQ ID NO: 1795 - DNA, 369 bp, Unknownn
  isolated from saliva, unidentified
gtgatccaacaagagagtcgtttaaaagtcgctgataactccggtgctcgtgaaattttagttattaagattttgggtggttcccgtgtgaagactgcaaatatcggtgacatcattgttgctactgttaaacaagcaacaccaggtggcgttgtcaaaaaaggtgatgttgtaaaagctgttgttgttcgtactaagtatggtacacaccgtccagatggctcatacatcaagtttgacgaaaatgctgctgtaattattggtgaagataaatcacctaagggtacacgtatttttgggcctgttgctcgtgaattacgtgacggaaacttcatgaagatcgtttccttagcacctgaagtattataa

SEQ ID NO: 1796 - DNA, 1119 bp, Unknownn
  isolated from saliva, unidentified
atgctaggaattgcaattataactggtagtggaatcatgagaggggtagaggcagataagattgatgccaaagcagcctacatgatagatgcaggtactggtcaggtcttgtatcaacaaaatgcgaatagtaaatatccaattgcgtcactaactaaaatattaacattagcggttattatgaaagatatccacaaccaaaaattaagttgggatcaaaaaattaaagtaaataaagatgtgtctgatatggctaataactggcaatactcaaatgttcagttaaacgaaggcgaaagctatacagttaagtcactagtagaatcaatgatgattgtatcggcagatggtagtacagaagctttagccttggctgatgctggaagtgtgaaagcctttaatgaaaagatgaaggaagtagcacatgaagcaggagttactgatgctgagatttacaatatgattggtttgccaaattcagatttgggtaatttaaagttgaaaaatgtaggcaatgatcaagaaaataaattttcagctaaagatatagctttgatttcgaagtacttagtaaataattatccagaagtaatagatattactaaacaaaagaatgttgattttaaaataagtgccgatcagacatacaatatggagaatattaattatatgttggaaggaagttatgcagcacctaaaaatgggacaatagatggtcttaagacaggatttacagatgaggctggatattgttttgtaggaacaggtacatttaatggacaacgtgtgataacggttattttaaatgcctcagactataataaacaatttgctgaaacaaataagataattgaatcagttatgaataatgataaagtagtaaatactaaggatataaagagtgttaagcaagctttgaaaaaagaaaatttgaaagtaaatgatactaatatttgggtaacaaagaacaccgatcctaagcaaataaaagcgaaattaactctatctaatgaaaaaataaaagaaaaaaatactaagaatgagaaagttggcacaattaaaatcagttctcctggggtatctccagtagaattgaacgtcaatttagatgctaaataa

SEQ ID NO: 1797 - DNA, 891 bp, Unknownn; identical to SEQ ID NO: 1012
  isolated from saliva, unidentified

SEQ ID NO: 1798 - DNA, 2010 bp, Unknownn; identical to SEQ ID NO: 597
  isolated from saliva, unidentified

SEQ ID NO: 1799 - DNA, 930 bp, Unknownn; identical to SEQ ID NO: 1239
  isolated from saliva, unidentified

SEQ ID NO: 1800 - DNA, 768 bp, Unknownn; identical to SEQ ID NO: 789
  isolated from saliva, unidentified

SEQ ID NO: 1801 - DNA, 474 bp, Unknownn
  isolated from saliva, unidentified
atgcccaaaatatatttccaaaagatgacaccaaatggttataaacaaattgaagatgaaattgaacagttaaaacttgatcgccctgccaaaataaaacaacttcaagaagccagagctctaggcgatttatcagaaaatgctgaatatagtgctgctaaacgtgacctacgccatttagaaagtcgattacgctatttaaataagcaacttcaatatgcagaaatcataactcctaaaaatgctgatagcgtagatattggaactactgtaactatccaatttgatgatgatgaaaacgacctagaaacatatcaaatcgttggaaagcaagaagtcaacgtagatgataacaaaatttctttcgtttcccctattggcaaagccattatgcataaaaaggttggtcacacagctactgttgttgctccaactggttcttacactgttaaaatcatttcaatttctatataa

SEQ ID NO: 1802 - DNA, 2265 bp, Unknownn; identical to SEQ ID NO: 1340
  isolated from saliva, unidentified

SEQ ID NO: 1803 - DNA, 939 bp, Unknownn; identical to SEQ ID NO: 673
  isolated from saliva, unidentified

SEQ ID NO: 1804 - DNA, 1293 bp, Unknownn; identical to SEQ ID NO: 844
  isolated from saliva, unidentified

SEQ ID NO: 1805 - DNA, 567 bp, Unknownn; identical to SEQ ID NO: 1438
  isolated from saliva, unidentified

SEQ ID NO: 1806 - DNA, 891 bp, Unknownn; identical to SEQ ID NO: 1029
  isolated from saliva, unidentified

SEQ ID NO: 1807 - DNA, 1482 bp, Unknownn; identical to SEQ ID NO: 1018
  isolated from saliva, unidentified

SEQ ID NO: 1808 - DNA, 768 bp, Unknownn; identical to SEQ ID NO: 1237
  isolated from saliva, unidentified

SEQ ID NO: 1809 - DNA, 1278 bp, Unknownn; identical to SEQ ID NO: 994
  isolated from saliva, unidentified

SEQ ID NO: 1810 - DNA, 519 bp, Unknownn; identical to SEQ ID NO: 891
  isolated from saliva, unidentified

SEQ ID NO: 1811 - DNA, 1290 bp, Unknownn; identical to SEQ ID NO: 1102
  isolated from saliva, unidentified

SEQ ID NO: 1812 - DNA, 1377 bp, Unknownn; identical to SEQ ID NO: 747
  isolated from saliva, unidentified

SEQ ID NO: 1813 - DNA, 597 bp, Unknownn; identical to SEQ ID NO: 1299
  isolated from saliva, unidentified

SEQ ID NO: 1814 - DNA, 483 bp, Unknownn; identical to SEQ ID NO: 984
  isolated from saliva, unidentified

SEQ ID NO: 1815 - DNA, 1338 bp, Unknownn; identical to SEQ ID NO: 242
  isolated from saliva, unidentified

SEQ ID NO: 1816 - DNA, 1737 bp, Unknownn; identical to SEQ ID NO: 875
  isolated from saliva, unidentified

SEQ ID NO: 1817 - DNA, 669 bp, Unknownn
  isolated from saliva, unidentified
gtggataaaaacattaaaaataaggctgaagaattaattaaagatcttatacagaaaatagataataatccttatgatgcacaggcatattataatttaggggtgactcttaatgatgctcattctgctgaacaagcagaagaactatttgagaaagcattgaatatatttgctaatagcaaagaaaaatcttcacttatgcattatggattgggaaatgtatactatactaattctatgtacgataaagctatagtggagtttaagaaagtccaatctgaaaagttaaagcaagattcaatgttaatgatggcacaggcatattatgcccaagaaaattatcctcaagctatgatgtatgcattaacagtttctgaaaatacaaaacataatgtagatgcgatttctttattagcatcatgttttatggctacaggtgatttgactaatgcaagaaaatactatttaaaagctttagaatatgacaaagataatgtagaagtattattccaattaggagtaatagaacttagtttgtcaggagaagcaggtaagtattttgatcgagttaagaatttggataatgaatattacaaaaaaatgcaacaacgtttggcagatgtacaacgtttcttaatgacacaaaagaaaggaaaatctgatgagtga

SEQ ID NO: 1818 - DNA, 1029 bp, Unknownn; identical to SEQ ID NO: 882
  isolated from saliva, unidentified

SEQ ID NO: 1819 - DNA, 1350 bp, Unknownn; identical to SEQ ID NO: 1150
  isolated from saliva, unidentified

SEQ ID NO: 1820 - DNA, 1425 bp, Unknownn; identical to SEQ ID NO: 1161
  isolated from saliva, unidentified

SEQ ID NO: 1821 - DNA, 3639 bp, Unknownn; identical to SEQ ID NO: 782
  isolated from saliva, unidentified

SEQ ID NO: 1822 - DNA, 2037 bp, Unknownn; identical to SEQ ID NO: 885
  isolated from saliva, unidentified

SEQ ID NO: 1823 - DNA, 1122 bp, Unknownn
  isolated from saliva, unidentified
atgacagaaactagtaatgaaattttatattgtattgggtgtggagctaaaattcaatctgaaaacccaaatgaactagggtatacaccggaatctgctgtaaaaaaaggattagagacagaagaattgtattgtcaacgttgttttagattaagacactataatgaaatagcagatgtaagtttgacagatgatgattttttaagattactaaatcaaattggtgaatcagattcattgattgtcaatgttgtagatatattcgactttaatggatcagttatcccgggactacatagatttgttggtaagaatgacgttttgttagtaggcaataaatctgatttgttacctaaatctttaaaacgttcacggattaaagactggttacgtcaagaagctaataagcaaggtttgaggcccatagatgtagcactaactagtgcaagtaaaggatatgaaattgataatttattagaattaattgataagtatcgtaagggtagagatgtatatgtagtgggtgttactaatgttggtaagtctacacttattaaccgtataattaagcaacaaacaggtatttctgagttgattacaacttcacgctttccagggacaacattagataaaattgaaataccatttgatgatggtaaaaacttgatagatacaccgggaattattcacaagcaacaaatggcacattacttaacaggaaaatcgttaaagtttgcctctcctcaaaaagaaatcaagcctaaggtttatcaattaaatgaaggacaaaccattttcttagggtctttagcaagatttgattatatttctggcggacgcacaagtgtaattgcatattttgataataatttaccattacatcgcacaaagttacaaaatgctgataaattttatgaaaaacatgcaggagaattattacaaccacctactagagaagaattgaaaaaaatgcctaaactaactagatttgagtttaaggtaagtgaaaaaagtgacttagtattttcaggattgggttggataagtttaagtccgaatacaattgttgctggttgggctccggaaggtgtaggagtattaataagaaaagcaatgatttaa

SEQ ID NO: 1824 - DNA, 1329 bp, Unknownn; identical to SEQ ID NO: 829
  isolated from saliva, unidentified

SEQ ID NO: 1825 - DNA, 2439 bp, Unknownn; identical to SEQ ID NO: 916
  isolated from saliva, unidentified

SEQ ID NO: 1826 - DNA, 657 bp, Unknownn
  isolated from saliva, unidentified
atggcaagtgttcaatggcttgaaaatgaatttgaaaaacatagaaatttagataatgcttcacatatggcaaaatatatgcgtaaccaatttgatttttatgggataaaaacacctgagcgtaggagtatatataaggatattataagagaagcaaagaaatctaaaagtatagattggcaattgttaaatgaatgctggaataatgattatcgagaatttcaatattttgtgtgtgattaccttaaagcgttgcaaaagtttttagtttttgatgatatcgataaaattagaccttttattaaaactaagcagtggtgggacacgatagatagtctagatactgttatcggtaatattaatgatttaagggttgatgacttaatgcttgagtggtctgtgagcgatgatatttggtttagaagaattgcaattaatcatcaacgaggtagaaaagataaaaccgatactgtactcctagagaagatattaattaataacttaaataataatgagttttttattaataaagcaataggttgggcgttaagagattattctaagacaaatacggattgggttaagaattttattgctaaatataaacctggattaagtactttaagcattagagaagctagtaaataccttgaataa

SEQ ID NO: 1827 - DNA, 429 bp, Unknownn
  isolated from saliva, unidentified
atgattattattttgattattgcagaccagggtctaaagttctggatttctgcaaatattaaattaggaaccagccaagtaattttacctaatgttttagctttaacaaatgttagaaatgatggagctgcttggagtgttctaagtggacagcaatggttctttacagtcattacaatagttgctctaggtatgatgggatatttcttctggaaattgagaaatgataacttgtatatgtcggcaatttcgttattaattgctggtacgttaggaaattttattgatagaattcgtttaggttacgttgttgatatgtttgaaacattatttatgaatttcccaatttttaatgtagcagatatgtgtctaacgtttggtgtaattatagtaataatagcattgataaaggatgaaaaagatgagtga

SEQ ID NO: 1828 - DNA, 1824 bp, Unknownn; identical to SEQ ID NO: 760
  isolated from saliva, unidentified

SEQ ID NO: 1829 - DNA, 816 bp, Rothia aeria; identical to SEQ ID NO: 958
  isolated from saliva, Rothia aeria

SEQ ID NO: 1830 - DNA, 1221 bp, Unknownn; identical to SEQ ID NO: 935
  isolated from saliva, unidentified

SEQ ID NO: 1831 - DNA, 1824 bp, Unknownn; identical to SEQ ID NO: 1482
  isolated from saliva, unidentified

SEQ ID NO: 1832 - DNA, 1260 bp, Unknownn; identical to SEQ ID NO: 1477
  isolated from saliva, unidentified

SEQ ID NO: 1833 - DNA, 591 bp, Unknownn
  isolated from saliva, unidentified
atgcaagtacataacgtcaatttaacaattagtgccgtaagaccagaacaatatccagatgctaaattgccagaagtagcacttgctggtcgttccaatgttggaaagtcttcattaattaacacattaattaatagaagaaattatgcccgtacgtcaagtcaacccggaaaaacgcaaacgctgaatttttacaatatcgaggatttattatattttgttgatgtaccaggttatggatatgctaaagtttcacaaaaagaaagagaaaaatgggctagaatgatagaaacatatttttctactcgacaagagctaaagggagctatcagtttagtagatgctcgccatgaaccttcagaattagattgtcaaatgatagaatttttgcattattacaatatacctgtattagttgtaggaacgaaaatagataaaattccaaaaagcaaaagaaataaaagtgaaagtcaaattagaaaaaaactacaattgacaaaaaatgatagactaattttattctctgctgttgataagataggtaaagatgaagtttggaattggattgaaagtattaccaaagttaattaa

SEQ ID NO: 1834 - DNA, 1830 bp, Unknownn; identical to SEQ ID NO: 883
  isolated from saliva, unidentified

SEQ ID NO: 1835 - DNA, 918 bp, Unknownn; identical to SEQ ID NO: 812
  isolated from saliva, unidentified

SEQ ID NO: 1836 - DNA, 1062 bp, Unknownn; identical to SEQ ID NO: 1024
  isolated from saliva, unidentified

SEQ ID NO: 1837 - DNA, 996 bp, Unknownn
  isolated from saliva, unidentified
atgttgaaaaatataattttaacaactggtgatccaggaaaaaatattggtggcggaaaggcaaaagaagatataagtaaaatttttagtgatatgggatacataggaaagaatattccaatttacacttctaaagttagaaaatacctatatattcatacaaaaatgcgaaaagatatagatttgactaatatcaatagagtggtttttcagtatccaacttcatctgtaagaatgacaagggaaataataaattacatatctaatagtaatgctgaattagtattatttattcatgatatatcaagcttgcaggaagatggaaatacaatctcagaatatgaaataggattactaaatctagctgataaaattattgtacacaatgatgtaatgaagaaaattttggaaaagaataacatttcatcgaaaattttagttctaggtatttttgattatttaacagatttttctcctaaatcaaaagcgtatgataaaacagtatgttttgctgggaatttatttaaatcaacttttttacaaaaactagctatggaagaacataaaatagatgtatatggacctaataaattagataattatccagaatgcatagactacaaaggacaatttagtcctgaagagctacctagtcatttaaatcagagtttcggattaatatgggatggagatagtgtagaaacttgtgaggggcattatggagagtatatgaaatttaataatccacacaagacatcgttatatattactactggattgccaatattaatttggcgagaggcagctatggctcaatttattgtaaaaaataaacttggtgtagcaatagatagtttagttaatatggatgagatacttgatagtataacggctgatgaatacaggataatgagagaaaatgccttgaaaatgggtaaagatttgaaaaatggaaaatatactaaaaaaatagtagaagtgttagataaaatgtaa

SEQ ID NO: 1838 - DNA, 561 bp, Unknownn
  isolated from saliva, unidentified
atgaaaaaattatcaactaaaatcataacaatcttagctttatgcatcgctttaaatattgttggaagtaacattgctttacttttgaaacttccaatttacctagatactatcggtactattttagctgcttctttggccggcccagttggtggtgttactgtaggtgctctaacttcaattatcgttggtttaacaaccgacttattttcactatattatttgccagttcaacttatagttggtctcatcgcaggtatagtttactcacactatgccgcagatacttttaaaaagctatggtggttagctatcatcatttctttaccagctactttagtaagttctgccattactttatttttattccacggcattactagttctggatctgccattattgtacaaatattggctaaattaggtttaggtaaaggcttagctgtattccttgttcaagttggaactgattatctggatcgtttagtcgctatttatgttgtttcacttgtttacaaagccctaaaaagtcgtatatctttaggagtaactaaatattaa

SEQ ID NO: 1839 - DNA, 1251 bp, Unknownn; identical to SEQ ID NO: 620
  isolated from saliva, unidentified

SEQ ID NO: 1840 - DNA, 1047 bp, Oribacterium sp.; identical to SEQ ID NO: 968
  isolated from saliva, Oribacterium sp.

SEQ ID NO: 1841 - DNA, 978 bp, Unknownn; identical to SEQ ID NO: 1179
  isolated from saliva, unidentified

SEQ ID NO: 1842 - DNA, 669 bp, Selenomonas sputigena; identical to SEQ ID NO: 756
  isolated from saliva, Selenomonas sputigena

SEQ ID NO: 1843 - DNA, 597 bp, Unknownn; identical to SEQ ID NO: 1501
  isolated from saliva, unidentified

SEQ ID NO: 1844 - DNA, 747 bp, Unknownn
  isolated from saliva, unidentified
atgaaagaagagcaaaaagattttattattggacgtcatccagctatggcggctttaaaaaagaaagatagcaatattaataaagtttttgttcaagaaggattaaaggcggatgctattcaggaaatatatactttagctaaagcccgaaaattagtagtttctagagttcctaaaactaaacttgataatttagtaaatggacaaaatcaccaaggagtagtgattgctatagcatcatatagttatgctacaattgatgatttgtttgaaaaagctcgtagtaagaatgaagatccttttttcttgattttagatggaattgaagatccacataatttaggttcaattatgagaaccgcagatgcagcaggagttcatggaattatcattcccaaaagacgtgcagtgcagttaacttcagttgtggcaaaaacttcaacaggtgctattgaacatgtacctgttgtgagagttacaaatttagtgcaaactgttaaagaattaaaagaacagggagtatggatttttggaactgatatgaaaggaactgattttagaaagtggagtgctaagggagcaacagctttggtaataggaaatgaaggtaaaggaatttctccacttttgaagaaaacttgcgatgaaatgttaactattccaatggtaggacatgttcaaagtttaaatgcaagtgtagctgctagtttattaatatatcaaggatttacttcaagaggaaattaa

SEQ ID NO: 1845 - DNA, 645 bp, Unknownn; identical to SEQ ID NO: 675
  isolated from saliva, unidentified

SEQ ID NO: 1846 - DNA, 963 bp, Shuttleworthia satelles; identical to SEQ ID NO: 1105
  isolated from saliva, Shuttleworthia satelles

SEQ ID NO: 1847 - DNA, 909 bp, Unknownn; identical to SEQ ID NO: 941
  isolated from saliva, unidentified

SEQ ID NO: 1848 - DNA, 600 bp, Unknownn; identical to SEQ ID NO: 623
  isolated from saliva, unidentified

SEQ ID NO: 1849 - DNA, 894 bp, Unknownn; identical to SEQ ID NO: 1165
  isolated from saliva, unidentified

SEQ ID NO: 1850 - DNA, 342 bp, Unknownn
  isolated from saliva, unidentified
atgagaaagtcatatcgcgtcaaaaaagaagcggaatttcaaacagtctttactcaaggacagtcttgtgctaaccgccaatttgtggtttacatgctagaaaagcctgatcaaaagcattttcgagtaggaatttcagttggtaaaaaaattggaaatgcggtagctcgcaattgggtaaagcgtcgtattcgccaaagtttaactgaattgaagcctcagttgaagcaggattgcgattttcttgtgattgcacgaccaactgttgcttatatgtcaatggctgaagtaaaggaacatctaaagcatgttttgaaattagccaaagtattaggagaatga

SEQ ID NO: 1851 - DNA, 1062 bp, Unknownn
  isolated from saliva, unidentified
atgaaaaaaattaaacttaatataatagtccctagtttggtgcaaggtggaggcttaagaataatcttctcttatgctaattacttagtagaacagggacatgatgtagttgtttatgttcctgttttgtatgtgtggccaaaagtaagaaacaataagattaattggaaaaccagtgctggaaatttcctaagaagtaataagttaaagtggttcgataataaattcaagattaagtctgtatttaaaatttcagacacttatatcagaaatgctgatattgttatagcgactgcttggcagactgcacaaacagtatatgatttagatgataccaaaggaaagaaagtatacttcattcaaggctacgaggtagataatgaaggtattaataaacaggaagttgaagattcgtataaattaggtatgaatatgttcacaattgctaattggctagaagaattagtcgaggctattagtgagcaagaagtaaaagttattcgcaattggactaaggacagtgagttcatccaaggagaaaagcaagttaatagtcctagagcaataattatgttagggaatacagcagcacataagggatggaatctaggactagaggttttgaagaaggctcaagaaaaatataactgccgtattattttatatggcgttagacaaattcccgatataccggaatcgttcgagttttatcagcagcctaagagagagttgctgatgaaattatatagtgaagcagatatctgtttatttccaagtattagagaaggttggggattaacggttacggaagcgatggctcataaatgtgcgattgttggtaataatactgggatagtattagaaatttgcgaagatggaaagacagctttaatttctgaaagtaaaacagcaaaagacttaaaaaacaagttgtttaaagtaattgaagacgagaaattaatgaaaaagttacaagataatggatatgagttggctaaaaaatatgcttttagtaaccaaagtaaattatttgaagagtacttattatcattagtcaaataa

SEQ ID NO: 1852 - DNA, 1725 bp, Unknownn; identical to SEQ ID NO: 1153
  isolated from saliva, unidentified

SEQ ID NO: 1853 - DNA, 1335 bp, Unknownn; identical to SEQ ID NO: 851
  isolated from saliva, unidentified

SEQ ID NO: 1854 - DNA, 1149 bp, Unknownn; identical to SEQ ID NO: 1536
  isolated from saliva, unidentified

SEQ ID NO: 1855 - DNA, 1140 bp, Unknownn
  isolated from saliva, unidentified
ctaactatttatgttataatagttagtgaagaaagtgaggtgaacctaatggaaatgcaagttacaatcaagactaaactaaagatttctaactctgaaatagcttggagtttttctaaaacaatggaacaatatcgtcaagcatgtaattatgtatctgaatacatttttaataatgattttgatatgaaacaaagtagattaaataaagaactatatactaagttgcgcaatctatttagtcttaaatcacaaatggctcaatctgtaattagaactgttattgcacgctataaaactgtcaaaactcaaatggcacgtagaccttataaatatcaagaccaaaatactggtgaatggtaccgtgaagtacgtgatttgacttggttacataaaccaatttcttttaatcgcccacaagttgaccttcaacgtaaccgtgattggtcttatttaagtagcggtcaattatccattaacacccttgatggtcgtgtcaaagttgatcctatttgtcgtggattcaatcagtaccttgacggtacttggaaatttggtttagctaaattacttaaatccagtggcaaatggtatttacatatttcagccactaaggaagtcgctgattttaataaacaaactgtaaaacacgttgtcggtcttgaccgtggtttacgctttttagctactagttatgatgaacaaggcaagactgccttttttgacggccaagcaattatgcgtaaacgtgctaaatatcaaaaacttcgtgccaccttgcaagctaaaggaactaagtcagctaaaagacgtttaaagaaattatctggacgagagaaccgttggataagtgatgttaatcattgcttgtctaagacacttgttcaaaaatatggtgccaatactttgtttgtcttagaaaaccttaacggtgtttcttttgaacgtactgacttacctaaagctttgcgtaatcaaaataaatcatgggctttttatcaattagaacaatttctaacttataaagcacacttacacaatagtgaagttgttgaagtttctgctaaatatacatctcaacgttgtcctaaatgcggagttatcaaaaaagataatcgcaatcatgaaaaacatgaatat

SEQ ID NO: 1856 - DNA, 819 bp, Unknownn; identical to SEQ ID NO: 865
  isolated from saliva, unidentified

SEQ ID NO: 1857 - DNA, 546 bp, Unknownn
  isolated from saliva, unidentified
atgaaatggtctttaaaagagctaaatcaagcaagtgaagctccaatccattttacagagaatttagatttgaatgaagcattaaaatctagaagatctgatattataaaagtttcaacagtacatgttgatggaatgttttctattgacgaattaggagttttaggctatatgaaggttaactgtacagtaaccttaccttctagtcgttcatttcaaccagtcgatttagaacttaattttgatgtaacagagcattatttaagtcattataatccggatttatcaagttttgaagatacggatgtcgttattgtattaaaagatgatatactgaatcttgcagatgttatagaagacaatatattgttacaaattcctatgcaggttttatctgtagatgagaaacgagatgacgcggttatgccgtctggtgatgactggagtgtcattcgtgaggaacagttgcagaaaaacaatcataagaaagataatattgatccaagattagctaagttaaagaatttctttgatgaagataaatag

SEQ ID NO: 1858 - DNA, 399 bp, Unknownn
  isolated from saliva, unidentified
gcccaacttttcagtgtacttagcttcgtggttataattttgttgggaatagttttactaattcaaattgcaaaagaaattattcgtcttttccaaattgcacttgagcctacaactagtgacatttaccttatgatagataagattatagttttctttttactgtttgaatttttcatgattgtaattagttctcttaaaaataatggtcatgtatctattactttattgatgggacttggactaacagctttattacgaaacttactgattatccatgatgactataagaacttaatcttaaatatcgtcggtattttattattgatcgtcggtatggcgatttatcgttactttgtacacgctcatattaaagaagaagatcaacaacagaaataa

SEQ ID NO: 1859 - DNA, 615 bp, Unknownn
  isolated from saliva, unidentified
ttgaaaaagacagaactcaagttggagagtggactggttaaggctttggaaaatgaatcatttaaccagttgacagttgcggaattggtagctgccgccggtattagtcgtagatcgttttatatatactataaagataagtatgaatttttgtatgatgttagaagtaggattttaaaaggtattaaacaggcgatggaagccgatagaaaagtcattgaacagtttgaagtccgcagattgcagacagatgaagaaaagtatttatcaacacatgatgaattttataaattagccgtttttattaatgaaaatagtgatatggtgcgtactttattttcaagaaatgcaacaatagatttttatcgtgattttatggatttattaaaagaagaaataactattcgtaattcttttcataaaataacgtatgggacaatgatacctaccagatatgcagaggagatatttgcaggtgaaatcataagtacgattagaatttgggtatcaaatcataataaagaatcaatggaaagtatcgatgaattccttgatattttagggaaaatccaaattatttctccatatcatttatttagaccaataaaggaatag

SEQ ID NO: 1860 - DNA, 624 bp, Unknownn
  isolated from saliva, unidentified
atggaaaataatattataattcgtttggaaaataaagaagaatggaaacaagtagagaatcttacaagagaagctttttggaataaatatcatcctggatgttctgaacattatattcttcataaatttagaaaacgttctgattttgtaaaagaattggattatgttgttgaaaaagatggagaagtgattgcccatattatgtattgtaattctaaaatacaatgtgataatggggattttgtttcagttatgacatttggtcctgttagtgtgttaccaaaatatcaagggaaagggtatggtagtaaattgattaaatttacaatgggtaaagcaaaaaaacttggttgtggtgcattagcaattactggagatccaaagtattatcgaaaatttggatttgtaagtggacattctatgaatatttactatgatccttttcctcgaaatgaagaaattccatttttcatggtaaaagaattacaatcaggttatctttctggagtaattggtacttttaaggatccagaaggatatattgttgaaaatgcagaagttgaaaaatttgatactaattttccaataaaggaaaagaaaatcttaccagggcaattatcataa

SEQ ID NO: 1861 - DNA, 774 bp, Unknownn
  isolated from saliva, unidentified
atgatttctattattacaaaagaaattaatgatttaccaatcctagaaatttgcgatagtgagaaattaggtgaagaattaccacttgtctttttctatcatggttggactggatgtaaagaaagagttttaactcaaggttatgagattgctaaaaaaggatttagagtaattttaccggatgctttatatcatggagatcgtcaagagggcgatgtaaaagggcatgttcttgaattttggaaaattgtcttaaattcagttaaggaatttccaactttggttgattactatcgtgaaaatgttggaattaaagatggttttgtaggagttagtggtttatcaatgggcgggataacgactaacgctttaatgacaacatatccatggataaatgcaggagtttgcttaatgggtagtcctaaaccagttaaatttgcgaagaaattagttgctgatgcggctacacaagttaaaggaatgcctgatactgaagttgataagcaaatttcagctttagaaccatttgatttatccttgaatttagaaaaattagctagtcgtccgcttcatttttggcatggtacagcagataaaatggtaccttaccaagatacggtggacttttatcgcgaaaacataggtaaaagttatacagaaaatgttactttaaccacaacggagaatgtgggtcataaagtcagccaagaaacaactttagaaatggcaaataaatttgatcaatattatcaaaagtttgttggtgagaggtaa

SEQ ID NO: 1862 - DNA, 1002 bp, Unknownn
  isolated from saliva, unidentified
ttgctatataataaagataaattaggagaatttgtacacatgaaagatgatctagctattttgattccttgttataatgaaggaataactattagaaaagttgttgaagattgccttagagatacaaaggatattgatggaaaagtcaacgtttatgtatatgataacaattcaactgataatacagtagaagaagcaaaagctggtggggcaatagttagatatgaatatcagcaaggtaaaggtaacgttattagacgtatgtttagagaaataaatgctaaatgttatataatgttggatggcgatgatacatatccaactaatgctattcctgaaatgtatcaactagtttgtgaaaaaaatgtggatatggttataggagatagattatcttctagttattttgaagaaaataagagaccattccataactttggcaatagaattgttcgaggtagtattaattggttgtttaagagtaacataagagatattatgacaggttatagggcttttagttatcagttcgttaaagcctattcaattctatctaaaggatttgaaattgagactgacatgagtatctttgcaattgaaaataatctatctattgaaaataaaattattgaatacaaggatagacctgatggtagtgaatcaaaattaagtacatactctgatggatttaaagtgttgttgagaatctttaatttgtatagagaatatcatccattaaagtttttctcaatcataggtgttatattatttttattagcactaggtttctttataccagaagtatggataccatatttaaatacgggattagtactaaaaattcctacgctaatattctgttgtttttttgtgttagctgctattttatcagtatatagtgggcttattttggatgcagtattacaaaaagaaaagagagaatttgaatttagattacaattaataaataatggtgaaataagtgaagaaaataggaattaa

SEQ ID NO: 1863 - DNA, 1296 bp, Unknownn; identical to SEQ ID NO: 1043
  isolated from saliva, unidentified

SEQ ID NO: 1864 - DNA, 1185 bp, Unknownn; identical to SEQ ID NO: 510
  isolated from saliva, unidentified

SEQ ID NO: 1865 - DNA, 1041 bp, Oribacterium sinus; identical to SEQ ID NO: 946
  isolated from saliva, Oribacterium sinus

SEQ ID NO: 1866 - DNA, 969 bp, Unknownn; identical to SEQ ID NO: 1375
  isolated from saliva, unidentified

SEQ ID NO: 1867 - DNA, 1287 bp, Unknownn; identical to SEQ ID NO: 1349
  isolated from saliva, unidentified

SEQ ID NO: 1868 - DNA, 2253 bp, Unknownn; identical to SEQ ID NO: 1253
  isolated from saliva, unidentified

SEQ ID NO: 1869 - DNA, 1254 bp, Unknownn; identical to SEQ ID NO: 839
  isolated from saliva, unidentified

SEQ ID NO: 1870 - DNA, 2010 bp, Unknownn; identical to SEQ ID NO: 640
  isolated from saliva, unidentified

SEQ ID NO: 1871 - DNA, 768 bp, Unknownn; identical to SEQ ID NO: 770
  isolated from saliva, unidentified

SEQ ID NO: 1872 - DNA, 1647 bp, Unknownn; identical to SEQ ID NO: 694
  isolated from saliva, unidentified

SEQ ID NO: 1873 - DNA, 2157 bp, Unknownn; identical to SEQ ID NO: 900
  isolated from saliva, unidentified

SEQ ID NO: 1874 - DNA, 1383 bp, Unknownn; identical to SEQ ID NO: 769
  isolated from saliva, unidentified

SEQ ID NO: 1875 - DNA, 267 bp, Unknownn
  isolated from saliva, unidentified
atgagtgaaagtcgtaaccaacgcaaagtctatcaaggacgtgtcgtttctgacaagatggataaaactatcacagttgttgttgaaacttacaagaatcacaaagtttacggcaaacgtgttaagtattccaagaaatttaaagcacatgacgaaaacaacgaagcaaaagttggcgatatcgtcaaaattatggaaactcgcccattgtcagctacaaaacgtttccgtttattagaaatcgttgaaaaagcagttattttgtaa

SEQ ID NO: 1876 - DNA, 2790 bp, Unknownn; identical to SEQ ID NO: 752
  isolated from saliva, unidentified

SEQ ID NO: 1877 - DNA, 732 bp, Unknownn; identical to SEQ ID NO: 926
  isolated from saliva, unidentified

SEQ ID NO: 1878 - DNA, 1275 bp, Unknownn; identical to SEQ ID NO: 1293
  isolated from saliva, unidentified

SEQ ID NO: 1879 - DNA, 687 bp, Unknownn
  isolated from saliva, unidentified
atgccaaaattagtatttatccgtcacggacaaagtgaatggaacttaaagaaccttttcacaggttgggaagacgttaacttgagtgaaaaaggtgttgaagaagctaaggaagcaggtcgtaagttaaaagaagctggtatcgaatttgaccaagcttacacatctgttttaactcgtgctatcaagactttacactttgctttggaagaatctggccaattatggattccagaaatgaagacatggcgtttaaacgaacgtcactacggtgcattacaaggtaagaacaaagcagacgctgctgaaaagtatggtgacgaacaagttcacatctggcgtcgttcttacgatgtattacctccattattgagtgcagatgatgaaggttctgcagcaaacgatcgtcgttatgctgacttagacccacgcatcattcctggtggcgaaaacttgaaagttactttggaacgtgtaattcctttctgggaagaccacattgcaccagacttattggctggtaagaacgtaatcgttgctgcacacggtaactcattacgtgctttaactaagtacatcgaacaaatctctgatgaagacatcatgaacgttgaaatggcaacaggtcaaccagttgtttacgacttggatgacaagttaaacattgtaaacaaagaaaagctttaa

SEQ ID NO: 1880 - DNA, 2859 bp, Unknownn; identical to SEQ ID NO: 1180
  isolated from saliva, unidentified

SEQ ID NO: 1881 - DNA, 1002 bp, Oribacterium sinus; identical to SEQ ID NO: 1400
  isolated from saliva, Oribacterium sinus

SEQ ID NO: 1882 - DNA, 900 bp, Unknownn; identical to SEQ ID NO: 1231
  isolated from saliva, unidentified

SEQ ID NO: 1883 - DNA, 1407 bp, Oribacterium sp.; identical to SEQ ID NO: 1154
  isolated from saliva, Oribacterium sp.

SEQ ID NO: 1884 - DNA, 1194 bp, Unknownn; identical to SEQ ID NO: 611
  isolated from saliva, unidentified

SEQ ID NO: 1885 - DNA, 750 bp, Unknownn
  isolated from saliva, unidentified
atgcaagatacgcaaatgcaagaattaatagattctgtcatgttagctggaaaaattatgattgaaagtggagctgatatggcaagagttgatgatactttaaaacgtatagctcgaaatggtggaattaaagaaccaaaaatttttgagaccaccaccggaatcatgatgtcagctccagattataaattggcacaggtagaaccaattcaaaaaagaacaattgatttagaaaaagtatcaagagttaatgatatctcacgtgcttttcaattaaaaaaaatcacagttgaagaaatgaaagtaaaattggagtttatcgataaaaaagcgccattttttgcttggacatggcaagtattggctgcagcaatgataagttgcactctgatgataatgtacaatgggcattggcaagattttatcacaactgcagttattggtggattaggttatgcttgctattactttatcaatacaacatttaaaataaagtttgtaagtgaatttttagcttcgttagtaattggtgttttatctgtattagctgttagaaacaacttaggaatatcagtaggtatgataattattgggagtgttatgccgttagtaccaggagtaccaactaccaattctgtaagggatgttttagctggtcatttattaagtggattagctaggggaacagaagcattattatcagctagtgcaattgctttagggattgcgatggttctaagattcatgtaa

SEQ ID NO: 1886 - DNA, 2082 bp, Unknownn; identical to SEQ ID NO: 809
  isolated from saliva, unidentified

SEQ ID NO: 1887 - DNA, 969 bp, Shuttleworthia satelles; identical to SEQ ID NO: 787
  isolated from saliva, Shuttleworthia satelles

SEQ ID NO: 1888 - DNA, 1950 bp, Unknownn; identical to SEQ ID NO: 904
  isolated from saliva, unidentified

SEQ ID NO: 1889 - DNA, 786 bp, Unknownn; identical to SEQ ID NO: 1428
  isolated from saliva, unidentified

SEQ ID NO: 1890 - DNA, 1032 bp, Unknownn; identical to SEQ ID NO: 1258
  isolated from saliva, unidentified

SEQ ID NO: 1891 - DNA, 657 bp, Prevotella veroralis; identical to SEQ ID NO: 669
  isolated from saliva, Prevotella veroralis

SEQ ID NO: 1892 - DNA, 795 bp, Unknownn; identical to SEQ ID NO: 1521
  isolated from saliva, unidentified

SEQ ID NO: 1893 - DNA, 882 bp, Unknownn; identical to SEQ ID NO: 749
  isolated from saliva, unidentified

SEQ ID NO: 1894 - DNA, 924 bp, Unknownn; identical to SEQ ID NO: 609
  isolated from saliva, unidentified

SEQ ID NO: 1895 - DNA, 1386 bp, Unknownn; identical to SEQ ID NO: 981
  isolated from saliva, unidentified

SEQ ID NO: 1896 - DNA, 993 bp, Unknownn; identical to SEQ ID NO: 987
  isolated from saliva, unidentified

SEQ ID NO: 1897 - DNA, 1140 bp, Unknownn; identical to SEQ ID NO: 847
  isolated from saliva, unidentified

SEQ ID NO: 1898 - DNA, 1335 bp, Unknownn; identical to SEQ ID NO: 1488
  isolated from saliva, unidentified

SEQ ID NO: 1899 - DNA, 1662 bp, Unknownn; identical to SEQ ID NO: 1001
  isolated from saliva, unidentified

SEQ ID NO: 1900 - DNA, 582 bp, Oribacterium sp.; identical to SEQ ID NO: 753
  isolated from saliva, Oribacterium sp.

SEQ ID NO: 1901 - DNA, 810 bp, Unknownn
  isolated from saliva, unidentified
atgaattttttaggagtaattaatccggttgccttacaattaggtccatttcaaattagatggtatggaataattattgctagtgcagttattctggcagtatatttatctgttttagagggaaggaaacaaaatatcttagatgatgacatctatgatttattgttgtattctctgccagtagcaattatctgtgcccgaatttactatgtagtttttgaatggtcatattattctcatcatttaagtgagacttatcgtatttgggacggtggaattgctatttatggtgcactaataggtgcagttatagttatcttgatcttttgtcgtcgccgcaatattccaacttggactttacttgatgtgattgccccaacagttatattggcacaaggtatagggcgttggggaaatttcatgaatcaagaagctcatggtgttgcaacgactttaggttttttaaaatcgttacatctacctaagtttataattaaccagatgtatatagatggaacatattatcaacctacgtttctttatgagtctctatgggatattagtggattcgttgttttaattattttgagaagacagaagaaattattaaaaagtggagaagtcgttctgtcttacataatttggtattcatttggtcgtttctttattgaaggaatgagaactgatagcttaatgttggggagcttaagggtatcacaatggttatctttaattctgtttattagtgccattacagcaatcttttacagaagatataatgatccattattgaaatggtatacagaataa

SEQ ID NO: 1902 - DNA, 843 bp, Unknownn; identical to SEQ ID NO: 1413
  isolated from saliva, unidentified

SEQ ID NO: 1903 - DNA, 1020 bp, Unknownn; identical to SEQ ID NO: 1514
  isolated from saliva, unidentified

SEQ ID NO: 1904 - DNA, 2004 bp, Unknownn; identical to SEQ ID NO: 905
  isolated from saliva, unidentified

SEQ ID NO: 1905 - DNA, 948 bp, Unknownn
  isolated from saliva, unidentified
atgtcatacgctagtgatgtaaaaaaagaacttacaatgcttgaggttcattttggtaatgctaaggctgaattaatggcgttgataagaatgaatggctcattaagtattgttaataagcaatttgttttaagtgttcaaacagaaaatccagctattgctaggcgcatctaccgtttattaaagcagttttacgatatagagagtgaattgatagttcgtcgaaagatgaaattgaagaagaataatttttatattgtacgtttaaaaactggaacaaatgaaattttaaaggatttagatatattagataattttcagattaaagaaactgttcctttagaatttttggatgacgatgccaaggtaagatcatatttacgtggggcatttttagcaactggttctgttaataatcctgaaacaagtagatatcatctagaaatttactcactatatgaagatcacaacgatacaatatgtgaaatgatgaatagatatggattaaatgcaaggaaaaccgagagaagaagtggttatattacttatctaaaagaagctgagaaaatagcagattttttatctttgataggtgcaactaatgccatgttgaaatttgaagatattagaattgttagggatatgagaaattcagttaatcgtatcgtgaattgcgaaactgctaatcttaataaaatcgcagatgcttctaaaaagcaaattgataatattaagttgattgatgctaaggtgggaattgataagttaccacagaaattacaagaagtagcaatagcgagattgggacatccagaagaaagcttaaagaatttgggtgaacttatacctggaggaccaatttctaaatctggtataaatcataggttgagaaaattaaatgaaattgccgaaaaaatacgcgctggtgaaagtattgcggtactataa

SEQ ID NO: 1906 - DNA, 1098 bp, Unknownn; identical to SEQ ID NO: 594
  isolated from saliva, unidentified

SEQ ID NO: 1907 - DNA, 708 bp, Unknownn; identical to SEQ ID NO: 836
  isolated from saliva, unidentified

SEQ ID NO: 1908 - DNA, 1149 bp, Unknownn; identical to SEQ ID NO: 783
  isolated from saliva, unidentified

SEQ ID NO: 1909 - DNA, 1185 bp, Unknownn
  isolated from saliva, unidentified
atgtttaatattatgaagaaaaaaaccttattttttcttgtcgctttatttaatctagcagctaactatgcccatccagttacacctacatattttaagatgcttcatcttgataattccgtttttggtacggcctttgcggtaatgtcctttggtatctttatcgcctctccattttggagtaagattgctggtttagttaactccaagtctgttatcgcaattggttgtatcggttatgccgttgcacaattcttatttgctgttggacatacaacaagcttgatcttaattggtcgattgcttgcaggactagcatgtggcgcatttttcgtaggtgtgcttaactatattgttaatctatccagtgaaataaatcgaggagctaacctaactcttaatgctactattcaaactgttgctagcgccttaggttactttgtcggtggaatgcttggtgcgtataatgtttatctgtcctttgcagttcaagttattcaactgactttagttggaatattattctatcttttacttgaaaaagattcgcaaaacactgatagtttgcaattatctcttatactgaaagaatcaaatccacttaaacgtctcgaagatggacgtttacttatgaataaagcttttgccttattattctctgtttcgatcttactgtatttaggatatactgcctttgatcaaagctttaactactatttaaaagatatcttcaatctttctagtagttttaacgggatctttaagggagctatcggtattatttctttgattgttaatacttcaattggtttgtacttgatgaaaaatactaaaattagtaaaagtctaatctatgtactgttaggtgcttcaactttaatggtacttatcttatttagccatcatttaactgcttatgttatcagtagttgtatattctatggtttctatgctttgagtacgccgctacttcaagatttaattacacaggaagctcaagttaagacacgtaacttagtattaggattctatcaatcaacacaatcattaggccaaatattaggtgcttacttagctggaattatctataattttagtccacaagctccattctcattagcttttcttgccctgctaggagcatttctttgttcgatcttttatagaagaatgtatagaatttaa

SEQ ID NO: 1910 - DNA, 576 bp, Unknownn
  isolated from saliva, unidentified
acaccacgatatttacaggcaataatgccatatgtaaatcaagtagaagaattattaggaaaaaagaccaattatacacttgaaagtggagaacagaagaataaagtacaaacagataatgttaaatatgacaataaccgttggcctaacaatacagccacagtctatatagacattgatgatagtactttatacaatgcctttgtgtcagcgataaagcagtggaataatactggtgcatttacatttaagattgtgaatgataagaaagacgcagacatagtaggtaagttaatggaaaatgatgatggaactgcaggaacgacagatactacaactgacgagcaaactaagcgaattattaaagctacagtttacttaaatcgttattatctagaaagtgccacatatggttacagtgaacaacgaattgttaatactgctgaacatgaattgggacatgcgataggactagatcatacggatgaagtatcagttatgcagccagcaggatcttattatacgattcagccacgcgatgtagatgtcgttaagaaactatatcaggaaaattaa

SEQ ID NO: 1911 - DNA, 759 bp, Unknownn; identical to SEQ ID NO: 1394
  isolated from saliva, unidentified

SEQ ID NO: 1912 - DNA, 1074 bp, Unknownn; identical to SEQ ID NO: 1518
  isolated from saliva, unidentified

SEQ ID NO: 1913 - DNA, 360 bp, Unknownn
  isolated from saliva, unidentified
atgactaaagaagaaaaaatggaacaaatcaagctcagttttgaaaatctatctcaactattcgaagtattaggcgatcaaaatcgacaacatctcatctatactctcttttctcttccttgcaagtccaaaggtggtgtccgcgttggagagattacagaaaagacacacctttctcgacctgctgtttcacaccatttaaaactactgaaacaagttgggattgtcggcatgagaaaagaaggtactaagaatttctattatttggaaactaatactcaacaatggcatgatctttccaaattatcacaagatatcatctctttgattcaagaaatcaacttggagggcaacaattaa

SEQ ID NO: 1914 - DNA, 1485 bp, Unknownn
  isolated from saliva, unidentified
atgactgaaaagggaaaagagcagaatgcattatttataatttttggtgctactggtgatttagcacaaagaaaattatacccttctttatttaatttatataaaaaaggttttctttgtaaaagatttgctgtaattggcactgcacgtagaccgtggactgatgaacattttcaacaagtagtaaggaattctatttccggaatggaagatactgctgcccaagcaacagaattttctcgccatttttattatcaatctcataatgtaaatgatgtagagcattacgttacattgaagaaattggcagagaaactggatgagaaatataaaattaatggtaatagattattctatttagcaatgtctccacgattctttggaacaatatgtaagtatctaaaatctgaagaaattgtgacagatgaaggttataatagggtaattattgaaaagccatttggtcatgacttacaaagtgcagttgaattaaatgatgagattgcaaaatacttctctgaagaatctgtatatcgtattgatcattatctcggtaaagaaatgaatcaaaatattttagctgttagatttggtaataatattttccgtgctctatggaataatagatacattgataatattcaaatcactttgagtgaatctctaggtgttgaagatagagcagggtattatgaaacagcaggtgcattgagagatatggttcaaaatcatattttacaaattgtttcattattaacaatgaatgcaccagtaacttttactgatgttgatattcgccgtgaaaaaattagtgcattaaaagctttacaattgtatactccagaagaagttaaaaaatattttgttcgtggacaatatgctcatacagaagatttaaatggttatcgtgaagaagatcaagtagatccaaattcgactactgaaacttttgttgctggaaaacttcatgttaatagtatgaattttgctggggttccaatttatattagaacaggtaagagattagctgcaaaagctactcgtgttgacgtagtatttaagaatatgcctaataacatttttaatgctaataagaaattgttacctaatgttttgtcatttgatattgatgcaaatccaggtatgagtttaactcttaatactaagaaagttagtcaatcaggatataaattggaaaatagagcattgagctaccgtcatgatatctcaacacaagcaattacaccagaggcttatgagaaactaattttagatgcggtaaaaggcgatgctactaattttgttcattgggaagaagtttactattcttggagatttattgattccgttagaacagcatgggataatgaagatgtagcccctgatgaattgacaaattataattgtaatactatggggccaaaaatttctgatgaactactagctaaggatggaaattactggttctttgatccaactaaataa

SEQ ID NO: 1915 - DNA, 552 bp, Unknownn
  isolated from saliva, unidentified
atgaataataaaaatgatgaaaaaccttgggaaaagacatttgaagaagatcgtgatgaacagggtaactattcacgaacagcaaatcgtagaaatgccaaaaataatacaatgttaacaacgtcacttctaatcatttttatagtgataattgttggaacaattgcattgtattttatatcacagaaatctgaatctaagcctgctagtagctctcaaattaatacagtggttacaagtaaaaagactagtgtgaaagaaaaaactgctactagtaagaaaaagaaaagtaataccaaagataaatcatctgttaaaagcgtagatgcaactgaagatacaactactactgatagtcaagaaggtactgttagtgaatctagtagttcttctagctctagcaatagcgaagctaaatacgtaacagtttcttctggacaaggaatttatcgagtagctgttaataatggtctaactgttgatcaattattacaattaaatccaggcatgggttcaaacttaaaccctggacaacaagtacgtgttaaataa

SEQ ID NO: 1916 - DNA, 660 bp, Unknownn; identical to SEQ ID NO: 1113
  isolated from saliva, unidentified

SEQ ID NO: 1917 - DNA, 366 bp, Unknownn
  isolated from saliva, unidentified
gtgaaaattgtgatttcaaaaccagacaagaataagacacgtcaaaaacgtcatgcacgtgtccgtggtaaaatctctggtactgctgagtgcccacgcttaaatgtttatcgttcaaacaaaaacatctacgctcaagttattgatgacgtagcgggtgtgacgctagttagtgcctctactttagacagtgaagtaagtggcaacacaaagacagaacaagctagttctgtaggtgctgttgttgctaaacgtgctgtagaaaaaggtatcaaagaagttgtatttgaccgtggcggatacctatatcatggtcgtgtacaagctttggctgaagctgcacgcgaaaatggtttggacttttag

SEQ ID NO: 1918 - DNA, 747 bp, Unknownn; identical to SEQ ID NO: 1306
  isolated from saliva, unidentified

SEQ ID NO: 1919 - DNA, 1398 bp, Unknownn; identical to SEQ ID NO: 1415
  isolated from saliva, unidentified

SEQ ID NO: 1920 - DNA, 813 bp, Unknownn; identical to SEQ ID NO: 846
  isolated from saliva, unidentified

SEQ ID NO: 1921 - DNA, 978 bp, Unknownn; identical to SEQ ID NO: 763
  isolated from saliva, unidentified

SEQ ID NO: 1922 - DNA, 456 bp, Unknownn
  isolated from saliva, unidentified
atggctaatgtaaaagttgtatttgcaacaattacaggaaataatgaagatgttgctgatattatcgcagaagcattagaaaacaaaggaattacagttgacgttgaagaaatttcacaagttgatgcttttgacctagaagagttcgatggtgttattgtatgtccttacacatatgacgaaggggcattacctgatgaaggaatggacttttatgaagatttggcagatgttgatctatcaggtaaagtttatggtgttgcaggttcaggcgatacattctatggtgaatacttctgtacagctgttgacgattttggaacacaattagctaaggctggtgctactaagggtgctgaaaatgtaaaaattaatctggcacctgattcagatgaagatattgaaatcttagaaaactttgccggtgaatttgctgctaaattggaggaaaattaa

SEQ ID NO: 1923 - DNA, 831 bp, Unknownn; identical to SEQ ID NO: 1402
  isolated from saliva, unidentified

SEQ ID NO: 1924 - DNA, 639 bp, Unknownn
  isolated from saliva, unidentified
atgttagagttaaagaatattagtaagagctttggtgataaagttattctaaataatttaaatttagaagttaaagatggtgaaattttatgcatcgttggtcaatctggtggtggtaaaacaacccttttaagatgtattagtggacttgaaaagattgatggcggtcaaattttaattgatggtcaagtatttgatccatatacaaatgaaaataatgattctgttatcggggtagtattccaagaatataacttattcccacaccttacagttttacaaaacgtaactttagcacctactatggttttaaaaaagaaaaaagaaattgctgaaaatgaagctaagaatttattaaatggtttagctttagaaggaaaagaaggattatatccattccaattatctggtggtcaaaaacaacgtgtggcaattgcacgagctttagcgatgaaaccacaaattttatgttatgatgaaccaacttctgctttggatccaggattgacagctacagttaaagatatcgttttgaatttgaaaaaagaaggaatgacacaaattatagtaactcacgatatggattttgcagaagagattgcggataatattttgaaagtgaaacctttaggctattaa

SEQ ID NO: 1925 - DNA, 1914 bp, Unknownn; identical to SEQ ID NO: 930
  isolated from saliva, unidentified

SEQ ID NO: 1926 - DNA, 948 bp, Unknownn
  isolated from saliva, unidentified
atgacgaaaattagtattattgtgccaatttataatgtagaaaaatatttaaaaagatccttagatagcttagtgaatcaaacactagaagatatagaaattattttagtagatgatggaagtactgataattctcataaaattgctgaagattataaagaaaattattctaatgtattactagttactaaagaaaatggtgggttgtctgatgcaagaaacttcggtttacagtatgcatcaggagagtatattgcttttattgactccgatgattacgttgaaagtcaaatgtttgagagaatgtataatttatcggaaaatggtcgaaaaaaaattattgaaagcaattttctttggaaattcccagataaaaacgtaaaagatgtagtaaagaaatataattcattaaatgaatacttagtaaaaggtagagtagtagcttggaataaaatttataaaaagtcatggttagatacattggattttaagttcccagttggacgattatatgaggatcaggacttctttttcaagatggttgctaatttacaaaatatagaggaaatagctgtagatgatcatataggagttcattatgtacaaagaagtaattcgatttcttataatgaatctacaagaattagggatattttttggatatacaatgatataattgaatattatcgggtacataaagtaacatgttataaagatgagatggaatatagatttactagaaacttactgggaaatgtattgattagaaaagttttaaagcaaaaagataggaaattaaaaagagaattattatctgaaataaaaaattatattgatacaaattttccaaattggaaaagaaataaatatctcagtgaaagaagtaaacaaaatctatatttaaaaatggtaaattcactaacatataagttattctatttatattag

SEQ ID NO: 1927 - DNA, 663 bp, Unknownn
  isolated from saliva, unidentified
atgggcgatcgtgttacagttctttcaactaaatatcattggaaaaaggtcaaaacttcagagggagaagttggttggattcaagattggaactttcaacaacaaaataaaattactagtttatcagatgctactatcgtaatcgatgctggacatggtggctctgattcgggtgccctatctcgtacaaataaaaatgaaaagacatatacgcttatctatgctaaaaaattagcagaaagattgagaaaggctggagcgatggtctatatgactcgagatgatgatagctttgtgagtttaaatagtcgaccacaactagcagaaaatctacatgcggatgcttttattagtattcattttgactctgcacctgaaaataacatggggtcaggatataccacttactattaccataagaagacatctttaagattagcacaagacatcaacagtaagttaaaatacttaaaattagaaaatcgtggggttgaatttggtgattttcttgtaattcgtgaaaatactgtaccagcagttttacttgaaatgggatatattaattcagatagagatttcgaaagaattacttctactagttatcaagatagtgttgctgatgatattaaacaaggattagatacatattttaatcaaaactaa

SEQ ID NO: 1928 - DNA, 666 bp, Unknownn
  isolated from saliva, unidentified
atggaaaaaattggaggaacggttagcatgaagaaattagatagagaaaatattaataaaagatacatctatcattttttcaaacgagtttttgattttttcgctagtttagtaggattaatcttgttatcgccgttgttattatacatagcatttagaatccataaagaagatagaggaccagtattttattctcaaactagagttggaaaagacggtaaagaatttgaaatgtataaatttcgttctatgattgtggatgctgataagaaattagctgaattaaaatctcaaaatgaagtagagggtccaatgtttaagatgaaagaagatcctcgaattacaaaaattggtaaatttattcgcaagcatagttttgatgagttgccacaacttttaaatgtgcttaagggtgacatgagtctagtaggacctcgtccacctttgccaagtgaagttgctcaatacacagattatgataagcaaaggctattagtagtccctggttgtacaggactttggcaagcaacggttagaaatagtgtaggcttttctgaaatggttaaattggatttagaatacattcaaaagagtggttttttctatgatctatatttgatctttttaacagttaaaattgtactgttctctaatgatgcgtattaa

SEQ ID NO: 1929 - DNA, 897 bp, Unknownn
  isolated from saliva, unidentified
atgaatttacaacaattacaatatcttcatgtcttagctcagactgagaattatacacaggctgctgaaatgttacatattacacaaccttctttaagttacgcgattagttccttagagagtcaagttaatatcaaattattcgaaaaatccggtcgaaacattaagttaactcgtagtgggaaaatctttgttgaagaaagcttagctgctatcgaatcactcaatcgtgctattgaaagagccaagaaatccgaaaataacaaagaagttattaaaatttcaatgctacgttctattagttctcactggttaccaactactattcgaaaatttttagatgatattcctgaagaaaaacaaccttcctttgaatttgaaagtggtatcggtttttcacactcaatcttagatgaattaagagaagaaaaagtagacgttgcattctgttcaaagattgataacttggatgatgttgattatttccctgtatatgaacaaaaattaaaattcataactccactagatcatcccttagctaataaaaataaaattaatttgaaagatactttagattttaaatatattacttattcttctaatactggtttatgtgcggaaactgaacaactattttcaatttgcggtggcacccctgatagtgtcttcgaagttgacgaagatgaaaccgtagctggtatggttgcggctaactttggtgtaggaattgtcccagaaatgccaattcttagaacattagatgttaaacaaatcccaattgagtttcctaaatggcatcgcttcatctacatggctactcttaagcgtcattaccaatctccagctgctttagatttcatcaattttattaaacaaaattccgatgctggaaaataa

SEQ ID NO: 1930 - DNA, 2172 bp, Unknownn; identical to SEQ ID NO: 1495
  isolated from saliva, unidentified

SEQ ID NO: 1931 - DNA, 1206 bp, Unknownn; identical to SEQ ID NO: 1294
  isolated from saliva, unidentified

SEQ ID NO: 1932 - DNA, 1923 bp, Unknownn; identical to SEQ ID NO: 1383
  isolated from saliva, unidentified

SEQ ID NO: 1933 - DNA, 2094 bp, Unknownn; identical to SEQ ID NO: 1484
  isolated from saliva, unidentified

SEQ ID NO: 1934 - DNA, 1302 bp, Unknownn; identical to SEQ ID NO: 973
  isolated from saliva, unidentified

SEQ ID NO: 1935 - DNA, 1437 bp, Unknownn; identical to SEQ ID NO: 1079
  isolated from saliva, unidentified

SEQ ID NO: 1936 - DNA, 2574 bp, Unknownn; identical to SEQ ID NO: 1298
  isolated from saliva, unidentified

SEQ ID NO: 1937 - DNA, 1512 bp, Unknownn; identical to SEQ ID NO: 1348
  isolated from saliva, unidentified

SEQ ID NO: 1938 - DNA, 921 bp, Unknownn; identical to SEQ ID NO: 1360
  isolated from saliva, unidentified

SEQ ID NO: 1939 - DNA, 966 bp, Unknownn; identical to SEQ ID NO: 925
  isolated from saliva, unidentified

SEQ ID NO: 1940 - DNA, 846 bp, Unknownn; identical to SEQ ID NO: 1159
  isolated from saliva, unidentified

SEQ ID NO: 1941 - DNA, 405 bp, Unknownn
  isolated from saliva, unidentified
atgtcaaaaaatttcagaaatgtaatcaattgttttacaaacggagtcggatatggtgcaacaacttttttattgtttgttgcctttgatgggtttcagagtgtaacaacatttaatgtgctaagtgttttaatcattagtgggttaattggggtgctgactttagtttttgacctagataattggtcatacttggttgaactgttgctccattttctcggggcctttagtttgattctagtgatgatgtggttgaatcattggctgagcttacaaaattggttgaatttttgcatcagctttataggaatttatttaattatcttttttattgtcaagatgaaaatagcttctgatgtcaaacgggttaatcaaaaattgtctgaacggcatcagaagaaatga

SEQ ID NO: 1942 - DNA, 3102 bp, Unknownn; identical to SEQ ID NO: 635
  isolated from saliva, unidentified

SEQ ID NO: 1943 - DNA, 1149 bp, Unknownn; identical to SEQ ID NO: 1475
  isolated from saliva, unidentified

SEQ ID NO: 1944 - DNA, 585 bp, Unknownn
  isolated from saliva, unidentified
atggcatatccacaattagatttggtaaatgtaaaaggaccaaaggcaacaatcaaaacaaatcatggtgaaattttaatccaacttttccctgaacaagcacctaagacagttgaaaactttgttggtttagcaaagaaaggttactatgacggagtaatcttccaccgcgttatcaatgacttcatgatccaaggtggcgatccaactggaacaggtatgggtggcgaaagtatctggggagcaccatttgaagatgaattttcaaatgaattattcaacattcgtggagctttatctatggctaatgctggcccagctacaaatggaagtcaattctttatcgttcaaaaccaaaacgtacctgcacaaatggcaggacaaatggaagcagctggctatccaaaagaaatcatcactgcctatgaaaatggtggtacaccttggttagatcatcgccacactgtttttggacaagtaacatctggcatggatgtagttgatgaaattgcagcagttgaaagagatatggctgacaaaccaaaagaagacgttgtaattgaaacagttgaaattgctgagtaa

SEQ ID NO: 1945 - DNA, 813 bp, Unknownn
  isolated from saliva, unidentified
atgtctgattctattactaatatttttgttatctctgattcagttggcgaaactggtcttagtttaattactgcaggtaccgttcaatttcctaatagtaaatttaacattcgccgttttccactaacaaaaactatttccttacttcaaggtattttgaataaggcaaaaagagaaaatgccattattttacatacttttgttaatcctgaattatctgactatgttaataattttggtaaagaaaataacttgcatgttattgatgctctaactggtgtggtccaaactttagccgagataactggagaaaaacctttaaatgcagctggattaaagcacaaactcaatccagactatttcaagcgtattgaagctcttgaatttgcagttacctatgatgatggtaaagatccatctggtttccttaaagcagatattgtacttttaggtgtttccagaacatctaaaacacctttatcattatatcttgctaaccaaggatataaggttgccaatcttccactagttcctaaaactcaaattcctaaagaaatttatcaagttgataaaaaacgtatcttcggcttgactaatgatcctgaagttttaaacaatattagacgtcaacgcatgatttcttatggtctagatccagatactgtttattcaaatatggataatattaatcaagaattagaatttgcaactaatctatataaagaattaggatgcttacaaattaatgtagcaactaaatctattgaagaaacagcaacacttattattgaaagtcttgatagtgaagattaa

SEQ ID NO: 1946 - DNA, 786 bp, Unknownn; identical to SEQ ID NO: 1453
  isolated from saliva, unidentified

SEQ ID NO: 1947 - DNA, 1434 bp, Selenomonas sputigena; identical to SEQ ID NO: 727
  isolated from saliva, Selenomonas sputigena

SEQ ID NO: 1948 - DNA, 624 bp, Unknownn; identical to SEQ ID NO: 840
  isolated from saliva, unidentified

SEQ ID NO: 1949 - DNA, 795 bp, Unknownn
  isolated from saliva, unidentified
atgaataaattacttttaggaagatatatcaatggtaattctttaattcatagaatggatcctcgaagtaaattagcactaagtttctattttataggaataatttttctcgctaataactggcaaacatatttattgttgatagcttttacttttttgggagtactgttatcaaaaattaaattgagcttttttattagaggaataataccattagtttggttaatattatttacagtattattgcaagtattttttacaaatggtggccatgtattttggcattggggtccctttacattatctaaatatggattagtaaatggtatctatgtattttttagatttgtcttgataatagtgatgtctaccttgttaacattaacaacatcgccattagaaatttcagatgctatggagtcattgttaaagccattgaaatatttgaaggttccagtatatgaaatttctctaatgctttcgatagcattaagatttgtacctactttaatggatgaaacagctaaaataatgaatgctcagcgttcaagaggtgttaattttggtgaaggctcattagttgagcaagtaaaagctgtaattcctatactaatcccattgtttgtatcttctttcaatcgagctgaagatttggctactgctatggaagctcgaggatacaaaggtggagagggtagaactaaatttagagtacatgtatggaaattgcgtgatacgatgactatcattgcttttgcagttttaacaatagcattaattattctaaaaaactaa

SEQ ID NO: 1950 - DNA, 1161 bp, Unknownn
  isolated from saliva, unidentified
gtggacaatacaaaatacagtagtttggtgaaacaattggttgacgatttaaaaggtatttttaccaccgctggtttaggtggagaacctggagaatataaactattaacccagtcatttctgtacaagtttatcaatgataagttcttgtatgaggctaaggtatttgatgccaaaaatgactatgacacgattatgaaaatgacagatgatgattatgagttcttacagatggacctgggtaacaaatctgccaagattaagcgagaagatctgatagaaagcttgtttaaccatcaaaatgaggatggattctatactttatttgatgcaactctgaatgatattgctgttgataacaatgatatctactcagtagaaactgctggaaataccgaagtacgtttgtttgatagtaacttgcttcgggataatattttagatgggtctcaaagagatgtcgttgcacgagcaattatcaataaattatctgaaactaagtttgatgaacacattttttcagctggttttgacttcttctcaaccatctttgaatacatgattaaggactataacaaagatggtggtggtaagtatgctgaatactatactccacatgcagtagctaaaattattgctcaaattttagttggaaatgatcagccacaaaatgttcgaatttatgatccggctgctggttcaggaagcttattaatgaatttggcaagtcagattgggactgatcggacgactgtttatagccaagatatttcgcaaaaatcttcaaaccttttgcgtttgaatttaattttgaatgggctgagtcactcaattcgtaacattgtgcaaggaaatacgattctgaataataagcacccggaaaagatgaactttattgtatctaacccaccttttaagttagatttctcagaatggcgggatgatgttgaagcactacctgagtataatgatcgtttttttgctggggtgcctaagattcctgcgaagaaaaaatcatcaatggcaatttaccaactattcatccaacatatagtttattctttaaaggaaaacggtaaggctgccattgtggtaccaactggtttcttgacggcacaagcagggattgacaaaaaaattcgccaaaagttggttgattaa

SEQ ID NO: 1951 - DNA, 450 bp, Unknownn
  isolated from saliva, unidentified
atgaagattatttttacagaagatgttcgaggtaagggacgtcgcggagaaattaaagaacttccagatggctatgctaatttcttaattaagcaaaataaagcaaagcaagctaatgcacaagcaatgagccaattaaaaggccaaaagcgtgctgaagctagaaaagaagcagaagaactagaagaagctaagaagtttaaagaactacttgaatcaggtgaaagagtagtagaaatgaaagctaaagctggaactgatggacgtttatttggttcaattactagcaaacaaatttctcaagaacttgaaaagcaatacggtatgaaaattgataagcgtaaaatggaattacgtgaaccaattcgtacaatgggatatgtaaatgttcctgtaaaacttcacaatgaagtaacagctaaaataagagttcatatttctgaaaaataa

SEQ ID NO: 1952 - DNA, 789 bp, Unknownn; identical to SEQ ID NO: 816
  isolated from saliva, unidentified

SEQ ID NO: 1953 - DNA, 1932 bp, Unknownn; identical to SEQ ID NO: 426
  isolated from saliva, unidentified

SEQ ID NO: 1954 - DNA, 1512 bp, Unknownn; identical to SEQ ID NO: 246
  isolated from saliva, unidentified

SEQ ID NO: 1955 - DNA, 363 bp, Unknownn
  isolated from saliva, unidentified
atggatactgagatattgcgaggcatatttatgaagattgatccacaattttgtcgtgttgatgatggtttagatactattttgggtaaatggaaaataccaatcatcttatatctactaaaaaatcagactatgcgtttctcagatttacaaaaagttctccctgaaatttcaaagaaaatgttatccaagaatctcaaagaacttgaagaagatgatttaatcactagaacagtctaccccactgtcccacctaaagttgaatatagtcttactgaacatggaaaagaacttgaagatatcattgatagtcttcacaaatggggcttacgtcatcaacaacacctatcaaaaaaagcttga

SEQ ID NO: 1956 - DNA, 348 bp, Unknownn
  isolated from saliva, unidentified
atggctgaacaagttacatcagcaaaagcaactgccaagacagttcgaatccctgcacgtaaagcacgtctagtgatcgatcttatccgtggtaagagtgttgctgaagcatttggtatcttgaagtttactccaagatcaggtgcttacttaatcgaaaaagtattaaagtctgctgttgctaatgcagaaaacaattttgacttagatgttgaagatttgtatgtaagcgaagcttttgtaaatgaaggaccaactttgaaacgcttccgtcctcgtgctaaaggttccgcttctccaatcaacaaacgtacaagccacatcactgttgtggtatcagttaaataa

SEQ ID NO: 1957 - DNA, 714 bp, Unknownn; identical to SEQ ID NO: 1016
  isolated from saliva, unidentified

SEQ ID NO: 1958 - DNA, 1302 bp, Unknownn; identical to SEQ ID NO: 955
  isolated from saliva, unidentified

SEQ ID NO: 1959 - DNA, 873 bp, Unknownn; identical to SEQ ID NO: 1435
  isolated from saliva, unidentified

SEQ ID NO: 1960 - DNA, 1200 bp, Unknownn; identical to SEQ ID NO: 1393
  isolated from saliva, unidentified

SEQ ID NO: 1961 - DNA, 1008 bp, Unknownn
  isolated from saliva, unidentified
atgtataattacactgtttgtactactatagaggtatataaaattcgaagggagaagagtgatttgcatatatttcatgatgctaagggttctagtcatgcaaaaattattttaattggtgaacatgctgtcgtatatggtcatccagcaatcgctctgccattaaaaaccgtaaccgcaactgcaagtattaaagttataccatcatcaagtgaacaaactattacaagttcttactatgatggttcagttgatgatatgcctaaaaatatgctcggtattaagaaattaattttaaaattagtttctgatttacgtatagaaaatggatttgagttacatttatccagtcaattacccgcagaaagaggtatgggatcttcagctgccgttgcgatttctattattcgttgtttttacaacgctaccgatactagaattaatcataaaaaactattatcatacgctgatattgctgaaaaagttactcataacaatcctagcggtttagatgctacaactagtgctagcgataatcctatctggttaattcgtaataaagaaattacacctattccaattaacctagatgcttatctactaattagtgatagcggtattaaaggtcaaacaagtgaagcaataaaaattgttaaagaccaacttaatacagacgaaatatcaacttcatcaaagttagctgcattaggtagattagcacaaaccactagagatcaactggctaataatgatatagtaggactcggaaaaacatttactttagcccaaaaagatttaatttctttaggtgttagcactcctaaattagataatcttattaatatagcacttaaaaacggttcactaggtagtaaacttactggtggtggtcgtggtggatgttttatcagtttattgaagacaaaaaaagaggcagaagtacttgctaaaattttaaatcaacacggggttactaaaaattggatagagcccctatcgaatctttag

SEQ ID NO: 1962 - DNA, 726 bp, Unknownn; identical to SEQ ID NO: 806
  isolated from saliva, unidentified

SEQ ID NO: 1963 - DNA, 1935 bp, Unknownn; identical to SEQ ID NO: 1085
  isolated from saliva, unidentified

SEQ ID NO: 1964 - DNA, 789 bp, Unknownn; identical to SEQ ID NO: 548
  isolated from saliva, unidentified

SEQ ID NO: 1965 - DNA, 1539 bp, Unknownn
  isolated from saliva, unidentified
atgaaatttgatacgagtagatttatatttatagttaaaggattattagttggagcggcagtaggaattgtagttagtttatttcgactattaattgaaaaatttttagtatttatcaagtttttgtttatgcaagcccataataattcaatctattttataattttagcaattataatgttggtatctttaatagctaattcaaaattcattaaggatgaaccaaatattaagggatcaggtattccccaagtcgaaggacaacttgctggagaattggaaatgaactggtggtctgttctttggcgtaaatgggttggtggaattttaagtatcggaataggcctatttttagggcgtgaaggtccatcaattcaattaggagcagcagtaggacaggggatagctgaaagaacaaatcatcgcggttctggtagaagaattttaattgctggaggggcttcagcaggattatctgcagcttttaatgcaccaattgcatcaacattatttattcttgaagaggtttatcataatttttctccattagtttggacaacttctttagcagcggcaattgcggctaattttgtttctttaaatttttttggtttaacaccagtattacatatgtcttataaattagcttttcccattcattattatatccatctagtattattgggaatttttttaggactcttaggatatgtttatcaatacttaactttaaatgtcgatagattttataaactatttaaatttatccctagtaattggttagcaataattcccataatattattatttcctttagggtactttttaccagacactttaggtggaggtaatagtttaattcttgaaataggtggtaatattccgacggtatggctacttttaggtattttcttattaagattactattttctactttatcttacggtagtggattgcctggtggaattttcttgcctattttgacaattggagctactttaggagctttatatggagttgttgcagctcattttggtttattgccagataaatatattgttgactgtattatttatgccatggcaggttattttgcttgtatagggaaagcgccatttacggcgattctcttaattaccgaaatggtaggttctttgcatcatttaatgccattagcagtcgtatcactaacagcatatacagttgttgatttattacgtggacgcccaatttacgaagcattgttagaaaaatctcttaaacgttatacaccacatccagatgagtttacagatcaattagaaattcctgtatttgcaggttcatatttacaagacaaacaagttagagatataacatggcctaaagaatgcttattagtggcaattcaacgtggagaaaaacaaacaatcccacatggtgatacgttaattagaagtggtgatactcttgtaattgagactggagatgctcatcgtgcagaagtggcaagaaaaattggacatgttgctaatgacatttccaactggaaaaactag

SEQ ID NO: 1966 - DNA, 612 bp, Unknownn
  isolated from saliva, unidentified
atgactaattattattattcttcaaacccagatgtagaacataaagaaaaaaagtggaatttcgaattgctgggaaataacatacattttacaacagataatggagttttttcaaaaaatacagttgattttggtacaagagtactattagaaactattgatgctaatttagatttagataataaaaaaatactagatatgggttgcggttatggccctattggattgtcaatagcaaaagcatatccaaatagtcagatagatatggtagatgtcaatgaactagcccttgaattagccaagaaaaatgcagcaaataacaatataaataacgttgaaatttttaaatctagtcaatatgaagacattaatgaaactgattatgacttgataattacaaatccacctataagagcgggaaaagatgttgtccatggaattttagcaggatcaaagcaacatttaaattccggtggcagtattgtggctgtaattcaaaagaaacagggtgcaccttctgcgataaagaaattaaatgaagtatttgaaaattgtcaaactttaaataagaagaagggatattttattttacaaagcgaaatgattaaatag

SEQ ID NO: 1967 - DNA, 960 bp, Unknownn
  isolated from saliva, unidentified
atgaggaaaaaatacttagttacagggggagctgggtttatcggttcaaacctaattgaaaaaatcatttcacaaggagatgaagttgttgttgtaggtaggcatctaccagctgaatgcaaagaagatgataataatttaaaagataatattactttttatcaggctgacgttacttattatgagtttatggaacagttactaatcaaagaaaaatttgattatattgtattattagctgcagttattagtatttcaggtacaatagctgagcctcttagcacacattttattaaccaagaagcaattttatatatttatgaaatcattcgaaagaacaagttaaaggtaaaaaaggtactgtttacatcctcgtcagctgtgtatgggaacattgctgatacacctaggcgtgaagatatgccagtaagtcttgaaaatccttatgcaatagacaaatttgcaagtgaaagatatgctatgttttacgaaaaagtctatggtattccaacagttgctgtgcgtttctttaatgtatacgggcctaggcaaaaagcacaggggaaatctgcaggtgtatgtgcaattatcttagactgtttgcttaatgacaaggaatttagattaaatggtgatggaaagcaaacacgtgattatatgtatgtaacagatgcagttgatgctactttgatgttactgaaagacccccaaataagtggaaaaatcttcaatgttgcttctggaaaatcggtaagtttaatagacttaatagtagcttttgaagaaattacaggtaaaaagctaaaaattatacataacaagggtttgaaatttgataccaaaaattcacttgcggatatcacgaagcttgaaaaaaccggcttccttcctaaatatacgtttgaatcaggattgagacaatatgtaaaagaagaaaaacgccggttggggtatagttag

SEQ ID NO: 1968 - DNA, 918 bp, Unknownn; identical to SEQ ID NO: 629
  isolated from saliva, unidentified

SEQ ID NO: 1969 - DNA, 993 bp, Unknownn; identical to SEQ ID NO: 884
  isolated from saliva, unidentified

SEQ ID NO: 1970 - DNA, 822 bp, Unknownn
  isolated from saliva, unidentified
atggagtacccttatcgtgaaaaatttctatcttgggctaaagatgttaaacattatcgtgaaagtaccgtaatgttgtacgattataccgtcaatagtttctataactatttttatagtcaatcagaacatggtaatgatattcgtcttgtccgacctcaagatatcactaactatcttgtaaatattcaagaacaacatcatattgttgctaatactgctaataaatactattttcacttgaaaaagtattttacttttctctatagtaatcagttgattgatgaatatcctttaatcgatttaaaaacttacaaagtcaataaatacactaatattacacttggttggcagcaatatctacctgaaattttcaaaattgcggaactttctgatgatgcaaaattagaactttttctaatctctcaaaatatcgaaccaaagggattacttaatattacttttggacagcttcgaaactttaatacagaaaatattggaattttgctagataatattgaagtaaaacctgataattatttcgtattctcactaaaaaacgatcctgaaaaaccattgaattcgttaaattcattattaatgagagttagacctgatgaagaaattttgaatatgacactagctccttcaaaattaagacagagttacatttacaattatctccttactaataaagataaatccgaaattgaacttctagatcatcttcatctatctattaagtcattagtatattatcgtcaaaacttgctcaatattgattttaataattttgtttatgaaactccaaaagaaaagtag

SEQ ID NO: 1971 - DNA, 843 bp, Unknownn
  isolated from saliva, unidentified
atgaagaaaataattacagattcagcagcaaatttaaatgtaactaaattgaatggtattgaatatcagagtgtaggtttaactttagtttgtggggataaagtatttttagatggtgctgattttgatcaagtggagttcgataagtttatcgaaaacagttcaacagaaataaaatcttcttgtcctagtgttgaaagttacttggcagcaatgggggatgctgatgaagtatatatttttacaatttcaagtgcgctttcgggttcatacaatactgcgcaaacagctaaaaaaatgattttagaggaagatccaaatagaaaaatacacgtttttgatacaaaagcagcaggtccagcagagcgtatggcagctgttaaagctagtgaattattgaatgaaggggtagacttttctgaagtagtagcacaagttcaagcttatatcgatcatgtgaagatcttttttagcttacagtcattaacgaatttagcaaataacggtcgaataaataaaactgttgcgaaacttgcaggagttttaaaaattaatgtgctaggttgggctaacgaagaaggaaagattgaacaattaggaaaagcacgtggagctaaacgagcatatcaatctttggtagatatattggttaagcataatcttaatagtaaaaaagtggtaattgatcacgcaaacaatgaaaaaggtgcattagctttgaaggacttaattcaagcaaagtatcctaattgtcagatagaaattggaatttgtacagcactatgtagcttttacgcagaaaaagggggtttaatggttggctgtactgtgaatgatggttaa

SEQ ID NO: 1972 - DNA, 810 bp, Unknownn
  isolated from saliva, unidentified
ttggctattcttccagaagcatggtttgttaattttattattttaagtgtgcttctaattctcttacttgcttgtttgtcagcaacggcaagaagacttagagacgttggatatagtggttggtttactttcctatcttttattccttattgtgtaggacttataatacttttatttttcacaacaaaaccctctaaaaaagaaaacaataagtacatagaagatacacaatctaatttgggcaagtttcttatgcaatcgaatagatcatttattggttctttattagtattagctttattatttggtgctattggcgcaacagatactgataataacagtggaaataacaatagttcttttgctgcgaataaacacagttcaaagcataagaataatagcagtcgccataaaaagaaaagtagttcttcaagtaaaaaggatgaagataaacatgaaagtagtagttcttctgaaaattctagttcatctagcgtagtagaagattatcatcctataacttatgatgaattagctcgtaatccccaaagtcatatgagtgagcatattcaagtttctggtagtgtagtacaggttgtagagagttctaaagcgttactcgtagacttaaatgatgacccagaccaagcagttattgtaagaatgttaaagagtaataataataaccgtattttagaaggtgattgggtaaacattcaaggaaccagtgttggaacaatagattataaaactgtaatgggaaacacaagaactgttcctgctattaccactacaaatataacaagataa

SEQ ID NO: 1973 - DNA, 867 bp, Unknownn
  isolated from saliva, unidentified
atgaagctaacaacaacggacttaacaaaaagatatggtcaaaaaacggtagttaaaaatctgaatcttgaaataccggctcaatcgttagttgcctttctagggaataatggtgctggcaagtcgacaacaatttcgatgctgattggtttgttgaaaccaactgctggtcaaattaattttcttgatgagcataatcaaccatgccaacccaaaattggagtagtttttcaaaatagtattcttgataatgaattgaccgtcaaagaaaatttgtattttcgggcaatgatgcagggaaaacagtcggttgctaatattggaaaagtgacagaggttttgggattgagcaacttccttgagcaaaaatatggtagtttatccggtggtcaaaaacgacgtgttgatattgcgcgtgccttattgaatgaccccgactttttatttttagatgagccaactactggattagatattcaaactcggacggtcatttggcagctgttaaatgatctgcgtcaaaaaaataatttgactatttttttaacaacacattacttagaagaagctcatgatgctaatctggtttatatcgttaatcaaggggcagtcattgcttgtggttctgcagcagaaataattgcagcaaatactgagaattatcttgagattaggacatcgcacaagtttgcctttccagctaattgtgaaaaagttggtcaagatcagtatcgtataatcgatcttccaatttcagctgcgattgattttctagcacagagtcgagcagtaattgagcaatttgagtatcatcatggcacacttgacgatgcatttatgaatttaactggaaaggagctgcaataa

SEQ ID NO: 1974 - DNA, 810 bp, Unknownn; identical to SEQ ID NO: 1500
  isolated from saliva, unidentified

SEQ ID NO: 1975 - DNA, 561 bp, Unknownn; identical to SEQ ID NO: 1003
  isolated from saliva, unidentified

SEQ ID NO: 1976 - DNA, 1260 bp, Unknownn; identical to SEQ ID NO: 1318
  isolated from saliva, unidentified

SEQ ID NO: 1977 - DNA, 3537 bp, Unknownn; identical to SEQ ID NO: 159
  isolated from saliva, unidentified

SEQ ID NO: 1978 - DNA, 1818 bp, Unknownn; identical to SEQ ID NO: 1507
  isolated from saliva, unidentified

SEQ ID NO: 1979 - DNA, 534 bp, Unknownn
  isolated from saliva, unidentified
ttgaatttcgtagcaattgactttgaaacagccaatcctaaaagatatagtgcctgttctttagcactaactgttgttaaaaataatctaattgccgatcaattttattctttaatcaagcctgatactgatttttcttggagaaatattcaagtccatggaattacagaaaaacaagtacaaaatgcacctagttttcctgaactctggccacatattcaaaatttctttacacctaacaatctaattgttgctcataatgcaagttttgattccagtgttttattaagaacactagaacattatgatatcaccctgccacattatcaactattagatacacttagaactagtaagaaatttttcaaagattttgagaatcacaagcttgatacaatttgtaataacttaaacatcgatttaaagcatcatcataatgctttatttgatagtactgcttgtgctgaaattttactttaccaagctaatctttttggtgaagatcagttacaaccattcattaaaataaaataa

SEQ ID NO: 1980 - DNA, 1308 bp, Unknownn; identical to SEQ ID NO: 1317
  isolated from saliva, unidentified

SEQ ID NO: 1981 - DNA, 915 bp, Unknownn; identical to SEQ ID NO: 1483
  isolated from saliva, unidentified

SEQ ID NO: 1982 - DNA, 873 bp, Unknownn
  isolated from saliva, unidentified
atgaaagtaagaaaagctgttattcctgctgcaggtttggggacacgttttttacctgctacaaaggcattagctaaagaaatgtttcctattattgataaaccaacaattcaatatattgttgaagaagctaaaaaatctggcattgaagatattttagttgttaccggaaagggtaagcgtccaattgaagatcattttgattcagtaccagaattggaacaaaatctaacagaaaaaggaaagacagaattacttcgattagtacagcaaacaacagatattaatttgtactttattcgccaatcacatccacgtggcttgggtgatgctgtattaatggcaaaagattttgtaggtaacgaaccattcgttgttatgttaggtgatgaccttatggaagataaggttcctttgactagacaattaattgatcgttatgaaaaaacacatgcttcaacattagctgtaatgaaagtacctcatgaagaagtaaataagtacggtgtaatcgatccagctgcagaaactcaaccaggtttgtttgatgttaagcaatttgttgaaaagccagatgttgacaaggcaccaagtgatttagcaatcattggtcgttacttattaacacctgaaattttcgatatgcttgaaacacaaaagccaggtgctggtaatgaaatccaattaactgatgctattgaccgtttgaacaagattcaaagagtatttgcacatgaatttaaaggccaacgctatgatgtaggttataagtttggatatttgaagacatctattcaattcggtttacgtcatcctgaagtaagagatgaattgaaagaatatatcaaagaactttctaagaagattaaataa

SEQ ID NO: 1983 - DNA, 2913 bp, Unknownn; identical to SEQ ID NO: 917
  isolated from saliva, unidentified

SEQ ID NO: 1984 - DNA, 813 bp, Unknownn; identical to SEQ ID NO: 1041
  isolated from saliva, unidentified

SEQ ID NO: 1985 - DNA, 2028 bp, Unknownn; identical to SEQ ID NO: 1396
  isolated from saliva, unidentified

SEQ ID NO: 1986 - DNA, 1221 bp, Unknownn; identical to SEQ ID NO: 845
  isolated from saliva, unidentified

SEQ ID NO: 1987 - DNA, 1188 bp, Unknownn; identical to SEQ ID NO: 880
  isolated from saliva, unidentified

SEQ ID NO: 1988 - DNA, 1539 bp, Unknownn; identical to SEQ ID NO: 1212
  isolated from saliva, unidentified

SEQ ID NO: 1989 - DNA, 600 bp, Unknownn
  isolated from saliva, unidentified
atggaagagaaaaaagtaaattattggaaatgggctttttttgtattagtgggaattttatttataagtggttgttatcttgcaacaaaagtaacttcacaaacaaaagagcaaactaatatagctaaagtttcagataagaattctaagcaaaagtatacaagtgttgatgttacattggataagaaacaagctaatgcaacaatcaattattatctacgaaaaaatcagaaaaaaggtaagatcaaatatcgttttttagtagataaatctgcaatcatgatgggaacaactaagattttagggaaaaatgtgtcatttacattatatacaaaacctaccttagataagaatgggaatattttattaaaagttaaatcagtggccattggttcattaaacgctccagctggatttatattgaaatatgtgaaaaataattacgacctagggaaagtggcaattattgatccaaaagcaaaaactataactttggatttaaatcaattaactaagaaacaagatgttttagttaagggtactaagttagatttagtaaatgatgaatttaaatttaatgtaaaagttccattgaaatga

SEQ ID NO: 1990 - DNA, 2367 bp, Unknownn; identical to SEQ ID NO: 736
  isolated from saliva, unidentified

SEQ ID NO: 1991 - DNA, 1773 bp, Unknownn; identical to SEQ ID NO: 1398
  isolated from saliva, unidentified

SEQ ID NO: 1992 - DNA, 519 bp, Unknownn
  isolated from saliva, unidentified
atgaaaatatttattttagaggatgattcacttcaaattttacgcttaaagttggttttagagagtattcaaccaaacttagtgattcaaacttttaaagaatcagataaattattgcaacatattactcagccagatgaaaataatatttatttgctggatattgaattaaaaaattctagatatggtggttttgaagcttctcgaagaattagagaagttgataatttaggtacaattatttttattactacgcattcagaatttatgagaaaaacatatgagtacagagtagcggcgctagactttattgataaaatccaaacaaatgatgaaattaaacagagtttggttacagattttcaattgataaaagaaagacaaaacttaaatgaagaaactgaatttattgaattagaaagtaattctgaaatttttagaataccggtatctgatatatatttttttgaaacaatcactgacttaacaaaaaggaaatttaaaaagcatagaaactaa

SEQ ID NO: 1993 - DNA, 1791 bp, Unknownn; identical to SEQ ID NO: 1321
  isolated from saliva, unidentified

SEQ ID NO: 1994 - DNA, 1278 bp, Unknownn; identical to SEQ ID NO: 1203
  isolated from saliva, unidentified

SEQ ID NO: 1995 - DNA, 804 bp, Unknownn; identical to SEQ ID NO: 1494
  isolated from saliva, unidentified

SEQ ID NO: 1996 - DNA, 546 bp, Unknownn
  isolated from saliva, unidentified
atgattttaatggcaaaacaaatttatgattcaatggcgatgaagcgtgcgctaactagaatgacttatgaaatcattgaaaaaaataaaggaattgatgatttagttctagtagggattaagacaagaggtgtttatctagcacaaagaatagctgatagattgaaacaattggaaaatgctgaagttcctgttggacaattagatattacactttaccgtgatgacagacatgatgcatcactagcacaagatccagtagtaaatgaagcagatttaggttttgatattaaagacaagcatgtgattttggttgatgacgtgttatttacaggaagaacaattagagctgctttagatgctttaatggatattggtagacctaagaagattaatttagctgtattagtagatagaggacatcgtgaattaccaattagagcagattttgttggtaagaatattccaactgctatggatgaacaagtagcagtttatgtagacgaagttgatggaaaagatggaatcgaattaaagaaactataa

SEQ ID NO: 1997 - DNA, 786 bp, Eubacterium infirmum; identical to SEQ ID NO: 1197
  isolated from saliva, Eubacterium infirmum

SEQ ID NO: 1998 - DNA, 951 bp, Unknownn; identical to SEQ ID NO: 762
  isolated from saliva, unidentified

SEQ ID NO: 1999 - DNA, 1356 bp, Unknownn; identical to SEQ ID NO: 638
  isolated from saliva, unidentified

SEQ ID NO: 2000 - DNA, 1488 bp, Unknownn; identical to SEQ ID NO: 621
  isolated from saliva, unidentified

SEQ ID NO: 2001 - DNA, 804 bp, Unknownn
  isolated from saliva, unidentified
atgggaaaagcaatagttattacctctggtaagggtggtgttggaaagactactacaactgctaatttaggaacagcacttgctttactaggaaaaagggtatgtttggttgatttagatataggcctaagaaatttagatgttatattaggattggataaccgcattatttataatattgttgatgttgctcaaggaacagcaaaattacatcaagctttaattaaagataagcgatttgatgataagctctatttattgccggctgctcaaaacactgataaatctgctttagagccagaagaagttaaagcaattgtagaagaattaaagccagatttcgactatattttattagattgtccagctggaattgaacaaggctttatgaatgctgttgctggagcagatgaagcaattgttgtttctacacctgaaatttcttcagttagagatgctgatagagttgttggattacttgaacaaaaagaacttacagaaccaccaatgttagttattagtcgtattcgtcgtcatatgatgaatgatggagatatgatggatgttgatgaaattacacatcatttatcaattaaattaattggaattgtttttgatgatgatgaggttatttcatactctaacaaaggtgagccaattgtattgaatgaaaaaaatccagcttcacaaggatatcgtaatattgcccgccgtctagaaggcgaaacagtgcctttaatgacaattagagaaacagaaaagggcggctttatgaaaaaattcatcagttggtttaaaaaataa

SEQ ID NO: 2002 - DNA, 2343 bp, Unknownn
  isolated from saliva, unidentified
atgaccgaaaaaaagaagacaatttctgataattcgttagtaaagcaagcctacatagcctcaggaattgcattactttccttaggggctgggactgctgttaattctaataatgtaaaagctgatactttaaatactcaaaatactaattctacaactgtagccaatactacaaagattgatacttctcaatcttctgtaaataatagtgaatctcaaaataataattcacaaactaattctaatactttgcaactttcaaaaagaaatgtacaagtaaataatgcaacaactaatactcagaatgttactacaaacactgaaaataataatacatcacttcaagggcaaactattcagaatgatgtatctaccaatagttccgcagctgcacataatgctactcttgactcgggagtagttaaaaacgacaataatatttcatatgattataacttaaccaatgctcctgccagtgtcactaattttgtaaaccaagttggtagtgccgcaactaaggtagctgatgaatatggagtatatgcttctgttatgatggcccaagccggattagaaagtgcctggggacaaagttctctttccaggaatgcacataacctttttggggtgaaatataaaggaacaggtaactacgttgttatgcctactcttgagtactatggtggtgcataccatactgtgaatgctcgcttccaaaaatatgatagttattatgactccttagttggatatgcacaactcattaagaataatttttacttatctactaaggcaaattcttctacatatcaacaagcagctaataatcttcgtaatggtaaatggggatcatatgcaactgatccaggttatgccaataagttgattaatttaattaatttatacggtttccaaaattttgataaagtccaatcttcaggacaagaaaaatatataaatggacattggtatctatataaaaataatcaaaaacaaactggattccaatatctatctagcggaaataaaattgcctattataatcagtggggacaaatgttgtatggacaacaacaaatcaatggacattggtactattttgatcctttatctggagctatgcaaacaggattaaaatatatttctgatcaaaagaaaaatgtttattataatactcaaggtcaaatggtctatgggcaacaacaaattaacgggcattggtatttattcgatagatacagtggtgctatgttaactggattccaaaatctttccaactatggacaaaataaaattgtttattataataaatctggacaaatgtcatacggacaacaagctatcaatggacattggtatctattcgatagatatagcggtgctatgttaaccggattccaaaatttagctccatacggtcaagataaaatagcttactataataaatacggacaaatgttatataatcaacaacaaattaacgggcactggtatttattcgataaatatagtggtgctatgttgactggattccaaaatctttctggatacggacaaaataaaactgtctactatgataagaatggacaaatgctttatggtcaacaacaagttaacggaaactggtatttatttgatcaatatagtggtgccatgttgactggattccaaaatctttctagatatggacaaaacaaaactgtttactatgataggaatggacaaatgctttatggtcaacaacaaatcaacggtcattggtatttattcgataaatatagtggtgccatgttgactggattccaaaatctttctggatactggcaaaataaaactgtctactatgacaagtatgggcaaatgctttatggtcaacaacaaattaatggaaactggtatttatttgatcaatatagtggtgccatgttgactggattccaaaatctttctaggtatggacaaaataaaactgtctactataacaagtatggacaaatgctttatggtcaacaacaaattaatggaaactggtatttatttgatcaatataatggtgccatgttgaccggattccagaaccttaccagatatggacaaaataaaactgtctactatgataagaatggacaaatgctttatggtcaacaggctattaatggacattggtacttatttaataagtataacggagctatgcttactggattccaaaatcttgcagattatgggcaagataaagttgtttactatgataaaaatggacaaatgctctatggaaagcaatcaattaataatcactcatatctatttgatacagttagtggtgctttaattgataaataa

SEQ ID NO: 2003 - DNA, 936 bp, Unknownn; identical to SEQ ID NO: 608
  isolated from saliva, unidentified

SEQ ID NO: 2004 - DNA, 714 bp, Unknownn
  isolated from saliva, unidentified
gtgaatgaaggaactcaaattgtagagttttttggaattccttttaatgttggtaatattgtttctggattagtttcagcggtaatagtattcgtagtattattttggttatctcgtaaaattcaaatgaaacctgttggtagacaaaatgttttagaatgggttgtagattttacaaatggtattataaagaatgctttaccagatgaagaaggaaagcagtttggtttgttagcctttaccttatttgttttcatctttatctctaatcagttgggattaataatagagcttacgtttaatggagttgaatatgtgaaaagtcccacatcttctccattaacaacgttaactctagcatttatgatactagtgttatcccattatttaggagtaaagaaatttggttttaagggatattttaaaaatacattccttagtccaatgccagcattattacctattagtatttttgaacaatttactaattttataacattggcattgcgtttatatggtaatatttatgccggtgaagttttgctaaaattaatttacaatatggcaaactctaaaggtgtattaacatatatacctgcaattccattggaaattatatggcagggattctctgtctttatcggaagtatccaagcctatgtctttgtcacattgacaatggtatacatctctcaaaaagttgaaaaagagtaa

SEQ ID NO: 2005 - DNA, 1083 bp, Prevotella histicola; identical to SEQ ID NO: 622
  isolated from saliva, Prevotella histicola

SEQ ID NO: 2006 - DNA, 1605 bp, Unknownn
  isolated from saliva, unidentified
atgaagagaagatttacacatacctttatgcttttaatttttcaattacgtcaaaaatggttatggttatgcctatggttgataggagtaactgcttttgctagtggttacgtatcagcctttgaaaagatagcagaagatcaaggtaaagtaggactatttattactatgaaaaatccagctatggcagctattgtcggtccgctaccagtgaaatctgctagtcaatattctgtaggtgtaatgtatgggcatgaaatgacactatttattgcggttattactatgataattgcaggaagttttatgattgatcaaacaagaaaaatggaagaaaacgggcagttagagatattaaaatcgttacatattggttcgcaagcctctagtatggcaacaaatttattggtacttttacatacagttttaacaattattttagttagtggaattttagtatcttacaatgttagttctatagatcttaaaggtagtttgtattttgcatgttcattaggattagctagtttgttaggtgcatcaatagcttatctttgtgctcaaatctttgctacaagctcacaagcacgtggaattttctttagtatagtgggaatattatatgtacttagggcaggtactgatgttagtaatttaatattatctaagtttaatccactagcttggacttatttaggtcatcctttttatcaaaatgattggtattatttgataggattattcttattaactttagttgtatttagtattggtttggtgcttgaaagttcacgagatttaggatctagtacaattacttcaaaaaagggtaaaataaaagctagtaaatggctagctacgccactaggatttttcttctacttaaatagatctactattatttcttggttacttgctgatggtgtaattgcattaatgtatggttcaatttacggagatattgatacatttgttagtagcaataaattaattagccaaatgtttgctaatgattctgcaacactgatcaattcatttaccgctttaattatggtggtaacgacagcaattagcttagtgatgccactagtagttgttcataaagtacagtctgagacaaataaagaacggttaggttatcttttagtgcagcgagtaagtaggttgaaagtttattattctagtttgattttagcattattttttgggactttagctatactaataaatggattttgtttaggaatagcagctgtttcatcaatgcaggctaataatggaaaatttattacaacttgtattcaagcagcattgaaccaatggccattagtttgtttatttgttggattaatgttactaagcttgagtttacctatatttgttagttggttagtctgtggattattagggtatagtttttgtgtaacatacttcgctgtactgcttgatttacctaagtggatgacgcatacttcgttattcaacgtacttgcgaaaatgccaatggaaaaatttgatttgatgtcatttgctattttaactggtatagggatattggcgatgttattaggaggaattttgtatacacgaaaggaaatagtgtag

SEQ ID NO: 2007 - DNA, 1527 bp, Unknownn; identical to SEQ ID NO: 834
  isolated from saliva, unidentified

SEQ ID NO: 2008 - DNA, 993 bp, Unknownn; identical to SEQ ID NO: 1315
  isolated from saliva, unidentified

SEQ ID NO: 2009 - DNA, 900 bp, Unknownn
  isolated from saliva, unidentified
atgggaattttgcttaatttttggttggaatctaatatcattactaaaaaagttagcactgatactaatattttcaaaaagtatatcgataacttcaattgggatgaattactttctaaagttataacaacaactattttgttattgttagtttcgttgctattttatatttttcattacattggtaagaaaattatcaaacgagcttttaaaaaaaatcgtttagttgaatcattgtcttctggaagaattaatacagcttacacattatcacaaaatatcttccattattttattttgttcttctatttttatgcggtattatctttgctaggaattccaataggttctttaattgctggtgccggaatcatgggtgttgcaataggtttaggtgctcaaggatttgttactgacgtggttactggattttttattcttttagaacaacaatttacagttggtgatgacgttaagatcgggactatttctggaaaggtagcagcttttggtttaagaacgacacaaattcttgactatgatggtactctccattacatacctaatcgaagcatcacaattgttagcaatctttcgcgtaatgatatgcgagcccaaattgatatccatgtaaagcctaatcaagattttgataaaattaagactgttatacaaaatgtaaacaaatctttaactcccaaatttgatgatattacccaaaaaccacaaattctaggtgtagttgagactccaaatggccttgtttacagagtaattatttttactaaaaatggtgcccaagctcctgttcaaagggcatttctcgcaaaatatttagaggctttaaaacaagctggtttagagatgcctatttcccctatcaatctaacaactaaataa

SEQ ID NO: 2010 - DNA, 1281 bp, Unknownn; identical to SEQ ID NO: 864
  isolated from saliva, unidentified

SEQ ID NO: 2011 - DNA, 312 bp, Unknownn
  isolated from saliva, unidentified
atgaaacttagaggaaaacaaaaacgatatttacgtagtgaggctcatcatttaaaacctatttttcaaattggtaaagatgggttgagtgaagtatggttagatgaagttttaaaggcattagataaaagagaactattaaaagttaatattttgcaaaattcactagtggaagttgaagatgttaaagaatttatagagaataatagtgatgcacaagttattcaaacaataggtaacgtgttagttctctttaaaaagtctgataaggctgaaaaccaaaaaatttcagtaaaagttgcagaattataa

SEQ ID NO: 2012 - DNA, 738 bp, Unknownn
  isolated from saliva, unidentified
atggtaaccaagagatacaatgagaaacatagggtagttttctacgaaactgatgtaactaagaatataaatattggaatgttagttgatttaatgatgttagcatcggaaaatcagagtgaacaattaggtataggaacagataaagtaaatggtctagggtatggatgggttattacacaacatgttttggagattgaacgccttcctaagataaatgaggaagttaaaatttggacagaagcagattcttataataaatatttctgttatcgtgaatttggaatagatgatatggatgataatccgttagtaaggatgcatacaatctttgtattaatggattttaaaaatagaaaaatttctcagattgtaccagaacttactataccttttggggcaactgaaactcctaaggtgaaacgatataaaaatgttaaaaagataaaggaaatagacaatcataaaaaatatcaagttcgttttatggatatagattcaaatcatcacgttaataatgtacactactttgactggatgttagatacgttagactatgattttctcagcaaacatacactaaaaaagataaatattcagtataaacaagaagttacatatggtgatatagtaacaagcaatgtccaaataataaatagtaatgatacaattactactttacatgcagttaagaataatgataaagtatcatgtttagctgaatgtgagtggatataa

SEQ ID NO: 2013 - DNA, 813 bp, Unknownn
  isolated from saliva, unidentified
ttggaaaaaaaggtagaagtagtaattgctactcacaagaaatataaaatgcctacagatgatttgtatttaccaattcatgtaggtgccgaattgaataaagataaagacttaggatatcaaaaagataatgttggagataatatttctgataaaaatgatagatatagtgaattaacagctctatattgggcatggaaacatgtagatgctgaatatattggcttagctcattacagacgtcattttggtggaaagaattatcatcacggtaaagataggcttagttgggtgattacaaaagctgagttagaaccaatgttagataagtatgatgtgatattacctagaaagagaagatattatattgaaactctgtattcacattataagcatacgcattattcaaaccagctagatgtaacttccgatattattaaggaaaaatatccagaatatgctgatacatatgagaaggtaataaataagacttcaggatatatgtttaatatggttattatgagaaaagatttgttagatgcctattgcacatggttatttgatatcttatttgaacttgaaaagcgtttaggaacacaaaacttggatgccttccaacaacgtttctatggacgtgtaagtgaaattatctttaacgtttggctagaaaaacaatttgaaaatggtgtcgttgataagaagcgtgtcaaagagctaccaattgtatatgtagagggagtaaattggtggaaaaaaggcacagcgttcttaaaagctaaattctttaataagaaatatgaaaatagcttttaa

SEQ ID NO: 2014 - DNA, 543 bp, Unknownn
  isolated from saliva, unidentified
atggatatagttgtaaatcttgcatcaggttttatgaacctctttgaaacaggtggaaaaacattcattggttggatgaagacaatcgtaccagttgtattgctattattggttttaatgaatacaattattgcattcttaggtgaagaaaagatggataagattgctagaggggcatctaagaacatctttacacgttatctaattttgccattcttatcagcatttatgttaggtaatccaatgtcctttacaatggctcgtttcttacctgaatactacaagccaagttactacgctgcacaagctcaattctgtcatacaagtaatggggtattccctcacatcaatccaggtgaattgtttgtatggatgggtatcgcacaaggtgtacaaaaattaggtttgaatagtatggacttagctattagatacttattagtaggtttagttatgaacttcatcggtggttgggtaactgactttacaactgcttatgtatgtcgcacaactggaatcaagttatctaagacagtggattaa

SEQ ID NO: 2015 - DNA, 1224 bp, Unknownn; identical to SEQ ID NO: 861
  isolated from saliva, unidentified

SEQ ID NO: 2016 - DNA, 705 bp, Unknownn; identical to SEQ ID NO: 1222
  isolated from saliva, unidentified

SEQ ID NO: 2017 - DNA, 1149 bp, Unknownn; identical to SEQ ID NO: 172
  isolated from saliva, unidentified

SEQ ID NO: 2018 - DNA, 1011 bp, Unknownn; identical to SEQ ID NO: 1272
  isolated from saliva, unidentified

SEQ ID NO: 2019 - DNA, 864 bp, Unknownn; identical to SEQ ID NO: 668
  isolated from saliva, unidentified

SEQ ID NO: 2020 - DNA, 990 bp, Unknownn; identical to SEQ ID NO: 735
  isolated from saliva, unidentified

SEQ ID NO: 2021 - DNA, 738 bp, Unknownn; identical to SEQ ID NO: 750
  isolated from saliva, unidentified

SEQ ID NO: 2022 - DNA, 708 bp, Unknownn; identical to SEQ ID NO: 8
  isolated from saliva, unidentified

SEQ ID NO: 2023 - DNA, 1146 bp, Unknownn; identical to SEQ ID NO: 692
  isolated from saliva, unidentified

SEQ ID NO: 2024 - DNA, 876 bp, Unknownn; identical to SEQ ID NO: 810
  isolated from saliva, unidentified

SEQ ID NO: 2025 - DNA, 1326 bp, Unknownn; identical to SEQ ID NO: 1333
  isolated from saliva, unidentified

SEQ ID NO: 2026 - DNA, 738 bp, Unknownn; identical to SEQ ID NO: 1359
  isolated from saliva, unidentified

SEQ ID NO: 2027 - DNA, 1905 bp, Streptococcus mitis; identical to SEQ ID NO: 706
  isolated from saliva, Streptococcus mitis

SEQ ID NO: 2028 - DNA, 645 bp, Unknownn; identical to SEQ ID NO: 590
  isolated from saliva, unidentified

SEQ ID NO: 2029 - DNA, 828 bp, Unknownn; identical to SEQ ID NO: 1072
  isolated from saliva, unidentified

SEQ ID NO: 2030 - DNA, 3582 bp, Unknownn; identical to SEQ ID NO: 1027
  isolated from saliva, unidentified

SEQ ID NO: 2031 - DNA, 870 bp, Unknownn; identical to SEQ ID NO: 1497
  isolated from saliva, unidentified

SEQ ID NO: 2032 - DNA, 1332 bp, Unknownn; identical to SEQ ID NO: 837
  isolated from saliva, unidentified

SEQ ID NO: 2033 - DNA, 885 bp, Unknownn; identical to SEQ ID NO: 874
  isolated from saliva, unidentified

SEQ ID NO: 2034 - DNA, 642 bp, Unknownn
  isolated from saliva, unidentified
atgttagatagtaaagaaacacaatatgcgctacaagaaatggggaaaatgtttccgaatgcgacaacttcattagtagctgatagtgattatcattttttattggctgttattttaagtgcacaaaccacagataaagcggtaaataaagttacaccatcattatttgataggtacaaatatcctatagatatggctaatgctgatccaaaagaagttgctgaatatgtcaagactatcggtctttataaaaataaagccaaatatttggtagaatgctcgaagatgctagtggataattttaattctgttgtgccaaaaacacataaggagttgatgtccttatctggtgttgggagaaaaacggcagatgttgtattagctgagagatttggtgttcctgcttttgcagttgatacacatgtgcatagaatttctaagcgtttagcaatagttccagaagatgctacagttagggagactgaaaagatattaatgtcaaaggtccctaaagaagattggataaaatctcatcaccgaatgattttctggggacgctatcaatgtatggcgagagctcctaaatgtgaaacttgtccattactggaaatctgtcaagaaggacaaaaaaggataaaataa

SEQ ID NO: 2035 - DNA, 948 bp, Unknownn; identical to SEQ ID NO: 1173
  isolated from saliva, unidentified

SEQ ID NO: 2036 - DNA, 1236 bp, Unknownn; identical to SEQ ID NO: 1345
  isolated from saliva, unidentified

SEQ ID NO: 2037 - DNA, 771 bp, Unknownn
  isolated from saliva, unidentified
atgaataaagaaagattgcaattattagcgcataaaacgatgaatatctatcaagtagaaatgcgacaattgccgcagacttcagaattaattacagagttgcctgtagaaacagaagcatcaaatcaatatgaaactaaaataatagtaaaggatgaaaatttactttacagaacttttagggttcctgaagataaaaaattaggaataatgaattttgcaagtccagttacaattggcggaaattttcaatatggtgtaaatgcgcaagaacaaacaatttgccgaaatagttttctatatccagagttaaagaagtatcgcagaacatattattatcataacatccaaaatcccaatgactttttatttagtccatatttaatttatgctagtgatattaaatttattcgcgatgaaaaagaagaccaaatcttgaaaggaaagtttgctgatgttgtatctgtggcagcacctgatgtaacttcaatgcgagaaaataataaagttttaccggcagaaaagattgctgaagatatatataataaagttttagcaactttgcgtgttttcaaaaatcatgaaactaaagttttaatattaggtgcttttggttgtggtgcatttggaaacgatccacagatggtagcaaaaatatttaagcaagtcctagatagatcagagttcaagggcgtatttgaagaaatatattttgatattatgaaaaatccacaagttttgaaaatttttgaaaatactttgaaagattga

SEQ ID NO: 2038 - DNA, 675 bp, Unknownn
  isolated from saliva, unidentified
gtggttaagaaactacaaatagcaattgatgggcctgcctctgctggtaagagtactgtagctaaattagtagctaagaaattaggatatatttattgtgatactggagctatgtatcgtgctgtgacttatgctgcattaaaagcaaatatttcattagatgatgacgaagctttaaagaatttattacaagatttcaaattggaatttgtaccagctgaacctgaacaaaaagtctttgttaatggagaagaagttacacaaattattcgtactccagacattactaataatgtatcattagtttcggcacaaccaagcgttagacaagatttgacacatcgccaacaagaaattgccgataacggcggtattgttatggacggtcgtgatattggtacaacagtattaccaaatgctgaagtaaaaatcttcttagttgctagtgttgaacaaagagcattaagaagatataaagaaaacatcgctaaaggtattgatacaccgttagaagtgcttgaaaaagaaattgctgaaagagattataaggattctcatcgcaagatttctccattagttcaagctaaagatgctgttaaggttgacacaacaccattaacaattgatgaagttgttaatgaaattatgaatattattgaagaacgtaatcattaa

SEQ ID NO: 2039 - DNA, 657 bp, Unknownn
  isolated from saliva, unidentified
atgataaaagtactaatagctgatgatcaaaagttaatcagggaatcactgaaaattgttttagatacctatcaagatattcaggtaattgatacggttggtgatggtaaacaagtcttagaaagtattaaagaacaagaaccagatgtaatcttaatggatattcgtatgcctaatatggacgggactgtaagtacaaaattagttaagcagtcctaccctcacataaaaatcattattctaacaacttttgatgatgatgatttcatttttagcgcactcaaatatggagcatctggctacatcctaaaaggtgtctctcctactgaattacatgatgctatcaccacagtttacaatggtggctccatgattaatcctaatattgctgctaaagttgtaaaattgttttctaaaatggctcaaagtgattttgaaattgatgtagataaagaaggagcggctctaattactgatgctgaatggcgtgtaatttaccaagttggacgtgggttatctaataaagaaatctcccaagaactatttttatctgaaggtactgtccgtaatcacttatcacacattctctccaagttaaatttacgcgatcgtactcaattggcaatttgggctgttcaaaatgccccacgtaagtag

SEQ ID NO: 2040 - DNA, 867 bp, Unknownn; identical to SEQ ID NO: 833
  isolated from saliva, unidentified

SEQ ID NO: 2041 - DNA, 300 bp, Unknownn
  isolated from saliva, unidentified
atggcaattggatctgaagaagtaaagcacgttgcagggctagcaaagcttgcttttaaagatgaagaattagctaagtttactggacaaatggatgaaattattaacatggttcaacaacttagtgaagtagatacaacagatgttcctgtaacaacacacgtaacagatgcaataaatactttacgtgaagacgttgcagtaaaaggaacagatcgtgatttattaatgaaaaatgttcctcaaagccaagatggatatattaaagttccagcaattattgacgaaagtgaggaatag

SEQ ID NO: 2042 - DNA, 2172 bp, Unknownn; identical to SEQ ID NO: 843
  isolated from saliva, unidentified

SEQ ID NO: 2043 - DNA, 2427 bp, Unknownn; identical to SEQ ID NO: 825
  isolated from saliva, unidentified

SEQ ID NO: 2044 - DNA, 1443 bp, Unknownn; identical to SEQ ID NO: 983
  isolated from saliva, unidentified

SEQ ID NO: 2045 - DNA, 981 bp, Unknownn; identical to SEQ ID NO: 600
  isolated from saliva, unidentified

SEQ ID NO: 2046 - DNA, 801 bp, Unknownn; identical to SEQ ID NO: 814
  isolated from saliva, unidentified

SEQ ID NO: 2047 - DNA, 2070 bp, Unknownn; identical to SEQ ID NO: 1420
  isolated from saliva, unidentified

SEQ ID NO: 2048 - DNA, 1704 bp, Unknownn; identical to SEQ ID NO: 604
  isolated from saliva, unidentified

SEQ ID NO: 2049 - DNA, 897 bp, Unknownn; identical to SEQ ID NO: 1314
  isolated from saliva, unidentified

SEQ ID NO: 2050 - DNA, 414 bp, Unknownn
  isolated from saliva, unidentified
atgaatatgaacttaacaattacccaagtgtcagaaaagtataatattacaccagatacactaagatattatgaacgtataggactgctacctaatgttccacgtcaaagtaatggaaatcgttattacgatgatagtgtgcaagaatggattgaaatgattgtttgcttgcgtcattcgggtgtacctgttgaaaaattaatcgactatgctgaaatgattcagaaaggcgattcgacgttgcaagcacgtgaagatttgttaaaagagcaactagctaatctaaaagaaaaacaacacaatcttaaccgttcaattgcacgtttggaacataagattagcttatacgaatcaggagaaattaaacagcataaaagctattttacagaatataagattatggaagatgaatga

SEQ ID NO: 2051 - DNA, 357 bp, Unknownn
  isolated from saliva, unidentified
ttgaccaaaaaaatttataacattggtgtagaagctactatggatgtcattggtggaaagtggaaaccaattattttatgtaatcttcgccaccaatcattacgtacaagtgaactaaaaagactaatccctaatatcagccaaaagatgttgactcaacaattacgcgaattagaagcagccgatattatcaaccgcaaagtatataatcaagttccacctaaagttgaatattctttaagtgattatggtcaatcattaagtaccgtacttagtgatctttgtacttggggcgagatgcatgtagacatgctgaaaaaacgcggtgaagatgtagaacttgtaaactatgactaa

SEQ ID NO: 2052 - DNA, 834 bp, Oribacterium sp.; identical to SEQ ID NO: 726
  isolated from saliva, Oribacterium sp.

SEQ ID NO: 2053 - DNA, 1437 bp, Unknownn; identical to SEQ ID NO: 1529
  isolated from saliva, unidentified

SEQ ID NO: 2054 - DNA, 876 bp, Unknownn; identical to SEQ ID NO: 1496
  isolated from saliva, unidentified

SEQ ID NO: 2055 - DNA, 744 bp, Unknownn
  isolated from saliva, unidentified
atggataacataaaaaaagaatatcgagaactcgatttattcgaaatattccaaatgttattgcggcattggtggataattttactgagtggtcttttatgtggattggtagcgtttacctatagtgagtttgcggtcgttcctcagtatacttcagttacgaaaatctatctatccaataagttaacggaaaaccagactaatcccactccttcaacagaattgataaaagactatgaagaaatggtaaaaagtcgagctgttttagagaatattatcgaaaaacatgacctacgctatagttatggtgaattaagtaagaaagttaatgcagaaaataaagacgaaactcaaattattagcataagtgttactgatcctaatccagttgtggcgcagagattggccaatagtattcgcgatgaatcgattaaacatgttacaaaagttatgaaagttatttccgttggtgtggtagataaagccaattatcctcaaagtcaatcatatccaattacaataaaatggattgaatacggatttttaattggttttgtattatcaattggggtacttttgatacgcttcatcttagatgacacaattaagacaagcgaagatgttgaaaagtatctaggattgagtaccttagctgtaattcctaagattagtgatagtaataataagaagaaatactatggaaattatggtaaaggtaagagcaaacggagaaagagggtgtga

SEQ ID NO: 2056 - DNA, 3000 bp, Unknownn; identical to SEQ ID NO: 463
  isolated from saliva, unidentified

SEQ ID NO: 2057 - DNA, 1578 bp, Unknownn; identical to SEQ ID NO: 1208
  isolated from saliva, unidentified

SEQ ID NO: 2058 - DNA, 1197 bp, Unknownn; identical to SEQ ID NO: 612
  isolated from saliva, unidentified

SEQ ID NO: 2059 - DNA, 888 bp, Unknownn; identical to SEQ ID NO: 1449
  isolated from saliva, unidentified

SEQ ID NO: 2060 - DNA, 840 bp, Unknownn
  isolated from saliva, unidentified
atgacaagaaatatacgtagatatcgctggggacgttggctagtatttttagttgctctagaaattattactttaagtattaacttcttttatgctccaattgatatcgcagccggaggaacgactggaattgccatcttagtagaggctgtttggcatgtagaacgacctttaacagttttaatctgtaatctagctatgattggcttagcttggatttttttagaaagaaaagttgttaaaaatattactttaggtagtttattgttacctgtatttatgcaattaactcctagtttccaggttactgataatgaattattagctgttattattggtggtggcttgatgggcttcggagtttcacttctttatcgaatcaatgcttcaagtggagggacaactgttccaccaatgattttgaagaaatacttttatctggattcagccctaacattaatgtttatcgacttacttgttatttttatgaatatatttgttgctggacccaatgctttctttttagcagccttttctcaagttataactgccttagttatgcgttattccgaggcaggctttgacttaaaataccaagttcaaattttaagtaacgatttgcttgatgaaattaaagaaacccttctaaaagataatagtagtttgactctttatgatgtagttggtggttatagtcaaacacaaaagcaacaaattttattaatcgtagatcgccaagattacggtcatttaattgctaaaattcatgaaattgatccagaagcctttattgttacatctaatgtaactaaagttcatggtggtaaatggggattatag

SEQ ID NO: 2061 - DNA, 1371 bp, Unknownn; identical to SEQ ID NO: 1147
  isolated from saliva, unidentified

SEQ ID NO: 2062 - DNA, 471 bp, Unknownn
  isolated from saliva, unidentified
ttgcgcaagcaaattagaaaagcggatgttgatgcagtttatcttaactccatgtcctcaccagctgatactgctagtgtagttcaagctttagaaaaagctggcgttaagcgactattaggtgcaacgattgctggggtagaagatgaagttccttatgaactagcaacttggacaaagaatagtttgccagcaagttacattaagggtgaatatgattctgctaagatagtcagagattctaatttggattacacattgttaagactgacttggttatttaatgacgaaagtgatcgtgaatatgaactagttccaagtggagtcgaatttgcagatgctgaggtttcgcgacaagctgttactcaagcaattttagatattttaaatggtgaagaatctgaatatgtaaggaagagttttggtttgggtaagccaaatacacattatggtaagccatcgttttattaa

SEQ ID NO: 2063 - DNA, 768 bp, Unknownn; identical to SEQ ID NO: 1111
  isolated from saliva, unidentified

SEQ ID NO: 2064 - DNA, 1083 bp, Unknownn; identical to SEQ ID NO: 841
  isolated from saliva, unidentified

SEQ ID NO: 2065 - DNA, 3600 bp, Unknownn; identical to SEQ ID NO: 915
  isolated from saliva, unidentified

SEQ ID NO: 2066 - DNA, 1056 bp, Unknownn; identical to SEQ ID NO: 1168
  isolated from saliva, unidentified

SEQ ID NO: 2067 - DNA, 2403 bp, Unknownn; identical to SEQ ID NO: 956
  isolated from saliva, unidentified

SEQ ID NO: 2068 - DNA, 1008 bp, Unknownn; identical to SEQ ID NO: 1235
  isolated from saliva, unidentified

SEQ ID NO: 2069 - DNA, 1728 bp, Unknownn; identical to SEQ ID NO: 976
  isolated from saliva, unidentified

SEQ ID NO: 2070 - DNA, 1218 bp, Unknownn; identical to SEQ ID NO: 1033
  isolated from saliva, unidentified

SEQ ID NO: 2071 - DNA, 924 bp, Unknownn; identical to SEQ ID NO: 1465
  isolated from saliva, unidentified

SEQ ID NO: 2072 - DNA, 1389 bp, Unknownn; identical to SEQ ID NO: 1017
  isolated from saliva, unidentified

SEQ ID NO: 2073 - DNA, 462 bp, Unknownn
  isolated from saliva, unidentified
atgaaacattcatataaactaagcgatgcaattcatattttaacatatgttgatatatacaaaaatgatgatttaagcagtactagaattgcggcaagtattgaagctaatgctagtgttgtgagaaatttaatgtcaaaattaaaaaaagcagggctgttaaataatcagccgggagtagctagagcgagtttagcaaagccagcaagtgaaatttcagttttagatgtttatcgtgcaattacatcaactgccagtttgttgcatgttgatcctaagacgaaccctaattgtgtagtaggtgctaatatccaaaatacattggaagaagtatatcagagggtgcaaaatgctgcagagttagagatgagccagattagtattcaagatgtaattgatggagtgctagagagtgaaagattgaaacagaaggctggtggtgatggtgaagaacttgattag

SEQ ID NO: 2074 - DNA, 1335 bp, Unknownn; identical to SEQ ID NO: 961
  isolated from saliva, unidentified

SEQ ID NO: 2075 - DNA, 858 bp, Unknownn; identical to SEQ ID NO: 1013
  isolated from saliva, unidentified

SEQ ID NO: 2076 - DNA, 690 bp, Unknownn; identical to SEQ ID NO: 974
  isolated from saliva, unidentified

SEQ ID NO: 2077 - DNA, 1239 bp, Unknownn; identical to SEQ ID NO: 644
  isolated from saliva, unidentified

SEQ ID NO: 2078 - DNA, 444 bp, Unknownn
  isolated from saliva, unidentified
atggaattacaagcaaatatgatttctttaaatcaagatgttgccacaagagatcaagcaattcgtatggcaggacaattactggtagatgcaggttgtgttgaaaaagaatatatcgattcaatgattgcacgtaataatgatgtctcaacatatatgggtaattttatcgctatccctcatggtacggacgaaggtaaacaatatattaaaaagacaggaatttcggtagtgcaaattccaatgggcgtagacttcagtggagaaaatgatagtgaacaattagtaactgttgtctttggaattgcaggtttaggtaatgaacacttaaatctattgtcacaaatcgctttatattgcagtgatgtttcaaatgtcgctaaattagcagatgcacaaacaccacaagaaataattaatttattgaaggaagttggaaaataa

SEQ ID NO: 2079 - DNA, 2109 bp, Unknownn; identical to SEQ ID NO: 1014
  isolated from saliva, unidentified

SEQ ID NO: 2080 - DNA, 957 bp, Unknownn; identical to SEQ ID NO: 656
  isolated from saliva, unidentified

SEQ ID NO: 2081 - DNA, 999 bp, Unknownn; identical to SEQ ID NO: 1479
  isolated from saliva, unidentified

SEQ ID NO: 2082 - DNA, 528 bp, Unknownn; identical to SEQ ID NO: 852
  isolated from saliva, unidentified

SEQ ID NO: 2083 - DNA, 2136 bp, Unknownn; identical to SEQ ID NO: 1309
  isolated from saliva, unidentified

SEQ ID NO: 2084 - DNA, 504 bp, Unknownn
  isolated from saliva, unidentified
atgaaattttggttagttatattaactgcgatagttttcattgtaattattgttgttatacagtattacataaaaaacaaggaattaaaaagattacaagcaagaagtagaaagcttactgatgatgctatggataaatcgatgaatgagatagatctagaatggtttaatcagaataatcacaaaaatgtaagagatatagcagtagtatctgatgtttggggaaaagatgtgatggtttttgaatattcagtagaattgactcaaaatcaaaaattttccagtgagaaactaaatgctttgaaagaattgttggaaaagaaattatttaattatgcaaaacagaaaaagattcaaaatatggctaataagcctccatttatagtatcagacatttggcagttagaaaatatactgcacatagatgtagcgtatataatgaatgaggcaacgtataagtatttaaatgatattgaaaagttagagcctggttttaagaaatag

SEQ ID NO: 2085 - DNA, 1422 bp, Unknownn; identical to SEQ ID NO: 1185
  isolated from saliva, unidentified

SEQ ID NO: 2086 - DNA, 1887 bp, Unknownn; identical to SEQ ID NO: 808
  isolated from saliva, unidentified

SEQ ID NO: 2087 - DNA, 1338 bp, Streptococcus infantis; identical to SEQ ID NO: 1060
  isolated from saliva, Streptococcus infantis

SEQ ID NO: 2088 - DNA, 1176 bp, Unknownn
  isolated from saliva, unidentified
atgattgacatgattactacgactcttggcgaagttggtaaagtaaaaatgtgtaagcgcatattaaaagaacagacttctaatgaaggagatatcccattttataaaatcggtacctttggtggacagccagatagttttattaataaggaattattcgaaaaatataaggaaaagttttcttatcccaaaattggtaatactttaatttcggcatcgggtacaattggaagaactgtaaggtatgaaggtgaagaagcatactaccaagatagtaatatagtttggattgacaatgacgaatctaaggtattagatgactacctatactatgtctatcaaaatattagatgggttacaacgacgggagctactattactagattatataactcaaatattgaatctatggaaattaaaattcctaaagatctaaatgtacaaaagcagattgttgatgtattaaatcctattgaaaaaaagatttctctcaataactctatttgtgagaaacttgaattaattgcaaaaactatctatgattactggttcttgcagtttgaattccctaatgaagaggggaagccttacaagtcatcaggtggcaaaatggtctggaataaagagttgcaacaagagattcctgatggatgggctagttcaaagttaaaaaacatcattgtcgagaatcctaaatctaagattaaggttagtgacgtaaaaaatgatggagaaataccattttttacaagtggcacagatatcttgtcaactagcgaatcaatagtttcgggcttaaattgttacttaaatactggtggtaatgctgatgtgaaatactactatggagaagcatcatattctactgatacatggtgtattactgctgaaaacgagacgaagtatattttgccatttgtgcttaacaaaattaagccaagcatggataaggtattcttccaagggacaggcttgcgccacttgcagaaaaatttattacgtgaataccaattttgtcttcctgacagtaatgttgtaaaagaattttcaaaacttgccagtgatatttttaaaaagcaacattatttacttgaagaaaacaagaaactggaatcattgaaacaatttttgctaccccttttaatgaacggacaagtaactatcaacgaaaaatag

SEQ ID NO: 2089 - DNA, 783 bp, Unknownn; identical to SEQ ID NO: 573
  isolated from saliva, unidentified

SEQ ID NO: 2090 - DNA, 1407 bp, Unknownn; identical to SEQ ID NO: 715
  isolated from saliva, unidentified

SEQ ID NO: 2091 - DNA, 576 bp, Unknownn; identical to SEQ ID NO: 707
  isolated from saliva, unidentified

SEQ ID NO: 2092 - DNA, 801 bp, Leptotrichia wadei; identical to SEQ ID NO: 1511
  isolated from saliva, Leptotrichia wadei

SEQ ID NO: 2093 - DNA, 1491 bp, Streptococcus parasanguinis; identical to SEQ ID NO: 963
  isolated from saliva, Streptococcus parasanguinis

SEQ ID NO: 2094 - DNA, 948 bp, Unknownn; identical to SEQ ID NO: 1492
  isolated from saliva, unidentified

SEQ ID NO: 2095 - DNA, 1431 bp, Unknownn; identical to SEQ ID NO: 908
  isolated from saliva, unidentified

SEQ ID NO: 2096 - DNA, 540 bp, Unknownn; identical to SEQ ID NO: 1136
  isolated from saliva, unidentified

SEQ ID NO: 2097 - DNA, 249 bp, Unknownn
  isolated from saliva, unidentified
gtgaccgtgattatttgtaaaacgattggagaaatcctcatgtctcaaagtaacttagaaaaacaagaagctaaattaaaacagcttaaccaaaaaattaaagaagaaaaatataaaattgaacaacggctaggtaaacagattatcagccaagccaatttagagtatactaatttatctaatgaccagattaagcttttagctaagcaattttctgaatttttaaaggaaaagacagtagatcattaa

SEQ ID NO: 2098 - DNA, 1686 bp, Unknownn; identical to SEQ ID NO: 1198
  isolated from saliva, unidentified

SEQ ID NO: 2099 - DNA, 813 bp, Unknownn; identical to SEQ ID NO: 1132
  isolated from saliva, unidentified

SEQ ID NO: 2100 - DNA, 1068 bp, Unknownn; identical to SEQ ID NO: 1292
  isolated from saliva, unidentified

SEQ ID NO: 2101 - DNA, 870 bp, Oribacterium sp.; identical to SEQ ID NO: 1423
  isolated from saliva, Oribacterium sp.

SEQ ID NO: 2102 - DNA, 1221 bp, Unknownn
  isolated from saliva, unidentified
atggtaatttttatatctatatttatagtaattactggattacaaaattcagctatggcagatagcattcccgccctaactaatgttaaatcggcaattgcagtggacgctaatagcggtcaaattctatatgaaactaaagaagatgaagtttatcctgtagcttctatgtcaaaattattaacttcttatattctactggataaaattaatcatcatgaattatcttggaatactaaggtaaaacctactaaagttgaagctgagataagtcataattctgaattgactaatgttccacttgatagcactcactcatacactattaaggagttatatcaagcaatgttagtaggatctgcgaatgctgctgcaatggttatagcaagggctgtttctggctctcagacagattttgtaaaactaatgcgagtaactgctaaaaatatgggcataaaagatgcaaaattatatagtgcaaatggcctacctactgaatatttgaaaagcgaaaaatatccaggtgctagcaaaaattccgaaaatgaattatctgcacaagatatggctatcattgctactaagctaattaaagactatcctgaaattttaaatacaactaaacttcaaaatgtccaattcaatgatcgtgggaaaacaacttcagtaactaatacgaataaacttttatctgataataattttcaagttgatggactaaaaactggtacatctgacgccgctggtgaatgtataacagctacaaccagtaaatatggaagtcgcattatcactgttataattggtgctaatagtgattcccaaagatttgaacaaacaaaattattactaaacaatatttctaatagctacaattatacggttattggtgctggtcaatctgttcctaatatcaacaacgttaaaatccttaagggtaagcaaaaaactctccctattgctatgcgaagaactactggtctttggttaaataaggaacaaggaactcaagatatttcagcaaaattccatcctaatagcgaaattattgccccaataaagaagtatcaaactgttggaaaagttactcttactgtggatggtagttacggatttctaaatggaaaagatggcatgacaacatctgtgagtgccaataaaactattgataaagctaatattatagttagactctggcgagacataacaagaacaaattag

SEQ ID NO: 2103 - DNA, 1320 bp, Unknownn; identical to SEQ ID NO: 738
  isolated from saliva, unidentified

SEQ ID NO: 2104 - DNA, 312 bp, Unknownn
  isolated from saliva, unidentified
atggaaaaagtacaagaattacaaagattagtcgcagagttatatgacagttttgaaaatgataatcgtaaaggtgtagaagaaattcgtcaagttctagcaaatgtaaatgaaaagtataaaacaagtagtcatccattggcttggacaggaagattggtactttatctacaagtgaatgctgtgaaaaaagacttatatttgacaccagaacaaaaggatattatcaaggaattggctagaattggtagaagaacaaatttgaattatgtttatcttagtccagtggatgatgctaaacaatttgtttag

SEQ ID NO: 2105 - DNA, 3231 bp, Unknownn; identical to SEQ ID NO: 1234
  isolated from saliva, unidentified

SEQ ID NO: 2106 - DNA, 684 bp, Unknownn; identical to SEQ ID NO: 838
  isolated from saliva, unidentified

SEQ ID NO: 2107 - DNA, 1293 bp, Unknownn
  isolated from saliva, unidentified
ccagtaatgctacataatgaaaatattcaaaaagtatatagaggtggagtgctagtttcttcatcaattttagttataagttgttttatcggaatttacgctagtgagaaaaaaatggaaaagatattatggagtatttttggtgcgttgtcattaccatttttttactatgtcaaagaagattctatatggattatgccctttatatgtgtaattatattaatatattgtgttaaaaactggtttttaattaaagaaactggaagaaaaaagatattgaacttgttacttatgtttattccaattatctccctattggtagtaacagttacatataaaaagataaatcaaggatactatggagaatatactatcacagatagaagtagcactaattttaaaaatgtaatacatgatctacttgtaatcagtgaaactaatggtggaaataaggaaatatggattactaaacaggcattggaaaaagcagaaagttatagtccgactttgaagaaatacgaacctgtaaaaaagatgtatgacaatggaggtgtgaaggtttactacggcgatttattcttttggtcatttagatatgttttcaatgatgaatatagtaaaaatggtattaagataaataagatatatgggaagatagacaaggaattaaaaaataacatagatagaaaaaacatagataacagtaaagaattatatttgtcttcagtggctaagggattatcaaagaatgatctagcatggctatggaaaaattggaagaaatattttgtggtcttagcaacatataaatataatgagttatctgtcgatgttgccacaggagatagtaatagtataaacgatatgatgcaaatcactaatacacctgctgttacacaagaggttattaatacagaatggaaaaatcaatacagaaaagttatttccgttgtacaaaaatatgtagtaggagcgtaccaaaaaactgggaaatgggtgtttttgttaggatttttaggcttagtgacattgcctgtttttgttattagaaataagagctatcaaatgttaagtttaatgggaattgttgtgggcttattaagtagtgttgtaccattatttataggagtacagtggtttagtaattttctagggtataagaaattttatgactatattggttgtgcaatccctattatgcaagtcttagaggctttaggattgttaatgttagtaagaggtactagcatcattatgcataaagtaaaaaagttaaggagaaaagatgcttaa

SEQ ID NO: 2108 - DNA, 591 bp, Unknownn
  isolated from saliva, unidentified
atgaaaaaattagttatcctaggtgctggtggccatggaaaagtcgtagctgatattgctgtgaaaaatggctatgaagaaattgtttttttagatgataatgaaacatcatgtgccggttttagcgtcgttggaaagatcgaagatgcagctaaaataaaaggagataagtttgtagcaattggggatgcaaatcttcgccaaaaattaatggaaaagattaagacagttacgttgatccatccccgagctacaatcagcagaagggtaactattggtgaagggacagtggtaatggccggagcggtaatcaattctgatactaagattggtaagggatgtattatcaatacttcggcttcggttgaccatgattgtacattagatgattttgttcacatttctgtgggagcgcatctagcaggaaatgtgagagttgcgactagaacttggctaggagtttcagctagtgttatcaacaatattgctatttgcaaagaatgcatgataggtgctggagcagtagtcgttaaagatattaataaaagtggaacttatgtgggagtaccagctagacttttaacaaggtaa

SEQ ID NO: 2109 - DNA, 597 bp, Unknownn
  isolated from saliva, unidentified
ttggagagtaaggataagatttttagacaggtactaattgctttatttagtgcaattattatcattcaaaatttcataccatttttaggttatattccaatggggccactaaatttaacaattatccacataacggtaattgttacggccttagtttttggtactaaatatggatcgatcataggtggaatatggggtgtcattacttttattagagcttttgtttggccaactagtcccttagcagcaattgtttttgttaatcctttaatttcaatattacctagaattttaattgggacagtcgctggctggttattcaagttcttaacacttaggactgggaaaagatatttaagtatgacagttgcagctgttgcaggatcattagttaatactatcctggtcctaggtcaaatctatctattttaccgtggacattcaatggctttatatcatatcgacattcaagcattattaccttatttattaggggtaatcgcaacaaatggaattcctgaagctattttagcaggaatattagcccctatgattgcaaagcctttaagaaagatgatgattgatcgtatcaaataa

SEQ ID NO: 2110 - DNA, 462 bp, Unknownn
  isolated from saliva, unidentified
gtgagtactttagacaatatggctcatgcaagtaacgaaagaagaaatcaaaatataatgaagttacgtcaagcatttaatgatgagaagtacaatacgataagtcaagctgctaaagatacgggatatacatatcaaactgtaaaaaaatgggctattgatggagatattccactccttgatgagaatggaacttcaatagttaaaatcactgaggataatcaaagaaaagtgaatgagaaacgtagaattgagcatataaataaattaaatgaaatatttcataaaaaagaagctataactgtttctgcgtgtgctagtaaattaggttatccagaggaaacaataatttcatgggcgaaacaaggagaaataccattgttaatggcaaataatgaattagtagtaccatttaacgagtacaatcgtccgtattggttagatagtgatgattttctttag

SEQ ID NO: 2111 - DNA, 957 bp, Unknownn
  isolated from saliva, unidentified
tgtggatatttgaatgcagaaaatacaaagttttgtgagaactgtggagcagatttaatagaagcgaaagtaccagaaccagggaaaacaaaagagtgcaagaattgtggatatttgaatgcagagaatacaaagttttgtgagaactgtggagcagatttaacagaaccaaaaataccagaaccagagaaaacaaaagaatgtaagaattgtggatatttgaatgcagagaatacgaagttttgtgaaaattgtggtaatccgttaaataaaaatcaaccaatacagattaatggtaacaatacagaagttgaaaagataaataaaaattcattaactccggaagattcagtaaatgaaagtaacagacgatctaaaaagaatacaaaaagtaaaaaaattccagcaatggtcgcatctgttattgtaattatcatagcaattataggatttgtttacttaaaagataataatggtcatacacaaactgctgagaataagagtgaagttactgtaaagaagagttcaactagcaagaaagaaagtccaagtagaaatagttttactagcagtaagagtagttcaagtccttctagaataaagacagaggaagtatacaatgaaaaaagagatcaatcaaatgtagatgtgactaatttaacggtttctcaatgcctattatgggcattgagtgaatgttacagtgatcaaaatgcagatgaacaaagttgggatatgctaaaagattctatagatagtgctgaagttattccagcaacaaagagtgatgatgactatgtacatatttattttaattatggatctgaggagtgtaactactatattgatggtaactacgatttatgtacagaagatgatgatgaggtagttagtcgatatccaacagaatttgaaaatgaaaaagcaaataactatataatgactcgatatgaataa

SEQ ID NO: 2112 - DNA, 978 bp, Unknownn; identical to SEQ ID NO: 912
  isolated from saliva, unidentified

SEQ ID NO: 2113 - DNA, 411 bp, Unknownn
  isolated from saliva, unidentified
atggcaaattttgaaaaagaagtaaagaataatatatttggctttggtggtaagaatgttgattatgcaaagtattttgtgggtgaaagctatttaaaatccctagttggagaagatgacattgatgtgcatgttgggaatgtcagctttgaaccaggatgtcgtaataactggcatattcatcataatggttatcaaattttgttggtaactgatggaaaaggttggtatcaagaagaaggaaaaccagctcaattgttgaaagctggcgatgtagttgtaattcatgaaggtgtaaagcattggcatggtgcaactaaagatagttggttcaatcacgttgcaatcactaaaggtaacagtgaatggcttgaacctgttagtgatgaagaatataataaattaggatag

SEQ ID NO: 2114 - DNA, 1668 bp, Unknownn; identical to SEQ ID NO: 728
  isolated from saliva, unidentified

SEQ ID NO: 2115 - DNA, 1371 bp, Selenomonas sputigena; identical to SEQ ID NO: 1320
  isolated from saliva, Selenomonas sputigena

SEQ ID NO: 2116 - DNA, 2076 bp, Unknownn; identical to SEQ ID NO: 781
  isolated from saliva, unidentified

SEQ ID NO: 2117 - DNA, 780 bp, Unknownn; identical to SEQ ID NO: 1174
  isolated from saliva, unidentified

SEQ ID NO: 2118 - DNA, 687 bp, Unknownn
  isolated from saliva, unidentified
atgaggggtgtatcaatgcaaaagagtgttgtattaaagggttataaagatggttatgaaattgagttaaaagcagatgctgctttttcacagatattaattgagttaactgaactgtttgagcgattaaaacatgaaaaagaaaagaatgatgagaaaattgcatttaacatcaaaacaggtgcaagattattaaccattgaccaaaaacatgaaattgaaaagatagttgataactaccctaattttttagtacatagaattgtttctgatgttattaatactaaagaagcattgcaaataatgaacagtaaaaatgtgcatgttaatggcgatgtaattcgtaatggacaagttaaagatataacaggggatgtcctatttttgggaaatcttcatcaaggtggagtcttgagagcaactggaaatatttatgtcatgggtagtgttagtggaattattcatgcaggttttgatagcaatgttcgatccattattttgggagatatttctggagctcaacagctaagaattggagatttagttgacattgttgatgaggaaaaagttacagctgggacagattcattagtttttgtaaatgatttacatgttttagaatttacaagtattgacaagttaaaatctctacgtccaaagatatttaatcaggtaggaggcttttaa

SEQ ID NO: 2119 - DNA, 915 bp, Unknownn; identical to SEQ ID NO: 1434
  isolated from saliva, unidentified

SEQ ID NO: 2120 - DNA, 2319 bp, Unknownn; identical to SEQ ID NO: 998
  isolated from saliva, unidentified

SEQ ID NO: 2121 - DNA, 1203 bp, Unknownn; identical to SEQ ID NO: 870
  isolated from saliva, unidentified

SEQ ID NO: 2122 - DNA, 1344 bp, Unknownn
  isolated from saliva, unidentified
atgaagaataaaatacattctatgaagtggcgaatatggaaaacagcttttgagatttttattgaaacttttttaggtttaggtttgttattagcaataacttttatcttgcagaaggcaggatatatatcaaatccgaataaagtttatttagtattagattctaataaaactactttgacggatattaggcaaacgatgaaaaaatatccttatgactttattgtattcgataggagaacaggaaaaattgtagcaagtagatatcaaaaaaatgataaagataattactacttagctaaagtaaagaataaaagttatataaatgggactacaagttatactatatcttctaataagttatatagcttagtgattagacaaaatagtgttccggaatttactaatccagccttgagaaagttttcgtataatcaaatatcatatatatttttgattatatacgaatcattaataatcattattgcaatttataaactaattcatgagatttcaaaaaattttacagctattcaaaagattgctttaaatatggggaataaggttactaaagattatcctaagtcgaaaattaaagaatttgatactgtattaaagcaactctatcaaaaaagtaatgagttatcaactttaattgagactgaacggatagaaaaagaagatttatcatttcaggtagcagcattatctcatgatataaaaacaccacttactgtattaaaaggaaatatagagttgttggaactgactaatcctgataagagacaattagaatttatggaatctatgaaaaacagtattcaaactttagaaaattattttaatacaatgattaattatactaagttactaaatttaaattcaataagcgaagaaataaatttaaatgaatttattaaagaactttttcttgaactaacagatattgccatagtcaacaaaacgaataatcgattaaaggtaaaaactaatttaaagaaatttcatgctaatgttccagctctaaaacgagcactaatcaacatttttcttaatgcgtgtcagtatgcggataaaagtaatccccaagtatcggttactgtaactgaagatttaaaatttttatggtttgaaatatggaataatggggcaccattttcagaagaagcacaagttaatgcgcaaaagttattttttactgaagataaaggccgtagtggaaagcattatggaattggactatcttttgcacaagcggttgcagtcagacatggtggtaccatgataattacaaatctagtaaatgatggggtgagtgtaaagttaggaatccagaaattctga

SEQ ID NO: 2123 - DNA, 1440 bp, Unknownn; identical to SEQ ID NO: 1332
  isolated from saliva, unidentified

SEQ ID NO: 2124 - DNA, 444 bp, Unknownn
  isolated from saliva, unidentified
gtgagcttattagagtcattgcaaaaagatatgattgcagctatgaaagcaaaagataaggtcaaacttggcactatccgtatgttaaaagctgcagttgtgaacgagcaaattgaggttggacatgacttatcttcagatgaagaaatagctgtgttatctcgagagttaaagcaacgtaaggattctcttgaagaatttaagaatgctggccgtgatgaagctgttcaaaatcttaagaatgaaataaaggttgttgaaagctatttaccagagcaacttagtgaagatgaagtgaagaccattgttcaagaaacgattgaccaagttggagcaacgtccaaagctgattttggtaaagtcatgggagcagtaatgccaaaactcaaaggaaaggctgacggaaagttagtcaatgcaaccgtaaaagaattattaaattaa

SEQ ID NO: 2125 - DNA, 864 bp, Unknownn; identical to SEQ ID NO: 1399
  isolated from saliva, unidentified

SEQ ID NO: 2126 - DNA, 600 bp, Unknownn
  isolated from saliva, unidentified
atgcaatatccagaacctatttctaaattaattgatagttatatgaaattaccaggaattggtagtaaaacggcaactagattagcattctatacaattgatatgcaagaggatgatgtaaccgaatttgctcaatctttgatctctgctaaaagagatttaagttattgcagtatctgtggcaatattactgaaagtgatccttgcatgatttgtgctgataaatcgcgagacaatagtaaggttgttgttgttgaacaacccaaggatgtaatgtcattagaaagaatgaatgagtatcatggtttatatcatgtacttcatggtgtattatctccaattgaaggaaaaggtcctgaagatataaatatcgcttctcttttaagaagactgcagaaaaatgaagcaataaaggaagttatcattgctactaatgcaacccccgaaggagaagcaactgctatgtatattgctcgtttagtaaaaccagctaatataaaagttactagattagcacatggattagctgtaggtagtgatattgaatatgcagatgagatgacattatttaaagctattgaaggacgacaagaaatttaa

SEQ ID NO: 2127 - DNA, 1113 bp, Unknownn; identical to SEQ ID NO: 1121
  isolated from saliva, unidentified

SEQ ID NO: 2128 - DNA, 732 bp, Unknownn; identical to SEQ ID NO: 1461
  isolated from saliva, unidentified

SEQ ID NO: 2129 - DNA, 468 bp, Unknownn
  isolated from saliva, unidentified
gtggcaaaaagtaagcctaaagataatgctttagcacaaaatcgtaaagcacgccatgattataatattttagagacttatgaggctggaattgctttaactgggacagaaataaaatctgtacgtgctagccgaattaatttaaaagacggttttgcgcaagttaaaaatggtgaagtttggctaatgaatgttcatatttctttatacgatcaaggaaatatttttaatcatgatcctttaagaaatagaaagttattattacacaaaaaagagattaaacatttaagtgaagaaactcagaaaaaaggaattacgatagtacctttgaaagtatatatcaaaaatggatttgccaaagtattgataggtatcgcacaaggtaaacatgtctatgacaagcgtgagacaataaaacgtcgtgatcaagaaagagaaataagaagaactttgaaaaattatggatag

SEQ ID NO: 2130 - DNA, 624 bp, Unknownn; identical to SEQ ID NO: 1172
  isolated from saliva, unidentified

SEQ ID NO: 2131 - DNA, 606 bp, Unknownn; identical to SEQ ID NO: 776
  isolated from saliva, unidentified

SEQ ID NO: 2132 - DNA, 552 bp, Unknownn
  isolated from saliva, unidentified
atgtctattatgacactattatcatggaaaagtccgaaattaaccgcccggacgatagcaatggcggcaattttaattgcgatgcagattgtcttatctaagctttcaattggacctgacaatctagttaagttttcatttggctttatcgctacaatgttaatgggttattatttaggcccatggttgacaggtgtagcaatggcaataagtgatattcttactaacagtgttttttcaacgggtggtaatttctttatcggatttacttttagtgcaattatttctggaataatcgccggagcatttttgtataaccaagagataacattgagaagattgttcatttatgagtttgttcaaactctagttacgaatattttctttacaactctttggattcatattatgtacaaagcacctattatggctttgttaactgttcgagtacctaagaatattcttacatggattgtatattcaatcgtaggattcttagttttacgtgcagtttcaaggctaaacttacgtagtaatgataatacgtattaa

SEQ ID NO: 2133 - DNA, 1500 bp, Unknownn; identical to SEQ ID NO: 1302
  isolated from saliva, unidentified

SEQ ID NO: 2134 - DNA, 1383 bp, Unknownn; identical to SEQ ID NO: 1108
  isolated from saliva, unidentified

SEQ ID NO: 2135 - DNA, 1356 bp, Unknownn; identical to SEQ ID NO: 868
  isolated from saliva, unidentified

SEQ ID NO: 2136 - DNA, 744 bp, Unknownn; identical to SEQ ID NO: 1196
  isolated from saliva, unidentified

SEQ ID NO: 2137 - DNA, 1116 bp, Oribacterium sinus; identical to SEQ ID NO: 663
  isolated from saliva, Oribacterium sinus

SEQ ID NO: 2138 - DNA, 591 bp, Unknownn
  isolated from saliva, unidentified
atgctatctaatcaagcaaaaattgagagtttgctatttattagtggaaatgaagggataacattaaccgaactttctcagattacaggaattttaaagccagctttacatgagcagttggataaattagcagataagtataagcaagatagatcctcaagtttgcaacttattcatgcagaggaaagatataagctggtgaccaaacctgctttagctgagttggtaaagaaatacttaaatagtaataatattacagaattaactggagctgccttggaaactttggcaattattgcttacaaacaaccaattactcgtattggtgttgatgaaattcggggtgtgcaatctagttcaatgattcaacgtttacaactactagagttaattaaagaaaatggtcgtttagatgctcccggaagaccaattctttacgttacaactgacaagtttttggattactttggtttagagagcctagatcaacttccagaacttgatgaagaaaaacaagaagatgaagaaatggatttaatgactttatttgaacaaacgacaggttcaacggaagatgaggaggaagaataa

SEQ ID NO: 2139 - DNA, 987 bp, Unknownn; identical to SEQ ID NO: 1426
  isolated from saliva, unidentified

SEQ ID NO: 2140 - DNA, 732 bp, Unknownn; identical to SEQ ID NO: 610
  isolated from saliva, unidentified

SEQ ID NO: 2141 - DNA, 849 bp, Unknownn; identical to SEQ ID NO: 744
  isolated from saliva, unidentified

SEQ ID NO: 2142 - DNA, 654 bp, Unknownn
  isolated from saliva, unidentified
atgattagaagtgaattattaaaattaaaaagtagtcctactatatacctattagtaagtttcactatttttgaaattgcatcagcctacgggtatttgtattggcatcgaaatttactaacttataaaaatattgtactggcatttgctctagcttatccatctttaatttctgtgataactaatatatgctttgaacaagaaagagaagcaaataattttcaagaagttcgtaagtatagtcaagtgaaattacttacaataaaaacgttaatcttagacttattattatggtggatttcattttttgtatggtggataataagttattccatagcccaagttaaattagggataatcagcggaatagcaatgtggctattgatagtattacttaatcatagtcacatgtttttatatatggttactaataaatatataaatttagtattttcattagtagagattttatttattatttttgctagtaataaaactttaatgtcagcctattggtgtttcgtagcatggcctattaactatttgattcatgcagataatagtaaactttattttagtgcaatgtggattttgatattaacaattttagattatttcatctttagaagtatagaattagaaagaatagactga

SEQ ID NO: 2143 - DNA, 717 bp, Unknownn; identical to SEQ ID NO: 627
  isolated from saliva, unidentified

SEQ ID NO: 2144 - DNA, 552 bp, Unknownn
  isolated from saliva, unidentified
atgaatttatgggtaacaggttatcggagttatgagttgggagttttcaattcaaaagataaaaaggtagaagtgatcaaatatgcattacaaaagaagatccttgaaaaaattgatgagggtttagaatgggttatcactggagcacaaatgggaattgaacagtggacttgcgaagtagtagcagaaatgaaaaaagaatatccggagcttaagttagctatcatgatgccttacagtgaatttgctggaaattggaatgaagctaatcaggaaagtttttcaatacgttgttcactggcagattttgtaggagaagttagtaaggaaaaatataagagtccgatgcaacttaaaaattatcaaaactttatgttagatcatacggatcaggcgatgttaatctatgatcctgaacacgaaggtaagacaaagtacgattatgaaatgataaagaagtatagcgaacaagaagattatccatatgatctagtggatatgtatcagctccaagaatttgcagaaatgtatcaagaaaaagatagtttttaa

SEQ ID NO: 2145 - DNA, 1551 bp, Unknownn; identical to SEQ ID NO: 945
  isolated from saliva, unidentified

SEQ ID NO: 2146 - DNA, 1080 bp, Unknownn; identical to SEQ ID NO: 1021
  isolated from saliva, unidentified

SEQ ID NO: 2147 - DNA, 1794 bp, Unknownn; identical to SEQ ID NO: 1502
  isolated from saliva, unidentified

SEQ ID NO: 2148 - DNA, 435 bp, Unknownn
  isolated from saliva, unidentified
atgtttgaagtaaaaaattctaataagttagattcacaagtttatcgagatagtttaattattagagaagatgtttttgttaaggaacaaggtgttcctatcgaaatagaaattgaaggtgaagaaggtccaaagtattactgtggatatgtagatggtaattttgtgacttgtgcgagagtgaaaatagaagatggtggagtttggcatattcaaagagtagcgaccttaaaagatagtcgtggaaaaggatatagttcaagtttacttcgtagtattgaggaagatgcgagaaaagcaaaggtgccatatttaacattaggtgctcaggatacagcgcaagctttttataaaaaactgggatatgaggttgtaggtgaaggatttctagatgcagaaatgccacatcatcgaatggataagaagctagtttaa

SEQ ID NO: 2149 - DNA, 1614 bp, Unknownn; identical to SEQ ID NO: 699
  isolated from saliva, unidentified

SEQ ID NO: 2150 - DNA, 513 bp, Unknownn
  isolated from saliva, unidentified
atgggggaagaaaaattggtagaagcagcggatttaaattctttcttaaaagaaacagtgaaaacactagattttgacggtgatatattcgttaattggaataagaaagatagacaatttgaaatggaactaactttttatgctgaaaataaagaggcaactttattaactgatactttaggtgtggagtcaactgagccagtggttacttttatagacgaaatactaatctatgataaaaatcgtgagaaaaattttgatgcagatgactatttagtatgtttgccttatgatggtaagaatggttggtctttagcagaagcaaaagcctttgtatcatatttacaaatagtattggataatggtgagtcagatttattagacttcctaacagatgatgaaaaagaaatttttgaattggtctggtctgaagatgagtataaaaagattattgagtcatatatgctaagtttacctaatccgaataataggattaaataccctaagttttag

SEQ ID NO: 2151 - DNA, 828 bp, Unknownn; identical to SEQ ID NO: 1335
  isolated from saliva, unidentified

SEQ ID NO: 2152 - DNA, 633 bp, Unknownn
  isolated from saliva, unidentified
atggttgaaacaataacaattcctgaaatagaagtcatggctgaattaataacgaatatgaaacataagagggtaggaatattaggtggtacttttaatccaccacatctaggacatttaattattgcagaacaagtaaaaagccaattaaatttagatgaagtaatgtttatccctgattaccaaccacctcatattgataaaaaaacagctatttctgctgaaaagcgactaaaaatggtgaaacttagtacgatggatgagcctggatttaaagttagtgatatagagttacgacgtaaaggtgtaagttatacaatagacacaattaaggaattgaaattgaagaatccagaagtagactattattttataattggtggagatatggttgagtatctaccaaaatggcatagaatagaagaactaattaaattagtaaaatttgttggtgttggtagacctggatatagaaaggaaagtaaatatccaattatgtgggtagatgttccaatgacagatatcagttcaactttagttagacgaaatgtaaagcaaggatgttctataaaatatttagtgacaccagaagtggaaaactatatacatgaagaaggtttgtatcgtgagtaa

SEQ ID NO: 2153 - DNA, 1446 bp, Unknownn; identical to SEQ ID NO: 1506
  isolated from saliva, unidentified

SEQ ID NO: 2154 - DNA, 690 bp, Unknownn
  isolated from saliva, unidentified
atgtatagaatcttagttatagatgatgatgtagaaattttaaaacttatgaaaacagcattagaaatgaaaaattatgaggttgtaacttgccaaaatgttcatgttccgttaaaattatcagattttgagggttttaatttaattttattagatattatgatgtcaaagatatcaggaactgaaatttgttatcagattcgttctaagatttcaacgccaattatttttataagtgctaaagatgatgaagaagatattttatatggtttaaaaattggtggtgatgattatataaccaaaccttttagtttgaaacagttattagctaaaattgatgcaaatattaaacgagaagaacgtagtcgtcaagcagttcgggatttcgcagaagttaagcgtgatatggggaaaataactttttatttggaagaacgaagggtatgcgttaatagtcaagatattcctttgactagtcgtgaatatgatattttagaattgctctcacgaaggacttctcatatttatagtcgtgaagacatttataataatgtatatgacgaatatgcagaaactttatttggatctatttccgaatatatatatcaaatccgaacaaagtttgcaccatttaagttaaatcctgttcaaacaattcgtggtgtggggtataagtggtatgaagaataa

SEQ ID NO: 2155 - DNA, 384 bp, Selenomonas sputigena
  isolated from saliva, Selenomonas sputigena
atggcttaccgtaaattaggacgcacaagtgcacatcgtaaggcaatgttgcgtaacttaacaactgatttaattgttaacgaaaaaatcgttacaacagaaacacgtgctaaagaagttcgtaaatttgttgaaaagatgattactttaggtaaaaaaggtgatttagcttctcgtcgtcgcgctgctgcatttgtaatgaatgttgttgctgatgtaaaagaagaaaacgacgatgtagttgttcaatcagctttacaaaagttatttgatgatcttgcacctcgttttgcagaacgtaatggtggttacactcgtattcttaaaatgagtgaacgtcgtggcgacgctgcaaagatggttgtgctagaattagtcgactaa

SEQ ID NO: 2156 - DNA, 357 bp, Unknownn; identical to SEQ ID NO: 482
  isolated from saliva, unidentified

SEQ ID NO: 2157 - DNA, 873 bp, Unknownn; identical to SEQ ID NO: 1429
  isolated from saliva, unidentified

SEQ ID NO: 2158 - DNA, 642 bp, Unknownn; identical to SEQ ID NO: 1417
  isolated from saliva, unidentified

SEQ ID NO: 2159 - DNA, 657 bp, Unknownn
  isolated from saliva, unidentified
tttattgtgattaaagcggctatatttgatcttgatggattgctagtggatacagaaatcgtatctttaaaaatatatcaggaattattatctgaatatggatatagttttactaaagaagaatatgcaaaacattatagtgggaaaacagaaaaagaaaatattaaacgttttatagatacatataacttatcggtatcttatcaggaatgtttagatgaagttttgaatattgaacgcaaacttatttcacaaggtgtggaattaaaagtaggggtaaaatctctacttatgtacctaaaagagaataattataaagtagctttggcaacatcaagtaccaaagatagagcgatttctattttaaaagggtacgatattctcagctactttgacgaatttgtatttagtgaagatgtaacactaagtaagcctaatccagaagttttcttaaaagcttgtgaaaaaacaaatgtatcaactaatgaagcaatagttttagaagatagtgaaaatggtattatggctgcctacaatgcacatattccagttatttgtatacctgatatgaaaagaccagcaaaagaatatttagagaaaactattgctgtttgtaaaacattaaacgatgttattgattatttaaaaacaaaataa

SEQ ID NO: 2160 - DNA, 834 bp, Porphyromonas endodontalis
  isolated from saliva, Porphyromonas endodontalis
atgatagaatttgaaaatttaatcatgactgaagtcttaaaggcaatgaaagagcttgggggtcgagtgacacgcaaagaagttaggcgagagattcgtgatcactcggatgtaatttcagaagaacaagttgataaaatcagaaagtcaaaaaagacaggaaaagagtatcatccgtttgcctataggtttaattttgctgtgaagcatttgatcacggcagggtatatcgttactgagaataaccatgatcttgaattgtcagaaaaaggacggatggttgattttgaaaagttcgatccaattcatgatgttagatctattgtagatggaccattaaatgatgagattaatcccaatgaagataatgatgagacttggcgtacagaattgttagatgctttagcaaaaatgtcacctaaaaaatttgagttttttagtcgagggctacttattcatatgggagttgacctagatgataatataggtgttagatatgtaggggatggtggcttagatggatttggctacattacatctgatgattttcgtacaactcgtgttgctttacaagctaagcgatgggatggaaaagtttctgcaccagagattgataaatttcgtggagcgatggataaacataatgctgagtatggtatttttattacaacatcagattttacgcgtgaggctatgaaaaccgctagagaagggactagggtaattacactcattaatggagatcaaatctgtgatttagtggcaaagtaccactattatgtagaaccagttacaacttatcgattaaaaaatttttattttgatgaggattaa

SEQ ID NO: 2161 - DNA, 1176 bp, Unknownn; identical to SEQ ID NO: 1323
  isolated from saliva, unidentified

SEQ ID NO: 2162 - DNA, 540 bp, Unknownn; identical to SEQ ID NO: 936
  isolated from saliva, unidentified

SEQ ID NO: 2163 - DNA, 1608 bp, Unknownn; identical to SEQ ID NO: 1353
  isolated from saliva, unidentified

SEQ ID NO: 2164 - DNA, 861 bp, Unknownn
  isolated from saliva, unidentified
atggaattaagagattttttaataagagcacatatttgtagtcaatactatggtggttcggtaaaaaacgttgcatattttatgaacgaaatacaaaaattacctacagaagaagaatttatcaagttattgaaacttagtgaaaagaaaattggaaagtatatggcttattttcttagtgatggtttaactaaagaagtagaagaaaataaaaattatggtggaatatgtacaatttttgatgaagattatcccgttttattaaaagaaatatacaatccaccattagtatttttttataatggaaatttttcacttttaaatgctcctacgttagcgattgttggggcaagaaagcattcgccatatgcgaaagaagtattaaagaaattgctaccagatattttagatgaaggtattgcaacagttagcggtttagcgaagggaatagatagtttggcacataagataacattatcagagaaaggaaaaacgataggtgtcattggaacgggactagacaggacatatccacgtgaaaattttgagttacaagccaatatggaaaaagaagggatagttttaagtgaatatgcattggggcaaaagcccttacgttttcattttccagctcgaaataggataatttcaggtttatgtcaatcattactagttgttgaagctaggagacaaagtggtagcttaataactgctaatatggcactacaagaaaatcggaatgttttagcagttccgggaaatattaattcaatattatcagaaggatgtaatgagttaattttggaaggagctaaaccaattttaagggcagaagatattttagaggaatttaaaatatag

SEQ ID NO: 2165 - DNA, 504 bp, Unknownn
  isolated from saliva, unidentified
atgatttcatttgtatgggcagaagatcaaaaacatcaaataggatataaaggacatttaccttggagacttccagccgatttggctcattttaaagaagttacaatgggtcatccaatggtaatggggaagaaaacgtttgatagttttcctggtttattaccaagacgtcaacatatagtgttaacccatgatactaacttaaaagaaaagtataaagataatccccaagtagaaattatgaattctattgatgaattaacttcttggttagatgaaaatcagtttcaagaagttagcgttattggtggagcgatgttattcaacttacttcttaataaagtagataaattatataagactgaaatactaagtgagtttaatggcgatacggttatgcctactattaattatgatgaatttaaacttgtttcaaaaaaaatcggtaaggtagatgaaaaaaacaagtatccttatgtatttttggaatacgaaagaaaataa

SEQ ID NO: 2166 - DNA, 471 bp, Unknownn
  isolated from saliva, unidentified
ttagttatgaaaataaagttgaaactttgtcaaaagagtaaaaagagtggatttacattattagaaacaataatagcaataggaattacttgtttaacatgtatgatgatattttctacactccaaatagtgtggaaaatcaatgcaaatgagactaaaaatgatagattgcagtgggagcaatttagatcagttatagaaagtagtaatttggattttaaatatgtacgtgttgacaatgagaatgatgaattgattttatatagcgatgcgatggatgatttttatgaattggacttatataagcaacaaatcaggatgcaaagaaaaattgatgggtatatgcccttgttatacaatgttcaaaaggtagagtggagatatgatgaaaataggaagtcgatttttatttcaattcggatacacggtagagaatatagcgaagaatatataatggatcgaaaaaaatga

SEQ ID NO: 2167 - DNA, 711 bp, Unknownn; identical to SEQ ID NO: 804
  isolated from saliva, unidentified

SEQ ID NO: 2168 - DNA, 1977 bp, Unknownn; identical to SEQ ID NO: 1350
  isolated from saliva, unidentified

SEQ ID NO: 2169 - DNA, 513 bp, Unknownn
  isolated from saliva, unidentified
atggctaatcatattgttttatttgaaccactaatgcctgctaatacaggaaatatcgctagaacttgtgcaggtacaaatacagaattacatttaattgaaccactaggattttcaacagatgataaatatatgaaaagagctggattggattattgggataaggtgaaaattacttatcatcctaatttaccggcatttttagaaacaattcctgaaaatggtgaattatatattgtgtctaaatttgcttccaaggcatatacagaagccgattatacaaatactgaaaaagaacactacttcttatttggtaaagaaacaactggtttaccagaaatgtttatgcgacaaaatccagaaaaatgtattagaatccctcaaaatgatgaacatattagagctttaaatttatctaatacagcagcaattgtagtttatgaagcacttagacaacaaggattccctaatttagaaactactcatacttatgaaaatgataaattaaaataa

SEQ ID NO: 2170 - DNA, 1323 bp, Unknownn; identical to SEQ ID NO: 681
  isolated from saliva, unidentified

SEQ ID NO: 2171 - DNA, 327 bp, Unknownn
  isolated from saliva, unidentified
atgattagagcaagatttttatatcgtgataagttaatttctggctttgaaatgcgaggtcatgctgattccggcgaatatggacaagatatcgtttgttcagctgtttcagtgttagctataaatacagttaatagtcttgagaaacttgctaacgccaatttgaatatcgtttctgatgatgaaaatggcggactgttagaagtacatgttagtgagaactttctttcaaatgaaagtgtaaagttattattagctagtttaaaactaggacttgaagatgttgaaaaaatgtacggtgattttataaaaatcgagaataactaa

SEQ ID NO: 2172 - DNA, 1074 bp, Unknownn; identical to SEQ ID NO: 1244
  isolated from saliva, unidentified

SEQ ID NO: 2173 - DNA, 831 bp, Unknownn
  isolated from saliva, unidentified
gtgattcatttgacaagtgtagaatgggaaaaagttaaggactattctgaaatcatatttgaaagagcaggtcaaattgccaaaataacaatgaatagaccagaaaaacataatgctttcactccagtaacggttgctgaaatgattgaagcattcacaatttgtcgcgatgacagtacaattggagcaattattttaacaggagctggtgataaagcatttagttcgggtggagatcaaacagttcgtggaaatggtggttatgtagggccagataaaattgcaagattaaatgtactagatttacagcatttaatcagaattatccctaagccagttattgcaatggttaaaggttggtctgttggtggcggtaacgtcttacagttagtttgtgatttaacaattgctgctgataatgcaatgtttggtcaaacaggacctaaagttggtagttttgatgcaggttatggttcaggatatttagcacgcgttataggacataaacgtgctaaagaagtatggttcttaaatcatttttatacagctcaagaagcatatgaaatgaactggataaataaagttgttcctttggatgaagttgaatcagtaactttggattggtgcaacgagattttacaaaagtcaccaactgcaattagatttattaaagctgcaatgaacgctgatactgacggtttagctggtttacaacaatttgcaggcgatgcaacgatgctttactatacaacagacgaaggaaaagaaggacgcgatgcctttaacgaaaaacgtaaaccagatttccagcaatttcctaagttcccttaa

SEQ ID NO: 2174 - DNA, 1803 bp, Unknownn; identical to SEQ ID NO: 1097
  isolated from saliva, unidentified

SEQ ID NO: 2175 - DNA, 1128 bp, Streptococcus sp.; identical to SEQ ID NO: 818
  isolated from saliva, Streptococcus sp.

SEQ ID NO: 2176 - DNA, 804 bp, Unknownn; identical to SEQ ID NO: 1034
  isolated from saliva, unidentified

SEQ ID NO: 2177 - DNA, 1272 bp, Unknownn
  isolated from saliva, unidentified
atgggactttttgatagaataagaaaagctttttctagtcaagatgatgaagaaaaaataaaacaagaaattattgataacgatgaagagagtataaagagtgaagaaaatgcatctgattcagatagtaatgtagtttctgaagaaaaaataagtgaagatgttgaacaaagtgttgattcacaagaaaaaaaagatgatgaatccgaagaagatagtgatgaaattctagattcaaacgaagacaatagtgaatttgttaaggaagaggattcggatgattcaagtgaacaaaatgataatttgaaagttgaagaagaagtctcaattgatgaagaaaaacgctatgacaaagggttagaaaaatcacgaaaaggttttggcgcaatgataaattcattgttagctaattttagacatgtagatgaagatttctttgaagaattagaagaaactttaatagaagcagatgtaggctttgaaacagctatgaagattagcgatgaattgagacaagaagttaaattgagaaatgcaaaaaagaaaaatgaaatttctgatgcaattattgaaaagcttgttgaaatttacgaaaatgaaggaaaagaggaagataataatttacacttctctagtgagggaccaacagtttttcttttcgtgggtgtcaatggtgtgggtaagacaactactattggtaaattagcccatcgctataaaatggaaggaaaaaaagtaatgctagctgcggcagatactttccgtgctggggcaattgaacagttagctgaatggggacgacgtgtaggtgtaacagttgtaaagaaagttgaaaagagtgatcctgctgctgtagtatttgatgcagtaaagaaagctaaagaagaagactatgacattttattagttgataccgctggtcgtttacagaataaagttaacttaatgaaagaattagaaaagattgctagagttataacaagggaaattccagatgcaccacatgaagttctattggctttagatgctacaacaggacaaaatgctttaacacaagcaaaacaatttaaagatgttactaatgttacaggaatagttctaactaaattagatggaactgctaaaggtggtattgtacttgcaataagaaatgaattacacttacctgtaaaattagtgggattaggtgaaaaaatggatgatttgcgtgattttagttcagaagaatatgtcgtagggttattcaagggattagttactccaaataaatag

SEQ ID NO: 2178 - DNA, 1353 bp, Unknownn; identical to SEQ ID NO: 602
  isolated from saliva, unidentified

SEQ ID NO: 2179 - DNA, 198 bp, Unknownn
  isolated from saliva, unidentified
atgaccaaatccagcaaagaggtcgaaacaattgagcaattgttggctgacccatgggcagtcgatattcaagccctttgggagcaagcagcccaaaatcgagatcctgataaatgcaagctgtttgatgcgttacacacttacctcttagataaacgccaagaacaaatcatcaatgaaaagcactttgtgatttaa

SEQ ID NO: 2180 - DNA, 1044 bp, Unknownn; identical to SEQ ID NO: 832
  isolated from saliva, unidentified

SEQ ID NO: 2181 - DNA, 801 bp, Unknownn
  isolated from saliva, unidentified
atgccacattttttacaagatattttagtaatattaatcgcagcatacatggcttgggataatggaacaggaaaccaaataacaggtaactggccagtaacaataggattacttgtagggttagtaatggggaatgtaagtgttggtttagtgataggaggaacactgcaattaatgtcattgggtgtagcaggtattggaggctcttcagttcctgaatatggagtcgctacgattgttagcatttatttagcaattaggactggggcaagtacaggaacggccattgcagtaggattacctgtaggaatgttaacgcttcaattagatgtagttttaaagattattaataacttctatgcacattgggctcaaagattattacatgagaaaaagttcaaaaaaattgatgcagtattttatttaacagttgtaacatggatgcttaaatatgtaattcctgtaactttagtggtactctttggaacaccgattgtaaaacttatattaaatgtaattccaacttggtttactaatggtttgcaaatagctggtggtatgttacctgttgtaggtattggaatgttgttgagatacatgccagttaaaaaatatttaacatatttaatcattggatttgttgctgctgcataccttaaagtcccagtactaggaattgccttattgggtggagctgcagcttatgctgtatatatgaaaaatattcaaaagacaaatagtacggtagctgtagcagagcaagatattgttaatgatgaaggagatgattttgatgagtaa

SEQ ID NO: 2182 - DNA, 459 bp, Unknownn; identical to SEQ ID NO: 1151
  isolated from saliva, unidentified

SEQ ID NO: 2183 - DNA, 450 bp, Unknownn
  isolated from saliva, unidentified
atgagtaatttaaataatttatatcgacaagcaattttagaagaagctaaccatccacgacataaaggtaagttggaaaataaaagtgttgaagttgaattgagaaatccgacttgtggggatgttattaccttaactgcattaattgaggataataagataaaagatattgcttttgatggctatggttgcacaatttctcaatcatccgcaagtattatgacaaatgaagtattaaataaagacttcgatacaataaaaaacatggtattgtcattttccgatatgattacaaaagaagtaaaacctgatagaaaagttttaggtgaggcaataattttagaaggggttaaacaattcccagctcgaattaaatgcgcaatgttatcatggaaggcaatttatcaacttattgagaagtatgaaggaaagggtgaaaagaatgattag

SEQ ID NO: 2184 - DNA, 1116 bp, Unknownn; identical to SEQ ID NO: 920
  isolated from saliva, unidentified

SEQ ID NO: 2185 - DNA, 1395 bp, Unknownn; identical to SEQ ID NO: 250
  isolated from saliva, unidentified

SEQ ID NO: 2186 - DNA, 1197 bp, Unknownn; identical to SEQ ID NO: 929
  isolated from saliva, unidentified

SEQ ID NO: 2187 - DNA, 888 bp, Unknownn
  isolated from saliva, unidentified
ttgagtgaattatattttcaagctgaagaagcatataaaaataaagattatacaaaagcaagaaaattactagaaaaagagtatctagaaaagaaaacatttaggacaaattattttttatttttagtatttcttaaaatagaggactatattgctgcctatgaaacggcaaatgaatatataaggcagtatattattgacaatgaaaaattcaagaagtatcaaaaagcagcaatttttgcagggatgaatgtaaaattacaagaattatcaaataatatatttgaatacgcaacagaaagtgaacaaaaagaatttgatgagaatcagcaaatgctattaacagattacttaaataaagattcaaaacttgagctaatgaaacggctaagttatctaggtgttttccctttatttcaacaaagaaaaatactgaaagatgcctatggattaagtgtagatgattttttcataaataccaaaaaaatattaatagattccaacatacatccacttttaaaaagtaacatactggatgattatagaaaattaaatttagaagaaacagtacaatacacagattataaaaatactgtcaaaatactagatgtaaaaaaattgaaagaaatagaagaatataaaatttacaaaaagatctataaagagtttaaacaattaccaataaatgactttgagaaagatttgaaatggaaggagatagttttaaagctaatggtgttgtatccattcaatgatattgaacaggatttagaacagaacctaatatatatattactatgtaatgatgagtttaaagttctaaatgaacaggaaatagctttttcgaagaaattagaagactatgtcgaacagtggaataatctgtaa

SEQ ID NO: 2188 - DNA, 1374 bp, Unknownn; identical to SEQ ID NO: 1110
  isolated from saliva, unidentified

SEQ ID NO: 2189 - DNA, 2853 bp, Unknownn; identical to SEQ ID NO: 775
  isolated from saliva, unidentified

SEQ ID NO: 2190 - DNA, 828 bp, Unknownn; identical to SEQ ID NO: 1472
  isolated from saliva, unidentified

SEQ ID NO: 2191 - DNA, 1761 bp, Unknownn
  isolated from saliva, unidentified
atgaatcaacatccaaattatattttaaatcaaattaatagtcctaaagatgtaaagaatttaacaattgatgatttaaaaaaagtagctactgaaattagacaattagttgtagaaaaagatgccgctattggtggacatgttggccctaatttgggcatcgttgaaacaactattgcttttcattatgtatttgactctcctaaggataaggtagtgtgggatatttcacatcaatcataccctcataaaatgttaactggacgtaaagaggcatttttagatccagatcattatcgcgatgttacaggatatagtaatcaagatgaaagtgaacatgattactttaaagttggtcacacttctacatctattgcattggctacaggaatggctaaagcaagagatatgaaggatgaaaatggaaatattgtggctgttattggtgatggctctatgagtggtggtttagctttagaagggctaaataatgctgctaagcttaaatctaacttaataattatcttcaatgataatcaaatgtccattgatgatgtaaatggtggtatgtataagatgttcgccgaattacgtgaaacaaatggacaaagttctaataacctctttaaggctatgggcttggattatcgttatgttgataatggaaatgatttagaaacaatgatttctgttttagaagaagtaaaagatattgaccatcctattgttgttcatatcaacactttgaagggtgaaggatatcaaccagcaatagaaagaaaacgtgaattccattggcatgtaccatttaatgttgaagatggttcaactaaaaatgtggcaacaggggaatcatataataaattaattcttgatgagttaggtagacaaattgatgatggtaaaccaattatggctattaatgctgcaataccaggtgcatttgacttagtaccatttaaggaaaaatatcctgataattatgatgatgttgatattgctgaacaatattctatcacatatgcaacaggattagctgctaatggcgcaagaccagtagtcttccataatagtacattccttcaaagagcatacgatcaattagaacatgacatggcattaaatggttatccagttgttatgctcgtaaaaggtgggcacattactgaaaactccaatacacaccaaggaatttttgatataggtatgatttctagcattcctaatttggaatatttagctccaactaatgcagaagaattaatttcgatgttgcgttgggcattaacacaaactgataaatcggttgttattcgtgaaccaattactgaagtacgacatggagaagcagatgatgattatacagagataaattatcgtgtagcaaaccaaggagaaaaagtagcaatcttaggattaggtgcattctataaattaggtgaagatgttcaaagaaagttgaaagaagatttgaatattgatgctacattgattaatccgatttctgctacaacattagatgttgaaactttaaataatctaaagaaggatcatgaattagttgtaacacttgaagatgcaagcatggttggtggctttggagaaaaggtagatcacttctatgctaattctgaaatgaaagttttaaactttggtgctcaaaaggaattaactgatatggttccagttgaagaattgtatgatcgatatcatttaaatcctgaacaaattgtagatgatataaaaagagttatagattaa

SEQ ID NO: 2192 - DNA, 1026 bp, Unknownn; identical to SEQ ID NO: 658
  isolated from saliva, unidentified

SEQ ID NO: 2193 - DNA, 696 bp, Unknownn; identical to SEQ ID NO: 1096
  isolated from saliva, unidentified

SEQ ID NO: 2194 - DNA, 426 bp, Unknownn
  isolated from saliva, unidentified
atgggagagtatagacatacgattgacgccaaaggaagattgatcgtacctgccaaatttcgcgaacaattaggggattcctttgttgtaacacgtggaatggacgggtgcttatttggatatactcaagaagaatggaacattctagaaactaaattacaaaaattaccacttacaaagaaagatgcccgtgcttttgttcgctttttctattcagctgcaactgaatgtgaaattgataagcagggtagaataaatattcctaaatctctacgtacacatgccgccttacaaaaaaagtgtgttgtcgtaggggtatctaatcgttttgaaatctggagcgaagatagatgggaagcttttgctgatgaggcagaagaaaactttgatgatatagcagaaaatatgattgattttgatctttag

SEQ ID NO: 2195 - DNA, 1020 bp, Unknownn; identical to SEQ ID NO: 766
  isolated from saliva, unidentified

SEQ ID NO: 2196 - DNA, 1089 bp, Unknownn; identical to SEQ ID NO: 734
  isolated from saliva, unidentified

SEQ ID NO: 2197 - DNA, 1083 bp, Selenomonas sputigena; identical to SEQ ID NO: 944
  isolated from saliva, Selenomonas sputigena

SEQ ID NO: 2198 - DNA, 354 bp, Unknownn
  isolated from saliva, unidentified
atggatagtaagaaacttttagaaatagttgtaaaagctgctgatagtaagagagcagaggatacagtagcattagatgttcaaggaattagtatattagcggattattttgtaattacacaagctaattctgaacgacaagtaaaggctattgctgatgcagttaaagaacaagtttatgaagctggtgctgatgttaaagatattgaaggaaaagatggagcaaactggatattattagacttaggcgatgtagtagttcatgttttcaagacagaaactagacagttttataatttagaaaaactatggtctgatgcaccattagtaaatattgccgattggataaaataa

SEQ ID NO: 2199 - DNA, 2268 bp, Unknownn; identical to SEQ ID NO: 1522
  isolated from saliva, unidentified

SEQ ID NO: 2200 - DNA, 837 bp, Unknownn
  isolated from saliva, unidentified
atgaataaaaatattatcgatactatatatgaaaaaatgcctcacatgtcgcaaactgataaaaaaatatcagaagttgtgttgagaaatcctcaaaaaacggtggatttcacaatttcagaattatccaagttagcgcaggtgagtgatgcttctgtatctcgtttttgtaaaaatttgtcattgtctgggtttcatcagttgaaagtggagttagctaaggcctcacagaatgaagataactactataaagaattagataaagataatgtaggtaattctataaaaagtatcttggataataaaatagtagagataaagaatacaatagaaggaatttcaaaaacagaattaaaagagataatgaatattttgaaaaaatctcggatagtgcagtttgctgctgagggagatacttatattgtggctcaagatgcagagtataaatttaatcaaataggtcgtttagcaatctcttctaatatgtgggaaaatgccttggcacagactttaaatatgagcagtcaagattgtatcgtggctatttctaattcaggggaatcatctagacttctaaagcaaatagaagaagctaagaagaaagaaataaaggttatagctattacaaaccattctgagtcgccattagcattgttagcagactatcatataaaaacaactttccgccaaagagtattgcagtctgaatattatttttcgcgagttgctgctatgtcagtaatagaattattattcctattattaattgtcgaagataaacaaatgctagaatctataaaaaatcacgaagaattaattgctgttacaaaaatataa

SEQ ID NO: 2201 - DNA, 762 bp, Unknownn
  isolated from saliva, unidentified
atgaatttatataatcggaaagaggttttagaaatgtcaggacattcaaaatggcataacatccaaggccgcaaaaacgcccaagatgctaaacgtggaaaaattttccaaaaaatatcacgagaaatctatatggctgcaaagagtggtggtcctgacccagatggaaacccacaattacgcctaattatggataaagctcgtgcagctaacatgccaaaggataacattaaacgtgctatcgataaggcaactggtacaggtggtgctgattatgaagaaattacatatgaaggttacggcccagctggtgtagctatcttagtacatgctttaactgataatcgtaatagaactgcttctgccgtacgtgctgattttaatagaaatggcggtaacttaggtgaaacaggttcagttagctttatgtttgatcgtaagggttacattgctattgcgcgagaagatttagacgttgatgaagatcaaatgtttgaagatgttattgaagcaggtggagaagacttacaaacttcagatgaagtatttgaaatttatactgatcctaaggcatttgcagatgtacgtgatgaattgcaaaagaaatacgatttggcaacagctgaattaacaatggttcctcaaaatacagtacccgttcctgctgataaagtagaacaattacaaagattaattgatagattagaagatgaagatgatgtgtcagaagtatacacatctgctgatttccctgaagattaa

SEQ ID NO: 2202 - DNA, 588 bp, Unknownn
  isolated from saliva, unidentified
atgacattatttggtggaacagaaaatattgctaatttagtgcgttttggagcaaagtattccccttatattatcaatggtcagtattggcgcttgataactcctatgtttattcatataggattacaacatttacttatcaatatgataactttatattttttaggaactttattagaaaatatttttggaaagacaaggttcttaataatttatctagtaagtggaatttgtgggaatatagcaagttttgcatttaattttagtagtatttctgcaggtgctagtacagcattgtttggtatgttcggttcttttttgatgttgggagaatctttcagaagaaatccatatttacaaactatgtctcgtcaattttttctattagtaatattgaatatattttttggtatgtttggtaattcggatttggcaggacatttaggtggattagtaagtggttttcttttaggttatgtcgttggggttcctaatttaggtagggtccctaaagttaaaagaattgtaagttttgtgattttactttttataaatttaataatcttaaatttgggttttacaagttaa

SEQ ID NO: 2203 - DNA, 1341 bp, Unknownn; identical to SEQ ID NO: 979
  isolated from saliva, unidentified

SEQ ID NO: 2204 - DNA, 1956 bp, Unknownn; identical to SEQ ID NO: 1459
  isolated from saliva, unidentified

SEQ ID NO: 2205 - DNA, 933 bp, Unknownn; identical to SEQ ID NO: 704
  isolated from saliva, unidentified

SEQ ID NO: 2206 - DNA, 993 bp, Unknownn; identical to SEQ ID NO: 632
  isolated from saliva, unidentified

SEQ ID NO: 2207 - DNA, 696 bp, Actinomyces sp.; identical to SEQ ID NO: 1487
  isolated from saliva, Actinomyces sp.

SEQ ID NO: 2208 - DNA, 582 bp, Unknownn; identical to SEQ ID NO: 1444
  isolated from saliva, unidentified

SEQ ID NO: 2209 - DNA, 1533 bp, Unknownn; identical to SEQ ID NO: 990
  isolated from saliva, unidentified

SEQ ID NO: 2210 - DNA, 837 bp, Unknownn; identical to SEQ ID NO: 978
  isolated from saliva, unidentified

SEQ ID NO: 2211 - DNA, 1392 bp, Unknownn; identical to SEQ ID NO: 1104
  isolated from saliva, unidentified

SEQ ID NO: 2212 - DNA, 1005 bp, Unknownn
  isolated from saliva, unidentified
ttgcctactactaggtggagtcttactaaagcaacacaaattggtataggaagtataaattatgatataagctggctattagatacattatgctattgtgcagttaattgctacgcactaatatctggttatgtaggagtaaaaagtaaatttaaattacaaaatataataaaactttggtttcaggtattattctattctgtagtattaaatataataatatgggtaacaataccaaatgtgcctattaataaagggttattaatacaaatgttaatgccgatttcttttgaaagatactggtacttctcagcatattttattctctttgcatttatgcctttcttgaatctattactgaataagctggataaatcaatggcgactaagttattaataacattaatattagtatgttcttttggggaaactttcatttttagggctaaaaccttcctaagcctccagagtggatatagtacaccatggttaataattctatatttaattggtggatatattaaattgtatggttggaagttttggaaacacgataaaacagtgtatttttcaatggcaatcctttcttttgcagttttcttattattaggtggagaacaatctcatggacgtgttctaataaattatcctgcacctacaatgttatttatgggaatagcattattaaatatttttagtaggttgtcactgaactctagaattatacaaggagtaaaattgtttgctccattgacatttggagtgtatttgatacatattcatccttttgtagcagagtatctatttaaagataaatttgctgatatagttttaaattcgcctgtcatgtttattggaaaaattataatttttagtttatgtatttacctggtttgttcaattattgagctagtacgtgcaaaattatttgaattgttaaaattgaacgtattggcagatgcaatagcggcttatatacaaagacattttgaaaagttaatttaa

SEQ ID NO: 2213 - DNA, 1092 bp, Unknownn
  isolated from saliva, unidentified
atggtttattatttgggagtcgcaactttaatatttatgggctacttcacttccaaaaatagtgataaatatttaaatgctatgctatgtatattatttatgtttattgccctacataatccctacataacaggaacagatggtagatcatatcgagcatactttaaggaaaatattccaaccttatttcatttttctgagtacaatcatacatatgaaattggctatgctttgcttaactcgctagctaagactatctataatgactactttatttttcagttaatatatagttttattgctatctttttattaggattggttttgaagaagactaaattggctgatcaggaaaaattattattattgtttgtttacttttgttatcgctttttccaaaataatatggagtttttacgccaaaatattgcgattttatttatctggctagctgttctttcagtaaatgattattaccaagaaaaaggtaaggataaaattaaatatttactaacgattattgcttggactttccaccgaagtgcgatctttaatttgatattattaccattgattgagagattgaaaaggactaatgctaaaaaattggtaataataacttcagttgcttcttttggaattttatttttaggaaatggtgtaatttcaaagattgttcagtttgcgatagtaattggtggtgaaagatatgcttcatacttgattagtccgggagaagtggtattaccgattaatttggttaattatgggatccgctatgtattttatattatgtattttttaagtattgataactatgaatatagcaagaagaaaactattttggtagttgcaagtctagcaattatttgtggctctattaatcaaaatatattcactagattattagaatattacatgataggaatttatatagcaattgttaaaagtaaacatctgatgacagctggaagatctagaaatttatatttgttaatcttgtacgtagcttttatgatcattctagcaagaaatctgatgaccgtatcgagtggtacatatatgaactatcaattatatccatttaaataa

SEQ ID NO: 2214 - DNA, 1035 bp, Unknownn; identical to SEQ ID NO: 1006
  isolated from saliva, unidentified

SEQ ID NO: 2215 - DNA, 1179 bp, Unknownn; identical to SEQ ID NO: 924
  isolated from saliva, unidentified

SEQ ID NO: 2216 - DNA, 1038 bp, Neisseria flavescens; identical to SEQ ID NO: 1064
  isolated from saliva, Neisseria flavescens

SEQ ID NO: 2217 - DNA, 1689 bp, Unknownn; identical to SEQ ID NO: 1460
  isolated from saliva, unidentified

SEQ ID NO: 2218 - DNA, 543 bp, Unknownn
  isolated from saliva, unidentified
atgaaagcgtggggaaaaatgactatacatgattcgaatgttcgggaaaaattacttcaattaggaagtcaaaaacggtacaattttacagctgaatatgcaaggtgtggttacaaagttacatataggcgtggattagatagagataaattagctccaacaattatgttcaaaaatgttaagataaataacaatctagttacagaccatctgtggttcaactacacaaaaggctttgctgagttgggaaaactaattgttggggatgttattagttttaatgcaagagttgctagctatgagaaattaggacataaaatagattataaattagaacgtccaacaaaagttaaattagttccccataaaaatggtaaagatgctttgcctatacctaacactacaaaaggtaaaaatgagttgttgggatacattatgctagagaataaaaaattttatcaagaaaataatcgtccatattacccatggtatgttgaaaagtataaaaaattcttagatcaaagatcttctaacactgtttaa

SEQ ID NO: 2219 - DNA, 780 bp, Unknownn
  isolated from saliva, unidentified
gtgggattagatttgactagaggaggagatggaatgaattctactttaaacatagcactggataatctaactttagcatttcaacctatagtcagaatagttaatgaagatacatttgaaatatctgattacgaggtattgttgcggtcgaaggacaagaagagtttccctgctacaatatttgaaaagattgtaaataatgaaagttgtaatcaaatgttttgggaatggtttactcttgaaataaagaaagttttaacagacaaaaaagttagagtagatataaatattgatccacgtcaatttttgtatcaatcaacctgggattttttggataaaatggttgagtacaaccagcaaattacaattgaaattacagaacgtgtatcgcaagaattaaacttgaaaaagggtttaattgatacagttaagcatataaaagatttaggctatcgtgtagctttagatgatattagttccggtcagtatagttttaaagttgttcaagaaaatatcaaaggtattgatagggttaagttatccttgttgatttttaatgacgatagcacagactcgaagacgaaaaatctcttcattatgtcttggataaattttgctaagactaataatgttgagttggtaattgaaggtattgaggataatatcgcagctaaagagatgttgtgccataatatcaagttgcaacaaggatttttctggcaagtacctcaagattatataagtcccaaagaagtacatagttttaaagaatttgaataa

SEQ ID NO: 2220 - DNA, 423 bp, Unknownn; identical to SEQ ID NO: 1020
  isolated from saliva, unidentified

SEQ ID NO: 2221 - DNA, 1959 bp, Unknownn; identical to SEQ ID NO: 1381
  isolated from saliva, unidentified

SEQ ID NO: 2222 - DNA, 987 bp, Unknownn; identical to SEQ ID NO: 1065
  isolated from saliva, unidentified

SEQ ID NO: 2223 - DNA, 1026 bp, Unknownn; identical to SEQ ID NO: 862
  isolated from saliva, unidentified

SEQ ID NO: 2224 - DNA, 597 bp, Unknownn
  isolated from saliva, unidentified
atgattaaaacggctgatgaatttcaaaggatttttgaagagataaagctagatcctcaaaatcaagaatacactgaaatggggattgaaccattatattatgctaatcctaaggctaaaatattaatagtaggtcaagcacctggacaaaaagctcaagatacgcatatggtctggaatgatttgagtggagataggttgaggacatggttagatgtgtctcgcgatgagttttataattcagatttatttgcgattatgccaatggatttttattttccaggaaaaggtaagggtggagatctcccaccacgaaagaattttgcagcaaagtggcatccaaagttaagaaagttaatgccaaatatagaattaactattttggtaggtagctatgctgttaagaaatatttgaatctaaaaagtagtgctaaattaactgatattgtaaaagattatcaaacatatctgccagagtattttcctttggtacatccttcacctaggaatttaatttggttaaagaaaaatccatggtttgaggaacaagtagtaaaagacttacagaaattagtatctgaaattaagaataaataa

SEQ ID NO: 2225 - DNA, 2067 bp, Unknownn; identical to SEQ ID NO: 745
  isolated from saliva, unidentified

SEQ ID NO: 2226 - DNA, 1335 bp, Unknownn; identical to SEQ ID NO: 855
  isolated from saliva, unidentified

SEQ ID NO: 2227 - DNA, 1854 bp, Unknownn; identical to SEQ ID NO: 999
  isolated from saliva, unidentified

SEQ ID NO: 2228 - DNA, 726 bp, Unknownn; identical to SEQ ID NO: 780
  isolated from saliva, unidentified

SEQ ID NO: 2229 - DNA, 1914 bp, Unknownn; identical to SEQ ID NO: 1129
  isolated from saliva, unidentified

SEQ ID NO: 2230 - DNA, 1932 bp, Unknownn; identical to SEQ ID NO: 1019
  isolated from saliva, unidentified

SEQ ID NO: 2231 - DNA, 2574 bp, Unknownn; identical to SEQ ID NO: 549
  isolated from saliva, unidentified

SEQ ID NO: 2232 - DNA, 996 bp, Unknownn; identical to SEQ ID NO: 603
  isolated from saliva, unidentified

SEQ ID NO: 2233 - DNA, 666 bp, Unknownn; identical to SEQ ID NO: 947
  isolated from saliva, unidentified

SEQ ID NO: 2234 - DNA, 1137 bp, Unknownn
  isolated from saliva, unidentified
gtgtcaaatacgattgctactactattagtaatgaccaaacttcggaaacgtctaatgttgttactttaagaaacaatcagaaaaatgagaatagttctaacgaagctgcagactctgttcaaaatgtaacttcaaatacagaaagtaatgtatctgcagaaaataaagctcctagtacaaaaaacgctacacttaaatcagatacaccagaagtaagtgctcctgtggaaagtaatgcaaatacatctgcagctccagcaatgagaatggcaacaagtacaacaacaggttattatcgtaatgcagcaggtatagtaaatcaaaataacattaatactcagccagctaaagaaaatcaagaattggccaataagactaatctaacttcttcagataactacagttctaatatctataaaggtaaagatgaaaattattacaagattgtaactatttatggtaatgactacgtttaccgtgctgctgacattcaagctaatggtactgcttttttgcaaaaggcaacgacagctgaagatactaaaaataatatcaatatttctaaagaagatttaggaaatggtaagacccgttggactgttgttttcttccctaataagggattacaaaatgttggcagtaacttaagtgggttaacttctacaaaatttggtattgctcttacttctgactaccaaatcgatggtaatgttgacatgaaagtaattagtgatcctaaaaaatcatttacgtcttatacatttgagcccggtagcaatagcgctactaccgttccaatacaaaatccatcagctgaaaaagacttttcgtttaatcctaacacagatgttgatccaaatactggtttaattaatagtgaaaccatgccagcttataacaatcaatatttgcaaggcccatactatttcaccactgctactaatactggtgctaagaacttatggcagacttactttaaagatgctgttgaatataataatgcatatgatgggtccccttatctaggtggcaatcatgactttcatcttaataattttgaaattaaaaatgaaactggagttgttgacggtgcaaaatatcgggacaaaatcatttatggacacactggggtatag

SEQ ID NO: 2235 - DNA, 342 bp, Unknownn; identical to SEQ ID NO: 1390
  isolated from saliva, unidentified

SEQ ID NO: 2236 - DNA, 681 bp, Unknownn
  isolated from saliva, unidentified
atggaatttttattagatacagttgatttgaaaaagattaaatattactgtgataaattaaatgttaaaggagtaacttctaatccaacgattctaaaaaaagatggagtaggcgatgatttattcgcacatcttaaaaaaataaaggaaatcattgaagatgaaagagaactccacgtacaagttgtggcaccttcagtatctggaatgatagatgaagctcataaaattgtagatgaagtaggtaaggatgtatacatcaaagttccaactactttagatgggttagaagtcatgaaaaaactaaaggctgaaggaattagggtaacagcaactgcaatttatacggaatttcaaggttatcaagcaatcaacgttggtgctgactacttggctccttactataatagaatgttaaatcaaaatattaattcagctgaagttattagaaatctatctaaaagaattaatttagataatagcaatactaaaattttagctgcaagtttccataatgtagcacaagtaaatgaagcattaagtaatggtgctcaagctgtaacagttggtcctgatattgtagcatctgcttttaagatgccgtctatttctcaagctgtggcagattttagaaatgactgggaaagtctatacggtgataaaaatataaataacttatag

SEQ ID NO: 2237 - DNA, 447 bp, Unknownn; identical to SEQ ID NO: 1519
  isolated from saliva, unidentified

SEQ ID NO: 2238 - DNA, 1902 bp, Unknownn; identical to SEQ ID NO: 1084
  isolated from saliva, unidentified

SEQ ID NO: 2239 - DNA, 1026 bp, Unknownn; identical to SEQ ID NO: 642
  isolated from saliva, unidentified

SEQ ID NO: 2240 - DNA, 996 bp, Unknownn; identical to SEQ ID NO: 849
  isolated from saliva, unidentified

SEQ ID NO: 2241 - DNA, 2034 bp, Unknownn; identical to SEQ ID NO: 1324
  isolated from saliva, unidentified

SEQ ID NO: 2242 - DNA, 1176 bp, Unknownn
  isolated from saliva, unidentified
atgacctatttaggaacactttgcttagttttgctgaccactgcttttgctggcagtattagtcggaaaattggaatgcctgcagtaattggacaattattagtaggtattattctaggaccagcaatgctaggctgggtgacaaataataattttgtccacattttttcagaaattggtgtggtcatcttgatgtttatggcaggattggaaagtgatttagatttattgaaaaaataccttaaacctgccacttcagtagctttatttggtgtaattgcgccaattattttagtatatcttttaggacgaatttataattttactaatgaagaagcaatttttcttggtgtaacttttgctgcgacttctgtatctatttcagtggaagtattaaaagaattaaaaaaattagatactaaagagggtactactatactaggagctgcagtgatagatgatatattagcagttttaattttaagtattttagtaagtatttttagcgatgttgctaaggcagaaggtggacatacacagtcaaatttaggtgtaggcatcttaattcaagtgatttactttattgggatttacctagttttcagatggattgcaccatttttaatgaagataagtgaaaagctattaatatcttcaagtgaaattttaatgtcactagtaatttgcttgggaatggcattttttgctgatttagttggtttaagtgcagtggtaggttctttctttgctggagtagcagttgcgcaaactccatataagagagaaatagattcaagtattgaaccaatcggttatgcagtatttattcctatgttttttgtgtcaattggattaagtatgacctttaaaggtttattgacaaattggttatttattgtaattttgctagtattggccttactaacaaaatggggtggctgtggcttaggtgctaaaatgctaggaatgagttggcattctggcgatattatcggagcaggaatggtttctcgtggagaaatggcgttgattattgcccaagtaggctatgaagcacacttgttatctgataagttctattcaagtgttattatcgtaatcatcttaactacaatcattgcaccatttatgttgaagtcagcaattatgcgccaagcaaaggcagaagctaaataa

SEQ ID NO: 2243 - DNA, 414 bp, Unknownn; identical to SEQ ID NO: 742
  isolated from saliva, unidentified

SEQ ID NO: 2244 - DNA, 762 bp, Unknownn; identical to SEQ ID NO: 960
  isolated from saliva, unidentified

SEQ ID NO: 2245 - DNA, 789 bp, Unknownn; identical to SEQ ID NO: 953
  isolated from saliva, unidentified

SEQ ID NO: 2246 - DNA, 2376 bp, Unknownn
  isolated from saliva, unidentified
gtgaaaaatttgataaaaaaattatgtaatgcattaatggcatgtgtagctatggtaatagttacattttctttattaatagcacaagcaaatccaacttttttgcaaagcaatttactatcgaaaagactatttgcatacagtttattaaataatttttctaatgtaattatcggtgtattactaattttaattggttatcaaataaaaggaaatataaaactcataaagaaatatgtatatatttatgtagtaaacttattgatatttatagggttgtttttgtggactagaagtttcactatccaaaatttgtacgatgcagttcttccaattactagaaatacttatccaattgtacttggtgctatatctgcactattgataaaagataagttaaagaattggtttaagaagtataggtttccagtaattttaagtggatatgctatagtttttgcattaccaagtatatttaataaagatatttttgggataggtaatggaaataatgctattacagcttttttgttggtgacattaggaatagtattttcaaatgtagaagtggacaagttacatatagataaaaaagttattactttaatgagtataagtgtaatgctaaatataaccttagcactttctatgccgttcatatcttggagaatacgtggagatttttcaacagcgtacagatttaatgtgctaacttcaatatctgttgtagcaatgtctatagttatatttacagttggacaaaaattaaagacgaacataaagatatcagaatatataggattactactattacttgtttattcgaataattttattattgaaaaaattgttaatggtagtataagtttaaaagtgttgctttttaagagttgcatagtttctataattgttgttgttttagggtggctattatcaaaaatagataaaagaaaccttactttagaagaaagactgttattgaatgatgataaaagtataaatctatggggcagaaatttaatatcatatataattactaatgttaagaaatatagatttaacatcatgaacattatttttttgtatattttagcttatgtttcatttattttaatgtcacctgatttttcagcaccacatttgggaaaagatcatactaatatttttttctataccttttttgtcaggcaacatatgctgatattaaatacaatgttgttttatctattatatagatttatttatgggataattggtagattttggataagtataatattgaattatgcagtaatagcagttgcaattgttgcagatgctataaaaattcattatcgtacagaacctattttacctgctgaagtaacaatggtttcagcctatggtgatatattgagtatggttcctcaatttattttatggataacagcaataataattgttatattgattggtataattatttattgtgaaagaaaactaccacaaaataaagtaaagtggagatttagaatattagggatagtatttgcagtattggtatatagcagtagtacaagaattaatcatgaaggctcaattgttggtgattttttaaattcatatgggaaccttcctacatttgaaaatcaagagcagggggctcaacaaaatggagctttgcaacaattcttaaataatatagatgtcacaattatgaaaaaagaaactgactattctaaaaagaaagttgataaattagctagaaaatattctaaattggcgaatgaaataaatgtgacacgtgataataacttgtctacacaaactattatctttaacttgagtgaaagtttggcaaatcctaatagattgaaagaagtagaattatcacataatccattatcatacatagatagtgtcaagggaaatacaacatctggattaatgataagttcaggattagggggtgggactgctaatatggaatacatgactttaacaggtcttccagtaagtaatttttcgccaacaatagctactgcttacacacaagtggtaccagaatctgaacgaactttgactattaatgaatactttaaaaaatcaactgcaattcatccatataatggtagtttttatagtagaaaagcagtttaccagaaatttggtttccaaagatttatgtatctaggaagtaaatataagataaagcataagataaaaattgggactaatccatatttatcagatgaaacggcatatcaaaatacattagatgtgattaataattataaggatggacaatttattaatttagttactatgcagaatcatcttccttattcagattactatgataattctagcgattaccaagcgagtggcgatatggat

SEQ ID NO: 2247 - DNA, 2661 bp, Unknownn; identical to SEQ ID NO: 732
  isolated from saliva, unidentified

SEQ ID NO: 2248 - DNA, 1401 bp, Unknownn; identical to SEQ ID NO: 643
  isolated from saliva, unidentified

SEQ ID NO: 2249 - DNA, 792 bp, Unknownn; identical to SEQ ID NO: 1139
  isolated from saliva, unidentified

SEQ ID NO: 2250 - DNA, 723 bp, Unknownn; identical to SEQ ID NO: 777
  isolated from saliva, unidentified

SEQ ID NO: 2251 - DNA, 726 bp, Unknownn; identical to SEQ ID NO: 807
  isolated from saliva, unidentified

SEQ ID NO: 2252 - DNA, 516 bp, Unknownn
  isolated from saliva, unidentified
atggcaaaaaagaagaaaaaaactaaagaaaaaaagactaatgaagaacgagtattagaccaacacaatataaaatatgaagaaacatctttcaattggatagagcaaggaaaagatgcattgaaggaagctgctgaattaggagtagaacctgaatctattttaaagacaattgtgttacagggtaagggagatcctaaagacttttttgtagtttgtttaccaattgtacatgaaatggatttgaagttagttgctcagcaattaggtaaaaaacaagtacacctagctgataataaaaacttgattaatataactggttatattcatggagcaaatacgccaattggtattcatgcttttaaaggttttccaatctattttgatgaaagaattaaaccttttgaagtaatttcagtatcagctggtaaagttggacgttctgttagattaaaacaagaagatttagttaaactggttaatggtaaatatattgaagttgagagaaaagaatag

SEQ ID NO: 2253 - DNA, 1770 bp, Unknownn; identical to SEQ ID NO: 1227
  isolated from saliva, unidentified

SEQ ID NO: 2254 - DNA, 1527 bp, Unknownn
  isolated from saliva, unidentified
atggataaagacaaaagaatagaggagcttgaaaaggaaaatcaacaacttcataaaaagattgaagaattgtctgaaactattaagcttctcaatgcccgtatttttggaaaaaaaacggaaaaattagataaaaatcaactttcatttttttcagaggctgaattagaagaattagatatagattctgatatttcatctaaagaaaatgaagaagttgaagtagagcttagagtagtttgccaccgaaaagttaaaccacgtggtcaacgagctgagtttcttgatactttagtacaagtagatgtcgttcatgatcttgaacaaaaaaattgtgctgattgtcatgaaaaactcactctaattggcaaaaaatgtgtttatcgagaggtaggcttgaaacaacctgagcttttttgtcgtaatcattatcagcaaacctataaatgtgaaaattgccacccaaaaggtggcgataaaatagttgccggtaaagtacctactagtcctatttttccacatagttatttttccagtagtgtattggctcaagtagttacttctaaatatttaatggctgtaccattgaatagacaagcaatatattttaaacatattggcttaccaatagatacaaagcatatggcacgtgccatcattaaattgagtgaacagttagaaacggttcacgatgaacttactaagattttattgaaaaatccggttattcatatggacgaaactccttttcaggtgttggaagaaaagaatcgaagtaaatcgtatttttgggtaatgagaacgacagaagaattttcaaatcatcaaatagtggtgtttaattactctagtagccgaaagcaagaaaatatttctaatctggttggagcttacactggagcaattatgtgtgatggttataatgcctatagcagtgaaatgtatccacaaattacatatggtagctgtttggtgcatatacgcagacattttgtggaaatagtcaaatctttaaaacaaggaagaggatcatatgcagtaagagcggtagaattattaaatcgtatttttaaagaagaaaagaagcttgagtatcaaaatgcagaagaaaaagtactgaagcggaagcttcatttgaaaaaatatgttgatgaattctacgattttctggatactatccctaatcctagcagtaaattaaagaaagctgttgaatatgccaaaaaatttcagcctagattagaaaatatatataaaattggcgaactccctctatcaaacaatccgatagaacaagtgattaggctatctaccttagttcgtaagaactcattgtttgcgagaagcgttgatggtgccaaagctagtgcaatattttatagtttagttcaaacagccaagttgaatggcttagatatattcaagtatttcaactacattttctcactattagaaaaacgagaaaatgtcaaggttggagcttatttgccatggaattctaaagttaaagaaatttgtacaaagtaa

SEQ ID NO: 2255 - DNA, 282 bp, Unknownn
  isolated from saliva, unidentified
atgttaatgaatttacaattcttcgctcataaaaagggtggtggttccacagctaacggccgtgattcacaatctaagcgtttaggtgctaagagtgctgacggacaagttgttacaggtggttctatcttataccgtcaacgtggtacacgtatttacccaggtgttaacgttggtatgggtggcgataacacattatttgcaaaagttgcaggtgttgttaagttcgaacgtaaaggacgcgacaagaaacaagtttctgtttaccctgttgctgaataa

SEQ ID NO: 2256 - DNA, 690 bp, Unknownn; identical to SEQ ID NO: 1042
  isolated from saliva, unidentified

SEQ ID NO: 2257 - DNA, 1311 bp, Unknownn; identical to SEQ ID NO: 1037
  isolated from saliva, unidentified

SEQ ID NO: 2258 - DNA, 2148 bp, Unknownn; identical to SEQ ID NO: 731
  isolated from saliva, unidentified

SEQ ID NO: 2259 - DNA, 396 bp, Unknownn
  isolated from saliva, unidentified
atgaatgccaatcagttaaggaggctatatattatggctgtaaaaattcaaaaccaattaggtaatattgatatttccaatgatgttattgcaacagttgttggtggagctgctactgaaattttcggtattgttggcatggctagtaagaatcaaattcgtgataatttaaatgaaattttacgtcgtgataactattccaagggtgtagttgttcgccaacaagaagatggagtagctattgacgtttatattattgcaggttatggtacaaaaatttctgaagtatgtcgtaatgtacaaagtaaagtaaaatataacttagaatctatgcttggagttaaagctgagtcggttaacgtcattgtacaaggtgtacgtgttattggagattaa

SEQ ID NO: 2260 - DNA, 1026 bp, Unknownn; identical to SEQ ID NO: 1265
  isolated from saliva, unidentified

SEQ ID NO: 2261 - DNA, 1383 bp, Unknownn; identical to SEQ ID NO: 1233
  isolated from saliva, unidentified

SEQ ID NO: 2262 - DNA, 696 bp, Unknownn; identical to SEQ ID NO: 1410
  isolated from saliva, unidentified

SEQ ID NO: 2263 - DNA, 1380 bp, Unknownn; identical to SEQ ID NO: 1455
  isolated from saliva, unidentified

SEQ ID NO: 2264 - DNA, 1410 bp, Unknownn; identical to SEQ ID NO: 761
  isolated from saliva, unidentified

SEQ ID NO: 2265 - DNA, 1008 bp, Unknownn; identical to SEQ ID NO: 1331
  isolated from saliva, unidentified

SEQ ID NO: 2266 - DNA, 1296 bp, Lachnospiraceae bacterium; identical to SEQ ID NO: 290
  isolated from saliva, Lachnospiraceae bacterium

SEQ ID NO: 2267 - DNA, 1116 bp, Oribacterium sp.; identical to SEQ ID NO: 1448
  isolated from saliva, Oribacterium sp.

SEQ ID NO: 2268 - DNA, 483 bp, Unknownn; identical to SEQ ID NO: 1023
  isolated from saliva, unidentified

SEQ ID NO: 2269 - DNA, 591 bp, Oribacterium sp.; identical to SEQ ID NO: 1437
  isolated from saliva, Oribacterium sp.

SEQ ID NO: 2270 - DNA, 900 bp, Unknownn
  isolated from saliva, unidentified
atgacaacaaatgatttaagagaattgtttttggatttaaatgttaaatttgatgaagaattaaagaaatatacaaatacaaaaacaggaggaaaagctgacgtattagcttttcctgacagcattgaagaaactgaaaaattaattaaaattgctaaaaaaaataatgtaccgttgacaattttagggaatgcaagcaatttaatcgttaaagatggtggaattagaggtctagttgtgattttacaacatctagatcagataaccgttgatggaacaaaagtcacagcacaagcaggtgcttctttgataggaacaacccgtgtagcagctaagcacagtctaaccggaatggagtttgcgtcaggaattcctggtagtattggtggagcaatatttatgaacgctggagcttacggtggggaaataaaaaacattgttgaatctgttaagttattaactcgtaatggtgaatacaaaacttatactgtagatgagttagactttggttatcgccatagtcgtttacaaagtgaagatgatattgtagttgctgcaacctttaaactagaacatggtgatataaagaaaattagggagagaatggaagaacttagctttttaagagcttcaaaacaacctctagagtatccatcttgtggtagtgtatttaaacgtccagcagggcattttacaggtaaattagtacatgactcaggattgcaaggatatacagtaggcggtgttcaagtatctaaaaagcatgctggatttattgtgaatattggtaatggtactggtaaagattatttagatgttattcatcatgtccaagcagttgtgaaggaaaaatttgatgttgaattagaaacagaagttaggataattggtgaagattaa

SEQ ID NO: 2271 - DNA, 930 bp, Unknownn; identical to SEQ ID NO: 234
  isolated from saliva, unidentified

SEQ ID NO: 2272 - DNA, 2493 bp, Unknownn; identical to SEQ ID NO: 1086
  isolated from saliva, unidentified

SEQ ID NO: 2273 - DNA, 468 bp, Unknownn; identical to SEQ ID NO: 1201
  isolated from saliva, unidentified

SEQ ID NO: 2274 - DNA, 831 bp, Unknownn; identical to SEQ ID NO: 1505
  isolated from saliva, unidentified

SEQ ID NO: 2275 - DNA, 2238 bp, Unknownn; identical to SEQ ID NO: 758
  isolated from saliva, unidentified

SEQ ID NO: 2276 - DNA, 552 bp, Unknownn; identical to SEQ ID NO: 881
  isolated from saliva, unidentified

SEQ ID NO: 2277 - DNA, 1326 bp, Unknownn; identical to SEQ ID NO: 1260
  isolated from saliva, unidentified

SEQ ID NO: 2278 - DNA, 1620 bp, Unknownn; identical to SEQ ID NO: 1259
  isolated from saliva, unidentified

SEQ ID NO: 2279 - DNA, 399 bp, Unknownn; identical to SEQ ID NO: 1288
  isolated from saliva, unidentified

SEQ ID NO: 2280 - DNA, 954 bp, Unknownn; identical to SEQ ID NO: 679
  isolated from saliva, unidentified

SEQ ID NO: 2281 - DNA, 1098 bp, Unknownn
  isolated from saliva, unidentified
gtgaaaagaattttgattattgcaaataatgatgtaggcttatataaattcagaaaagaactaattacggaacttactaaagaaaatgaagtctatttgcttctgccatgtggaaaaaatgtcgataaattaatagcattaggtgctaaattcattgattgtccttatttagaaagacgaggaacgaatccatttaaagatatgcggctaatgttgtattttagaaaaaatattaggaaactaaagccagatgtgattttgacatacacaatcaagcctaatatttacgggggatatgctgctcgcttatgtaagattccatatatagttaatgtcacaggcttaggaacagctttagaaaatgaagggattttacaaaaaataacaagtttgatgtacaaggtagctttaaaagatgcgaaaaaaattttctttcaaaatcaagctaaccaggattttatgttagataggaaaataatcgataaaagcaatagctatgaaattattcctggatctggggtaaatttacaagaatatcaagttaaaccctatcttaagcaagaacaagtaaagtttgcctttgtttcgcgcattatgaaacaaaaagggatagatcaatatttagcagctgctaagtatattaaaaagaaatatccagaaacagaatttcatatttatggcttttgcgaagaggagtatcagggtgttttaaataagttacatgctgaaaaggttattaattatcatggaatggttcaagatatgcagtctgtgtatcaaaaaatcagttgtttgattcatccaacttattatccagaaggaatgtcgaacgttttgttggaagcatgtgcgagtggtcgaccaattattacgactgatcgacctggtagtcgagaaattgttgatgatggggtaaatggttttgttgttgcagaacaaaatagcaaagacttaactgataaaatagaacaatttcttcatttaaatctaagtcaaagagaaaaaatgggagttgccgcacgaaaaaaagtagagcgagaatttgatcgacaaattatagtatctaggtatcttgctgaaatacaaaatattagatag

SEQ ID NO: 2282 - DNA, 450 bp, Unknownn
  isolated from saliva, unidentified
ttggattttaatgatgtgaagaagttaatggaagacttcaataactctcctacacgagaacttgaaatcacaacggatggttttcatattcatttgagtaaaaatgaagcaccatttattagccaagataataaaaattatgctgattctccagctattgaagctagcgatgaaagtattgtaagcagtaaaagcgatgatctcgatgatgctagtttgataaaatctccaatggttggaacggtatatcttcaacctgaaccagaaaaagcagcttatgtctccgttggatcacatgttcataagggcgatgttgtatgtattattgaagccatgaagatgatgacagaaatcaagagtgagtacacaggtgaagttgtagaagttttggttgataatgaagatttagttgaatttgatcaacctttatttaaaattaaggaaggttag

SEQ ID NO: 2283 - DNA, 1590 bp, Unknownn; identical to SEQ ID NO: 1178
  isolated from saliva, unidentified

SEQ ID NO: 2284 - DNA, 1197 bp, Unknownn; identical to SEQ ID NO: 1081
  isolated from saliva, unidentified

SEQ ID NO: 2285 - DNA, 909 bp, Unknownn; identical to SEQ ID NO: 1077
  isolated from saliva, unidentified

SEQ ID NO: 2286 - DNA, 945 bp, Selenomonas sputigena; identical to SEQ ID NO: 993
  isolated from saliva, Selenomonas sputigena

SEQ ID NO: 2287 - DNA, 1458 bp, Unknownn; identical to SEQ ID NO: 702
  isolated from saliva, unidentified

SEQ ID NO: 2288 - DNA, 2178 bp, Unknownn; identical to SEQ ID NO: 630
  isolated from saliva, unidentified

SEQ ID NO: 2289 - DNA, 1545 bp, Unknownn
  isolated from saliva, unidentified
atgaatttttttaattatttatttaaaagtagtcgttcaataataaatatactatttacaatatttattggtttgactttctattttaccctaacttcgagtaatttactgttaaattctcaaacaacaacttgggtaacaatggtaatgctactaggattagtgggtataatcatcattatgataactgacaactttgttaaaagatttgcgcgttctgtataccaaagtggttggttaggtatgttagttttgggaatattattattaatttggcagatattctttatagttgcgacacatccagcgataggatttgatgttaacatgttacatcaagcttggattaatcctaatcaagcaaaggttagaggatatttcagccaaaattataataacttgccaattttattgcttcaaaattggatattaactaagtttcacagcacatcttggttggttatagattctgtgacgctatttttagtcaatttatctgcattaatcaatatagtcacaatgtatctagtttctaaagacaaagtaagactattatggtatttacaaattatttttctagctttctttcccatgattattattccttatacagatacatgggtgttaccgtctgtttccttaatattattaggatttgtaggtatgagtagccatagtttcaatttaatttatagaatattattttcagtaatggccggagtagctacagttattacttactacatcaagccttcaggtattattccagctattgcttttataatagtaggcatagtttatttgtgtaataaaccagataaaaaaagcttattaagagcattttgtttgctagtatttctatttggaagtggagctactacatttgttttaggacaaaatattatttctaatcaaaagtatgtatccattgataaaagtttggaaattccttcaattcattttgtaaatatgggaatgtcagggacaaccggtgcatataatccacatgatgcactaatgatggctaaacttccaaagaaacaagataaaattgcatattctaagaaaatgatacgtaagagattaaaacaacgtggacttttgggatacatttcctttttaattaggaaacagggatacaatacagctgatggaacatttggttggctaggtgaaggtacgtttatctttactaaaacaccggcatctaattggaaatggtgggctcaaacttttacctatcctgctgggaaaaatgtatctgtatttcgtttcataagtcaattaatctggatttccttgataggaattttatttttcggatggaaatatcacgatcttgttagtgatggattacgtctttctcttattggaggatttctatttctcttaatttttgaaggtgggagaagtcgttatttaatacaatttttacctagtattataattttgattccgattgtatggcaaagtagcaaagaaactattgccaaaatattactagctacaggattaaagaagatggaggtgtcgcaaaatgcttaa

SEQ ID NO: 2290 - DNA, 795 bp, Unknownn; identical to SEQ ID NO: 1517
  isolated from saliva, unidentified

SEQ ID NO: 2291 - DNA, 558 bp, Unknownn; identical to SEQ ID NO: 1025
  isolated from saliva, unidentified

SEQ ID NO: 2292 - DNA, 504 bp, Unknownn
  isolated from saliva, unidentified
atgagtaaggaaattatcgcaaagaaagctgctatcgttgaagaagtttttgaaaaattccaaagtgcttcttctgttgtagttgttgactaccgtggcttaactgttgaagaagttactgatttacgtaagcaacttcgtgaagctggtgtagaaatgcgtgttatcaagaatacattcttgaagcgtgcagctgacaaagcaggttatgaaggtttagatgatacattctctggccctactgctgttgcatttggtggtgaagacatcactgcacctgctcgtattatggctaaatttgcagaggatcatgaagctttagaaattaaaggtggtatgatcgaaggtaagattgcttctcttgaagaaatcaacgctcttgctaaattaccaaaccgcgacggattactttcaatgctattatctgtattgcaagctccagttcgcaactttgcttatgcagttaaagctgttgctgacagcaaagacgaagatgcagcttaa

SEQ ID NO: 2293 - DNA, 963 bp, Unknownn; identical to SEQ ID NO: 937
  isolated from saliva, unidentified

SEQ ID NO: 2294 - DNA, 570 bp, Streptococcus sp.; identical to SEQ ID NO: 1418
  isolated from saliva, Streptococcus sp.

SEQ ID NO: 2295 - DNA, 1485 bp, Unknownn; identical to SEQ ID NO: 1146
  isolated from saliva, unidentified

SEQ ID NO: 2296 - DNA, 1311 bp, Unknownn; identical to SEQ ID NO: 1009
  isolated from saliva, unidentified

SEQ ID NO: 2297 - DNA, 1251 bp, Unknownn
  isolated from saliva, unidentified
atggaaaatagattaaatatagcagtagctggagtgggctacgtgggaatgtcattagctgtgttacttgcccagcataatcatgtatcagcagttgacacagttcctgagaaagtagaattaattaataaacgacaatccccaattcaggatgaatatattgaaaaataccttgcagaaaaagaactagatttacaggcaactactgatgggaaggaagcttattgtcaggcggatatagtgattatagcgactcccaccaattatgatgtggttaaaaactattttgatacaagttccgtagaaagtgtaattgaaatggttttaagtgttaatacccacgcaacgattgtcataaaatcaacaatccctgtaggttatacagagtcagttcgagaaaaatatcaaacagataggattatttttagccctgaatttttgcgtgaatctaaggctttatatgataatttatatccaagtcgaattattgtagcgactgataagagtgatgagaagcaacttaaagcctcgcaacagtttgcagaattattgcaagaaggtgcaataaaagaagatattccagtattattccctggattttcagaagctgaagcaataaaattatttgctaatacctaccttgctttgagaatttcattttttaatgaattagatacttatgctgaatctagaaatttgaatacccaagacattattaaaggtgtatcattagatgaaagaattggagatcattataataatccgtcttttggttatggtggatattgtctgcctaaagatactaagcaattattggccaactaccaagatatcccagaagacttaattgaggcaattgtgaaatctaatagtacaagaaagagttttattgctgatcaggttttgaaaaaggctggttattatgattattctcaagatatgatttataatccaaacgaggaaaagcaaccagttgttggtgtttatcgtttaactatgaaatctaattctgataatttccgtgaatcttcaattcaaggagtaatgaagcgtgtaagagctaaaggggcacagattataatttatgagccaactttggatggtaatacaacattctttggtagtcagattattaacgacttagagagatttaagcaaatgagcgatgtcataattgctaatcgatatgaaaagtgcttagatgatgtagaagaaaaggtatatacacgcgatatttttaaacgtgattag

SEQ ID NO: 2298 - DNA, 654 bp, Unknownn; identical to SEQ ID NO: 1286
  isolated from saliva, unidentified

SEQ ID NO: 2299 - DNA, 921 bp, Unknownn; identical to SEQ ID NO: 792
  isolated from saliva, unidentified

SEQ ID NO: 2300 - DNA, 864 bp, Leptotrichia buccalis; identical to SEQ ID NO: 535
  isolated from saliva, Leptotrichia buccalis

SEQ ID NO: 2301 - DNA, 1365 bp, Unknownn; identical to SEQ ID NO: 1533
  isolated from saliva, unidentified

SEQ ID NO: 2302 - DNA, 675 bp, Unknownn
  isolated from saliva, unidentified
atgttaaatatttcacgaaaagaggaaagtctaatggcagaagtaaagattccgcaggctactgcaaaacgtctaccgatatattatcgttatctaagactattatctaattctggaaagaatagagtttcttcaacagaattagctgaagccgtaaaagtagattctgctactattcgacgtgatttttcgtattttggtgctttaggtaaacgtggttacggatatgatgtacaaagtttacttgatttttttactaagcaattaaatcaagatacgctaactaatgttgctttggttggggttggtaatttaggacatgctttattgaactttaatttccatcaaagtaatcatgtaagaattagtgcagcatttgatgtaaatgaagatattacaggaacaattcaaagtggaattccagtatatccaatgtctgatatgaaagaacaattaaagttacagcaaattgaaattgtaattttaactgttccagctcctgtagcacagaaagttacagatgagttagtggaagttggtgtaaggggaatattgaattttacaccacttagaattactgtaccagaaaatatacgtgtgcaaaatgtagatttgacgaatgaaatggaaactttaatttatttcttgaatcattttggaagcacagaagagtaa

SEQ ID NO: 2303 - DNA, 807 bp, Unknownn; identical to SEQ ID NO: 718
  isolated from saliva, unidentified

SEQ ID NO: 2304 - DNA, 1689 bp, Unknownn; identical to SEQ ID NO: 1142
  isolated from saliva, unidentified

SEQ ID NO: 2305 - DNA, 792 bp, Unknownn; identical to SEQ ID NO: 1374
  isolated from saliva, unidentified

SEQ ID NO: 2306 - DNA, 894 bp, Unknownn; identical to SEQ ID NO: 867
  isolated from saliva, unidentified

SEQ ID NO: 2307 - DNA, 558 bp, Unknownn; identical to SEQ ID NO: 909
  isolated from saliva, unidentified

SEQ ID NO: 2308 - DNA, 771 bp, Unknownn
  isolated from saliva, unidentified
atggactatcaaaaattgccattatttatacatgattatccacaggaggcagtaatcaatccagatcatgaacatttggattataagctaccagaaaaattaatttatgcttttgtgactaaagaaaatattgataaatttctagcaaagtattcttatcgaattgtagggagtatggaaactatttcttttaatcccaatgtctatgaaattgactatgaaggacaaaaaatagggctatgtcaggctccgcttggggcaccagcagctacacaactattagattggctaattggttatggagtaaggaaagtattaactgttggttcatgtggagcattagaagattttgaagaaaatgaatttgttatcccaacaaaggctattagagatgaaggaacctcgctacattatttgcctgctagtgaaagtattgagttgacttcaaaatttgtgaaacaggtagaacaaatcttacaagactttaattatcgaattcatgaagttacaacatggacaaccgatggcttttatcgagagactgtggagttagtcaatcattatcgtaaattaggtgttgctacagttgaaatggaatgtgccgctttagctgcatgtgcacaatttagaaatgtggattttgcgcagattttattcacagcggactcactaaaagatgttgataattatgacgaacgagattttggaattaattcacatctaaaagtattaaaaatagcgacaaaagttatggtgaaattaaaaaactaa

SEQ ID NO: 2309 - DNA, 705 bp, Unknownn; identical to SEQ ID NO: 1007
  isolated from saliva, unidentified

SEQ ID NO: 2310 - DNA, 1512 bp, Unknownn
  isolated from saliva, unidentified
atggacacactggggtataggttaaattctaaaaacgctaattctaatggcgtatttagcagtgataactttaaccaagcaatggaatttaagtcacaaggtgccactggtaatggtcaaacacaattttcttcttatgttatttcctttactacgcaacacacagactcttatgaagtaggtttaactacaggtccgaaaaatcaacaattctcaggaatcgcagctaatatttattcttatcagaatggctactataacatgttttctagcttatatggtgagcagagagcactgaatccagctggtgcaccattaaaagctaaagatgttgtttctgattgggataaagccaatactgctatggctaagattcataccgactatttaaataatgctcaaattaatgttttgcgtaataaaattcaaaataacattacagactctgatgctttaacaaagattattaatgaaggaaattccttaaacgatgctatgaaaaatcttggtaatagtatcggacagtatgattctgatggcaagtttactgatcataaagtcgatacaactaaggcttcagatcggtatcaatatgctgattcagatacaaaatcaacttatgacaatacgacaaatgcagtaagtaatataattgacaaaagtaatggtacctatgcagatcaagcgacggtagaaaagcttactgatgacgaaaataaggcatggtctgctcttaatggtgtgaagccaaccgacactgataagatcacaccaaatgttccagaaaagaaggtaccagtagcaaataccagcaacttaactgaaactgaaaaatatcaagttaagaagaatgtggaagacgctaataagggtaacttcccagatggcacagttgttacagtaggtgctgacggaacagctacagtaacttacccagataagtcaactgatacaatcaacggtagcgatttggtacgtccagaaaccccagaaaccgaggctgataagatcacaccaaatgttccagaaaagaaggtaccagtagcaaataccagcaacttaactgaaactgaaaaagaccaagttaagactaatgtgactgatgccaataagggtaatcttccatcaggtagtcaaattacagtaggcaatgatggtactacaacagtaacatacccagatggctccaaggatacaattccaggtgacaaagtggtagaaggaaagagcgacgcagataagaacgaatcaaaggtaccaggcgacaaggtaaaagtagacgatccaaacaaactaacagatagcgaaaaagaagaactatcaaataacttggaaaaacttaatccaggtacagtggtaactatagctgatgacggaactgcaacagtaacatacccagatggttcaacaaatacaatttcaggtagtcaattagtaactgctaaaggtaatggtaatactacaaactctaacgtgaaggttacaccaacaaataccaataataagattaat

SEQ ID NO: 2311 - DNA, 690 bp, Unknownn; identical to SEQ ID NO: 889
  isolated from saliva, unidentified

SEQ ID NO: 2312 - DNA, 837 bp, Unknownn; identical to SEQ ID NO: 1224
  isolated from saliva, unidentified

SEQ ID NO: 2313 - DNA, 522 bp, Unknownn
  isolated from saliva, unidentified
ttgactaataattactatcacttaatttgcaggaaggaaagtggtgtcaaagtgaatagaatagctagaagagaattgatggagcaactttttgctgataataagataacaactcaagaacaattgcaacaattattgcgtgctgaaggagttgaggttacacaagctacaatttcaagagacatgagaattttgaatattgtaaaagtaagtgaccaaaatggaaatacatattataagcaaatgaaggtagagggagaaaaaaattacgaacgtctatttcaagaaataaatgataatgtattaggaattcaacaaataaactttattaatttaattagaacaactgtgaattcaagttacgcaaatattttagctgcgaaattagatgacttagagttggctgagattgcaggaactttggcagggaatgatacagtagttgtattcagcaaaaatgaagaagatgcagaaattgtttataaaatgatctatgaacatatggatgatgacttgaaataa

SEQ ID NO: 2314 - DNA, 1734 bp, Unknownn
  isolated from saliva, unidentified
atgttaagactcagagaaaatggtagatcaacttggatgtggttactgttaggaataattgtggcaatgttaggagtcaggtatgtgtatgctgataatattgatacttcttctactacttcttccattacgacatcgacaactgcaaattcctcgtcggcttcttcatctcctatagttggggcaacatcatctgcaatagcttggcccacagaatttgctcaatggacgcaaggtgaaaaacgaggtgttttttcatctaatccatatggatatatggtagattctaacaatttaattagtgaaagtaaggatggaaataatatctatctgaagtttaatctaattgcgtttggaagttgggataaatcacaaacaaaattctatattttatcaaaaactaatgatcaatatagcggaaaagatttgaatagtgataatgtaaccataaataaggtaacatcatattttaggtcagctttatgggaagttaaggttaatattccagaagatagtggagacgaatttcaattgtgtatgtatgacaatagtagtacaggtttccatgaaacaaatggggtagcagatgatagtacatacaagtatatgttgatcagtccagtaattggatggcatcagattagtgttacacgaacaaatgtatcaagagaatactatgtgggggaatctagtaatttaacctttagttcaccagcggtccaaggtgattcaattataactgtaaataataatttttttaaaaatgctagtacagttgtagttggtgctcagacagtagatagtaatgtacttaaaacttcatatacgatttatagtgatgcagaagcaattgaaaatcaaattgaaggtttacttccgctaaataatgatgattatggtttacgagcgactatgacgtataaccttccttccgcaccacagaagacagaattcttttatggtggattaagaaacatcgttttagatgacactaatttatcaaagacaacagttaatactaaagattatttatacgggaagtatgttgatactattatttctgatattggtagtaatctgacatatacttggtattatgcaactagtgataacgagagttcattaaaagaagtcggtaaagattttagtgatactaagaatagtacggggattctgggaagtgattggatgagttttccagagagtagttcttttttgaaatatgttgctactcaaaatagtgaaaataagaaagtttatttgatgatgaaaattagatttggtggagatttaaaggcgttaactaatccaatattggttcaaattcaaacaccaactttaaaagttccagataagatagattttggaaatattccggtaaaaaatatctataatggcggaaattttgaatctttaacaaagaatgatgacaacctttctgtttctattccaagtgtaagtaagaatgcttggcaggtttcggctagtacggaagaaactggtaataacagtattgctaagttgaatggacaattaaatatctttggtaaaaacttaacgactacaccagtagaagttgtgagtgtggatgaagctggtaaaaccgtaaatttacctttgaatgctaaagtaactttcaagggttatcacaatcctttggcagctggaacgagctttacagaagatattaattggaatttatctccaaaaacaacggttagtgcatctgaatag

SEQ ID NO: 2315 - DNA, 411 bp, Unknownn
  isolated from saliva, unidentified
gcaaataagaaaggaatctttattgtgaaaatcaaacgtttagatcacatcgtattaacagtatcagatttagctcaggctgaacgcttctatcatgaagtatttgacatgccagtcattaaggatcaaactaccgaagatgtaattacacttcgttgtggacatcaacttattcgtctacgtaaagctgataaagatagtgacttgcgtgctaataatcaaacaattggtgcagctgatatttgtatcgtctctggagataaaatgtctgatattgaaaaccatcttaagagttattttgtaaatatcgttgctggccctatgacaaaattgggatctgaaggcgaaatgacatcgatttatctacgtgattacgatcaaaatttgattgaaatttcaacttataaataa

SEQ ID NO: 2316 - DNA, 1518 bp, Unknownn; identical to SEQ ID NO: 1442
  isolated from saliva, unidentified

SEQ ID NO: 2317 - DNA, 2019 bp, Unknownn; identical to SEQ ID NO: 641
  isolated from saliva, unidentified

SEQ ID NO: 2318 - DNA, 1203 bp, Unknownn; identical to SEQ ID NO: 896
  isolated from saliva, unidentified

SEQ ID NO: 2319 - DNA, 957 bp, Unknownn; identical to SEQ ID NO: 1130
  isolated from saliva, unidentified

SEQ ID NO: 2320 - DNA, 840 bp, Unknownn; identical to SEQ ID NO: 1515
  isolated from saliva, unidentified

SEQ ID NO: 2321 - DNA, 1023 bp, Unknownn; identical to SEQ ID NO: 972
  isolated from saliva, unidentified

SEQ ID NO: 2322 - DNA, 969 bp, Unknownn; identical to SEQ ID NO: 848
  isolated from saliva, unidentified

SEQ ID NO: 2323 - DNA, 639 bp, Unknownn
  isolated from saliva, unidentified
atggatagatcatatgcggttttcggtttaggagaatttggccgaagtgtttcctatgaattaatggaaataggagctgatgtgttagcagtagacaagaatgaaaataagattacagcgattgcggatgatgtaacgatggctatttctatcgatgcattaaatgaaatggcatatgagaaactgggattgaacaacatggatggtgtagttgtttcaatgtcaggtaatctcagtgcttcaatcatggcgattatagcggctaaagatgcaggagtacctttagtaatagctaaagcatcagatgatactcagagaacgatttttaagaaagttggagctgatcgagtggtaattcctgaacgcgatggtgcagtgcgaacagcgcataatttagttgcgaaaaatttcctagattacatagaactttcagataaaatttcaataatagaaataaatgttaaagatgaatggttacataaaccattggcagaattgaatttgcgttcaaaatatggtctcaatgtaattgcaattagacgaaataatgatttgcagacagatattggccctaatttgacttttgacaagggagacacaattttagttgtaacagataaacatgatttaggattataa

SEQ ID NO: 2324 - DNA, 792 bp, Unknownn; identical to SEQ ID NO: 1361
  isolated from saliva, unidentified

SEQ ID NO: 2325 - DNA, 543 bp, Unknownn
  isolated from saliva, unidentified
gtgtgtataataaaattatcaattattaaaggagctaggaagaaagtggatgtcaaattttattcaacagctgtggagcataataatttagggaccactcttggtagttctatcttgagggatgctcttctacctgatctagttggaacagataacactattctttactgggcaggcaaacgtttagctcgaaattttccactagctaaagatgaagatttacctgtatttttcgagaaagctaattgggggtacttaaaaagagtaaaatctaagatgaatcgtcaagttttcgaactttcaggtccaatagtcgaaattagaaaaaaaattaattctaaatgtgaatttcttttagaagcaggattcatcgcagaaactatccaaaatcaaagcggatttacttcagaagctgttatcgatactgaaacatctcgtggaaattccgtttttataactgttcaagttgatcaacgtgatcctgttgacttaaatactattcctgacaaggatttactcaatccatctagagaggaactataa

SEQ ID NO: 2326 - DNA, 585 bp, Unknownn; identical to SEQ ID NO: 1346
  isolated from saliva, unidentified

SEQ ID NO: 2327 - DNA, 2079 bp, Unknownn
  isolated from saliva, unidentified
ttgattgaccgccaagacttggatgtacagacagtaagtgcatttgaagcttatgcttataatgacacgattaatgttgatgatactgacaatagctatgatttggctaaccaattaattgataatgagaaaaaagttattgttacaactagacaaaagttacaagcaattttcagaagaattgatgaacaaaaagataacttatcaaagaaatatttaaaactgaaagatgtaaaactagcttttgtagtagatgaatgtcatcgtgcagttacaccgtcacaaaagagagaattggataagttctttaataaatcacctttgtggtatggatttacaggaactccaattatggataaaaatgcgcgtgctgaaaatggcaatgatgctagaactacaaaagaactttatggagatctattacacacttatacgattaaaaatgcgatagcagataatgcggtgttaggattccaaattactaatattggtcaagaaaacgttgaagatgaagaaaatactgaaaaatgggataagctttaccttaaggatgtacatatgaaggctgttgttaagaagattttaaatttagcttatgttaagcaaggactaaaagatggtaatcgatacgctgctatttttacaacttcatcaattaaacaagctcaaaaatattatcacatatttagagacatcgctaatggcgaaagtgagataaaagttcctaaggtaattaaagaaaaagcagtagattttccaagagtagcgataacttattcaatttcgcaaaatgagaatgattcaaaggataaccaagatgacatgaaagtttcacttaaagattacaatgcaatgtttgggactaactttgagatggggcaaattgatgcttataaccgaaatgttaacgatagacttgcacgaaagtctaagcagtatcaagctccaagccagcaattagacattgttattgtagttgatagacttttgacaggttttgattcaccaacgttatcaacgttatatattgatagacgaccaatgaatccacaaaatatgattcaagctttttcacgtactaatcgaatttacgataatactaagcaatggggacagattgttactttccaatatccagaaacttataaaaagaaaattgatgaagctattcaactttattcaaacggagctgccacatctgatataactgcgccagtttggacagaatctcggaagaaatatattgcagcacgaaatggaataaatcaatatttactagacaaaaaagcattagacagaatagttgatgcaccaattgaagaaatgaaagcttttgctaaagattttcaaaaattcgacaaggcatttatggcaattcaaacttatgatgaatattacaatcaagatgaattaccagaaaaagaaagaatatctataccagcattaactgatgaagaattagagcatctacagggtgtttattctaatgttattgaaaagataaaaaaacgtgacagagatgaacctgatccggaatttgactgggaatatgaattaacccccatctacaataataagatagatgaacgctatattactaatctaattcaaaatgtggtatctgatactaacgaaagtgaactattccttaatgaaaaagatgtcgaagaaatcgatgaaactatcgataatttagaaaagataaacaaaccaaaagcagatataatcagaagtttatgggataaagttaagcaaaatccgcaagaatatgctggaacttcgattagtcaattagtagaagatttgattaacaaggaaaaccatcgtttgatgcaagaatttgcggataaatacaaagtggattataacgatctacgttatgtaattaacaactatgtttctgatggggacagtactcgtcaaaaaggtatggcagaaatgattgataaggaagcttacgagaaatttagggatgcatatccaaatgcagagtcattgttaaagtggaaacatagaatgcgtcaagaagtagatactttctacacagacaaaataagaccactaatgtatacagaataa

SEQ ID NO: 2328 - DNA, 708 bp, Unknownn; identical to SEQ ID NO: 1206
  isolated from saliva, unidentified

SEQ ID NO: 2329 - DNA, 861 bp, Unknownn
  isolated from saliva, unidentified
atgctgccattaataagacgaaatttaaaattatttttccgtaatcgagctggagtatttttttctttgttaggagccttaatttcttttggactatttattatttttttgaagtctaacatgttagattcgtggaaacaattgcagcatccagccagagtacttgatctttgggtaattggcgggacattggccgtggccagtattactacgactttaagtgctttatccagaatggtgtcagaccttgaatatcgggtttttgatgatttgattttaactggtttaagtcgcttgaaaattcgactcagttatgttttggcagcaacaattattggaactctattgcaaatagcactttttttaataatggttagttatttttcttgggttgatggcatcagtattcctggatatatcacttttcaagtgttgatagttacaattttagcatcattttcagcaagtgtgctgaattttattctagtttatcggatgaaaaatattgatactgttggcaagttttcttcaatcgttggggcagcttcaggatttttagtgggaatttatattccaatcggtgttttgccaacttttgcgcaaaatttagtcaagttaacaccaggggcttatgtagcagcaatctatcgtcagctgttgatgcatgatatactgaaaaacgttcaaccaaatattttgcataatttacaaaaaacactgggaattggaattaatttaaatggtaatctaaccacaaaattgcaaaactttgcaatagttaccggtgtaaccgtaattttattaataattatcttgattaccaacaaacatgatcaaaataaatctgttagtacggagtga

SEQ ID NO: 2330 - DNA, 471 bp, Unknownn; identical to SEQ ID NO: 1103
  isolated from saliva, unidentified

SEQ ID NO: 2331 - DNA, 963 bp, Unknownn; identical to SEQ ID NO: 1127
  isolated from saliva, unidentified

SEQ ID NO: 2332 - DNA, 435 bp, Unknownn
  isolated from saliva, unidentified
atgataagagaatttcagatatcagacacccagctagttatgcagttatggcttgcaggaaatgaagatgctcattcttttgttgctaaagagtattggcaagctaattttgaagaagtggaaaaacaattattgaaagctgatatttttgtttatgatttaaatggagaaataaagggatttattggactaatggatgaatatattgcagggatttttgttgataaagcgtatcgttctcaagggattggtaggcaacttttggaatatgtaaaacaattgcacagtacattgtcattaaatgtgtatcaaaagaatgaacgtgcattaagattttatcgtgaaaatgggtttactattgtttctaagcagaatgatgaacatacaggggaaattgaatttacgatgatttggaataaaaataaagtcgaataa

SEQ ID NO: 2333 - DNA, 624 bp, Unknownn; identical to SEQ ID NO: 1427
  isolated from saliva, unidentified

SEQ ID NO: 2334 - DNA, 2361 bp, Unknownn; identical to SEQ ID NO: 1480
  isolated from saliva, unidentified

SEQ ID NO: 2335 - DNA, 390 bp, Unknownn
  isolated from saliva, unidentified
atgaatatcaaaaaagttagtgaacagttagagatcacccctgatactatccgctattacgaacgcattggacttgttccacctattaatcgcaacaaaaatggtgtacgtgattttaccgacttagacatccaaagactagacttcatcaaatgcatgcgtcatgctggtttatctatcgaaagcctccacgaatacatgcatctttattcgttgaatgacgatcgtaccattccagcacgtaaaagaatcttagaagaagaagctgaaaaattagatgaaagaattgctagtcttcaagaaactagagcctatttgcaacataagattaatgtctatgactcacaacttacccaagcaacaaatgatttgaaactatcggaagagtaa

SEQ ID NO: 2336 - DNA, 573 bp, Unknownn; identical to SEQ ID NO: 1337
  isolated from saliva, unidentified

SEQ ID NO: 2337 - DNA, 1317 bp, Unknownn; identical to SEQ ID NO: 337
  isolated from saliva, unidentified

SEQ ID NO: 2338 - DNA, 1278 bp, Unknownn; identical to SEQ ID NO: 690
  isolated from saliva, unidentified

SEQ ID NO: 2339 - DNA, 1734 bp, Unknownn; identical to SEQ ID NO: 1452
  isolated from saliva, unidentified

SEQ ID NO: 2340 - DNA, 1677 bp, Unknownn; identical to SEQ ID NO: 1454
  isolated from saliva, unidentified

SEQ ID NO: 2341 - DNA, 816 bp, Unknownn; identical to SEQ ID NO: 772
  isolated from saliva, unidentified

SEQ ID NO: 2342 - DNA, 1050 bp, Unknownn
  isolated from saliva, unidentified
atgaataaaaagattagcttaaaaacagggacaatgaatattttaaatggtattagtatgggcgttgtagtagccttgattccatctgcgttagttggtcaattaatgaaagctttgatgggagtgatgccacatattgcaagtcaggtgattgatattactaactttgctgcaagtttgctacctgcaatggctggattctgtgtgggatatctctttaaaatgaatatgattcaaatgagttcaattgcagcagcggcaacaattggatcaggtgtagtgaagaaagctgggacaacttatgttcttgctggaacaggcgatgtaattaatgtcgccgtaacaattacatttgcagtaatcattgctagtgttattggaaataaattgaagaattatacagttctgttgatgccggttcttgtcttagtactgggtggtggactaggattaatgactctcccttatgtcaagttagtaacaggatttgtaggagcgatgataaagacttttacaattcttcaaccagttttgatgggaacattgatgggaatatcatttgcagttctgattgtatctccgattagttcagtggggatagcgactgccattggaataagtgggattgcctctggttcagctaatctaggaattacagctggtgctttcacattagcgattatgggaagttcggttaatagtttaggaacaatccttgctcattttataggaactcctaaaattcaaatggggaatatgttagaaagaccgaaattattcattccagtgataattagttcaggaattatgggtgctttaggagctatcttcaaaatccaaggaacacctatgagtgcaggatttggtttcgctggattgattggaccaatgacagcatatgaacaaatggatcctggagtaggtagtatgattttactaacaacattgtttgtggtattgccaattattttaggtttggcgatgaaatatatttttgttggtgaaagtaaatttgttaaagctaatgatttattaattgaaactgaatag

SEQ ID NO: 2343 - DNA, 1389 bp, Unknownn; identical to SEQ ID NO: 831
  isolated from saliva, unidentified

SEQ ID NO: 2344 - DNA, 888 bp, Unknownn; identical to SEQ ID NO: 1004
  isolated from saliva, unidentified

SEQ ID NO: 2345 - DNA, 954 bp, Unknownn; identical to SEQ ID NO: 1095
  isolated from saliva, unidentified

SEQ ID NO: 2346 - DNA, 852 bp, Unknownn
  isolated from saliva, unidentified
atggagattacacttgatattttacaaaaagtcattaaaaaacgtgaacctaacagtcataaaggtaattttggtagagtattactcattggcggaaatattaactatggtggagctataattatgtctgcttccgctgccgttcatactggcgctgggctagttactgttgcaactaataaagaaaatctatcttcattacattctgtcgtaccagaagcaatgtttattaatttttttgacaaagtatctcttacaactgctatttcaacggctgatgcagtagttgtaggccctggattaggtactgataatagagctaaagaagttcttgaagttacattaagtaatatctctgataatcaactttgcataattgacggttcagcaatcactctcatatctgaaaatgattccttaaaaaaattgattgctaacaataaaaaaatcatttttactcctcaccaaatggaatggcaaagactatctggtattcctatagataaacaaattgatgacatcaacttacaaaaacaaacatcgctaaatgctactgttattttaaaaaaacaccatactactatttatcatcaatcaggaactattgataatttagcaattggtggcccttttatggcaactggtggtatgggagatatcttaaccggtatcctcgctgcatttatcacacagtttaaggaaagttcactagatgaaagaatcaacgcagctgtttatttacacagctatatagctgaaaatttatcccataaatactatgtgacattaccaacagatattattaaaaagattcaaaaaacgatgttgaaagttatttctgaacaaaaataa

SEQ ID NO: 2347 - DNA, 1143 bp, Rothia mucilaginosa; identical to SEQ ID NO: 700
  isolated from saliva, Rothia mucilaginosa

SEQ ID NO: 2348 - DNA, 609 bp, Unknownn
  isolated from saliva, unidentified
atgaacacaacagttcttaccgagcttattaatcaatacggttacttggcaattgcactgctgattgctcttgaaaatattttcccccctattccatcagaagttattttaacctttgctggttttttgactttaaatagcgaattacacattctaggggtaatagttgcatctaccattggagctgttttaggtgctttaatactatatctagccgggtatctactttcagctgaacgtctggaaaaaatattatctggaaaagttggacaattacttcactttaacgataaagatatagccaagtctattagtttcttcaaaaaacatggtagtaaagcaatcttttttggtagactagttcctgtaattagaagtctaatctctattccagctggaatgacacatttcgattgtaaaaaatttattgttctttcctttttaggaacagctatttggaatactattttaatttgctctggacactatcttggagcatcttgggaaaaaattcttacagtttttgattcttttactacaataattgttattctcttaggcttaacaattattagctattacttcatcaaattaagaaaggcaaaataa

SEQ ID NO: 2349 - DNA, 1908 bp, Oribacterium sinus; identical to SEQ ID NO: 1158
  isolated from saliva, Oribacterium sinus

SEQ ID NO: 2350 - DNA, 915 bp, Unknownn; identical to SEQ ID NO: 1339
  isolated from saliva, unidentified

SEQ ID NO: 2351 - DNA, 780 bp, Unknownn; identical to SEQ ID NO: 1268
  isolated from saliva, unidentified

SEQ ID NO: 2352 - DNA, 906 bp, Unknownn; identical to SEQ ID NO: 1254
  isolated from saliva, unidentified

SEQ ID NO: 2353 - DNA, 1011 bp, Unknownn; identical to SEQ ID NO: 596
  isolated from saliva, unidentified

SEQ ID NO: 2354 - DNA, 1293 bp, Unknownn; identical to SEQ ID NO: 1445
  isolated from saliva, unidentified

SEQ ID NO: 2355 - DNA, 543 bp, Leptotrichia wadei
  isolated from saliva, Leptotrichia wadei
atgaataagaaagaatttagaaaaaaccaaattcaaaaattacagaaattaagtaaaacttgggaaaaaaagttagatgaactaaatctgtataaagagttatttaaaactactgagtgggaaaaagctgataatgtagcaattacactgagtgaagattttgagttagatacttttcctataatttcaactgctcagcaacaaaataaaaaagttttagtacctaagactttgccaaatagaatgatggagtttgttgaattaactcctgatgtcaaaatagtaagaactaaatttggtgttttggaacctgaaagtgagaattatgttaataaagaaaatatcgatttaatcattgtcccgggcttggcatttgctgaaaatggagcaaggttaggattcggtggaggattttacgataagtatttaagtgattatcgtggaaataaggtagcacttgttgatagaagtagatatttccaagaacctcagtgggatgttgatagttttgatatttacattactaatcaaataagaatataa

SEQ ID NO: 2356 - DNA, 807 bp, Unknownn
  isolated from saliva, unidentified
atggttgagattatgaagattggtttcataggtgtaggaaatatggcaaaggccataattgaaggtctaatgagtaagggtgtagaagcaaagaatatttttattcatagcgcacataaatccaattatgaagtatatagtcaagaaactggagtatctgcttgtgaaagtaatagtgaagttattgaaaaatcagatgttgttttcttagcagtaaaaccaattgtagtagaaaaagtcttaaaagaagtaaaagattcagttctaactcacaacccagtcttagtatctgttgtaacaggtgtatctgtagctgagttagaggatatactaggaagtaaagatgtaaaaatagtaagaacaatgcctaacgttaatgtagagataggtgaaggcatgacagctttacataagaatgataatgtaagtgatgaagattaccaacttgtaagagaattatttgaaaagataggtaaagttgcagaaattgaagaaaaagattttagtacattcgtagctttagctggaagttccccagccttcgtgtacttctttattgatagtttagcacgatcaggtgttaaatatggattaaataagcaaaaagcaactcaaatagctgcacaagccgttttaggaagtgcattaaaagtgttgaaatcagataaaacaccatgggaattagtagatgatgtttcctctcctggtggaacaacagtagctggattattagcaatggaagaagcagggtttatgacttctattgttaaaggagtagatgcaacaatttcaaaagataagggatag

SEQ ID NO: 2357 - DNA, 771 bp, Unknownn; identical to SEQ ID NO: 1341
  isolated from saliva, unidentified

SEQ ID NO: 2358 - DNA, 1386 bp, Unknownn
  isolated from saliva, unidentified
atgaagaaattaattaagaaaagtgaacctattttaggcttaggggaaagtattattgttttagcagttattctaggaattttaggtttcctaattattggacaacatcaagaaccacaagcaccattattaatcgcttttgttgttttaatggtttacggtcgcttacgtggatttacttgggacacaatcattgacggtatgcgtactggtttacgtgccggggttgatccacttgtaattttcttaacaattggggttttaattgctacttggatcttctcaggaactattcctactgttatgttctggggatttaaaattatttctattcaatttttccttcctactgtcttcttagtttgtaccttagtcggaattgcttgtggtagttcatttaccagtgtttctactatgggaattgcctttatcggtattggtacaactttacactttagtcctggtctaacagctggtgcaattgtttctggcgcattctgtggttctaacatttcaccattgtctggaacaaccaacttagctgctagcaccggagaaattgacatctacactcatatcaaatcacttctttggactgatttaccagcttggtttatctcattaatattctttacacttatgggattacatccaaaaccagctagcttacacgctattaatgttatgcttgatcaattgcaaaataacttctggatctcaccatggactatgttacctgttatcttgttgatcatcctagctatctttaaagttcctgcaattccttcattaggactaggtgctttatctgctgttattctaggctggattcataatccaaatatctccattaattctattactgaattgatcatgaatggattcgttgctcatacacctaacaaaaatatcaaccttcttctttcaaaaggtggaattagtagtatgcttacttcacttgcattgattatttttgccttagctttaggtggacttttaattaaattcaacatcatcggtgtgattatcactaagattgaagaatctgtcaaaggtatcgttggtttaactatttctgctgctttaacttgtatcggtgttaaccttttagttggtgaacattaccttgcaatcattttaccaggcgaatctttcaaagaagcttttgatcaccacaatttacctagaacagctcttactcgtgtcctcaatgatgctggtgctgcgattaatgctgtcgttccttggagtgttagtggtgtatttgttgcaggtactttacaagttaatccactagattttataccattcgcaattttcccattcttagttacggttctttgcatcttagcgggatttgtaaatgttataaagaaaaaagcttaa

SEQ ID NO: 2359 - DNA, 1347 bp, Unknownn
  isolated from saliva, unidentified
atgatgacaaagactgtaattattggtacaaatcacgctggaatcgctgctgctaatacattattggataattatccagatcaagaagtagtgatgattgatagaaattctaatttaagttacttaggatgcggaacagcactttgggtaggacgacaagtgaacgattatcatgggttgttctataccaaagtagaagatttcacaaataaaggtgctaaaattacccttgaagcagaagttaaagatatagattttgataaaaaagtaattcactatattaagaaagatggcacagaattaactgaagattacgataaactaattctagcaacaggttctctaccaatatctcctaatgtagctggtaaagatttaaacggaattcatttcttgaaattattccaagatggtcaagatgtagataaagaaatttctgcagaagaagtaaagaatgtagcagttatcggagctggttatatcggagttgaaattgctgaagctgctaaacgtcggggtaagaatgtattactatttgacgcagctgatcgttccttatctactcattatgataaagcattcaccgatttaatggataaaaacttagctgatcacggtattgaaaatcattttggtgagttagtaacagaatataaaggtaatgaccagaatcatgtaactcaagttgtaactgctgaaggtgaatatgatgttgatttagtgattaatgcaatcggattcagacctaataattcattaggtaaagatcatttgagcctattcaaaaatggagcttacttagtagatcgttatggacaaacaagcgataaaaatgtatatgcagttggagactgtgccacaatttactcaaatgctctagataaaatgacttatattgctctagcttctaatgctgttcgttcaggtattgtagctgctcacaatcttgctgggactaagcttgaatcagtaggggtacaaggctcaaatggaattaacatttgggatttgaagatggtttcaacaggactatcagtagaggcagcgaaaaaattcggtttagatgtagagtatacagactttgaagacttacaaaaaccagctttcatgcctaaagatgtaaatgcagaagttaagataagaattgtttatgaaaaagaaagtcggagaattgtcggagctcaactagcttcaacggaagatgtttcaatggcaattcacatgttctcactggcaattcaagaacatgtaactattgataagttaagtttattagatattttcttcttgccacactttaaccaaccatataattatataacaatggctgcgttatcagcaaaataa

SEQ ID NO: 2360 - DNA, 1488 bp, Oribacterium sp.; identical to SEQ ID NO: 826
  isolated from saliva, Oribacterium sp.

SEQ ID NO: 2361 - DNA, 663 bp, Unknownn
  isolated from saliva, unidentified
atgatggacaatgaaatgataataaatattttggttggtggaccacgtgaagaattacctgaaaacttttggaaaagcagttttagtgaagatcattggataggagcggataaaggtgcagtagatttggttaaacatcaccaatccttactatttgcagttggagactttgattcttccagtgaagaagagatagaattagtgaaggaaaatgtacctgaattaataacttttaaaccagaaaaagactacaccgacactgaattatctgtaaagttagcaatagataaatatcaccccaaaaaaattactatctatggagctacaggtggaagaatagatcacttattggctaatataatgtttgttttaaagccagaatttagattttacgcagataaaataaaaattattgatagaagaaatattataaatttctttttgccaggtaagtatactataaataaagaggaaaactttgattacttggcattcataccattagaaaaaattaaaaatttaaatttatatgatgaaaaatataaattgaataatgctaattatacttatcccattgcattagcaagtaatgaatttgtaggggataaagctagctttagttttgaaagtggactactttgtgttattcaaagtaaagattaa

SEQ ID NO: 2362 - DNA, 819 bp, Unknownn
  isolated from saliva, unidentified
gtgaataatttggaaagaaagttaattgcgattgacttagacggaacaactttaaataacgaatctaaaatttcatcatatactaaagaagttttacaaaaagctgcccaagctggccatatcgtttcaatcgtgactggtcgtcctaatcgtatttctgaaaacttttacgatgaattgaatattcctactccgatgattaatttcaacggtgctttaggacatattccacataaaaattgggataaagaatacattgaaactttttctaaagatatcgcacttgatttagtagctgaaaaagaaaaacttggaatcaagattgtcgctgctgaaagtaaaaattatgctttagctgatcaacctaataatattattccagatttctttccagcaactttgaaagcaaatgaagtcttaaatgccattaacttgcaaaaagatccttctgcgatgactatgttagttgatgaacacaaattacctaatattgtcaaaactttaaaagctaactttggcgataagattacagttggtgtttggggtggtaagaatccaattcttgaactttctcctaaaggtgttaataaagctaaaggtgttgatttcctagctaaaacatacaatattgataaaaagaatatcattgcttttggcgatgaacataatgacgcttctatgattgactatgctggttggggtgtcgttatgcaaaatggaactgataagctaaaatcgcttgctaacgatatcactgaatatgataatgaacatgatggcctagcaagatatcttgaaaattatttaaaactagcataa

SEQ ID NO: 2363 - DNA, 1149 bp, Unknownn; identical to SEQ ID NO: 774
  isolated from saliva, unidentified

SEQ ID NO: 2364 - DNA, 708 bp, Unknownn; identical to SEQ ID NO: 613
  isolated from saliva, unidentified

SEQ ID NO: 2365 - DNA, 900 bp, Unknownn
  isolated from saliva, unidentified
ttgatatatgctaaagatgaaaaaaataatattgtagaagcaaatatggctaaaaaaggaagaaaatattattgttctggttgtcatgggcaagtgatattgagatgtggaaaattaagagttagtcattttgcgcataaaaagcatgcttgtgatatcttttccgaaggtgaaacatcagaacatttaagaggaaagaaattattaatgacatggttaagaaaagaaggaaaggatccacaaatagaagcatatttgacttcattacatcaaagacctgatattttgtgtaataataaagcttttgagtttcaatgttcgccaatatctgtagaaagaatgagtgaaagatctaaaggatatataagtgaaggatatgatttcttttggtttttaggtaagaggcatttgatcaaaaagagattaacacaacaaatagcgcaatttatacgatggcataaaaatctaggattctacttaatttatattaatgtagaacaaagaaatatggaggtttattaccatattcaacaagctgactttttaccagtccgtttttatagaaaaaaagtaaatagctggaaggaattacaagatttctttaagcaaaatagaataaagaattataatttattgtctatatcagagagaaaacgacaaaaaaattgtttttatagaaattgtttgcaatcgacgaacaaatttaaagagttacaagtaatatgttatatccatggatatatactacaagaaatatacgaagaaatttcaagcgaaagatatacttatccaatctacaaggaatatatattcactaaaaaaatgtacgaaaagttgaatttaaaagatatagaactctattatcaattaccattcatcaattttagtaacattgattaa

SEQ ID NO: 2366 - DNA, 1164 bp, Unknownn; identical to SEQ ID NO: 1010
  isolated from saliva, unidentified

SEQ ID NO: 2367 - DNA, 2223 bp, Unknownn; identical to SEQ ID NO: 1355
  isolated from saliva, unidentified

SEQ ID NO: 2368 - DNA, 993 bp, Unknownn; identical to SEQ ID NO: 890
  isolated from saliva, unidentified

SEQ ID NO: 2369 - DNA, 852 bp, Unknownn
  isolated from saliva, unidentified
atggctacactggtggcattaactttagctgcttgtggcaatgaaaataataaaaaatcaagttcatctgagatgaaaacgacacaaaagtcaaatgtgtctaaaaaatctaaaaagacagaacaaagtaatgaaagttcttcatcttcaagctcatcaagttctgaaagttctagtagtgaagctagttcttcaagtcaatctggtccacaacaagccaaagttacaggggataataatacccaaagaatggcacagattgctggagcattgaagtactttttaggaaaggatgccttagttccaactaaagcagggattagtagtggtgtggtaaatgcctactatactggtgatggtaataattttacggtttactatatcaaagatacagaaggaaagaatttcaatgatcctagtttaaaagataaagtatcatatataacattttccaagaaaacttatggttctgaagaagaagctgaacaagctgtaaattacatttcaggcgagtcagaaatgggtctacctaaggttccattaagtggaaatgtaaatgctacattgaattctggtgctggacaaagatatctacactggaattctggtaaatggtcggtaacaattcatggtacagccggtaaagatcctgttcctactggtcgcaaggtagttgctttattaaataatgcttacttaccagctcctgattctagaggtgcagcaagctttacagccggttctggttctggtaatcaaaagattgaatggaacaatggtaaggcagtatatactataaagagttctaacattaattctctaattgaactagcaggatcaattcaaaaataa

SEQ ID NO: 2370 - DNA, 801 bp, Unknownn
  isolated from saliva, unidentified
atgtctgctatttcaatgattttagttgttattgtagcgttctttgcaggattggaaggtattttggatcaattccaattccatcaaccattaattgcatgtacattaattggtttagttacaggtaatttaactgccggaattatgttaggcggatctttgcaaatgatcgctttaggttgggctaacattggggctgctgttgctcctgatgctgctttggctgctgttgcatctgctattattttggttaaaggtggtcaaggtacagcaggaatcagtacagctattgctgttgctattcctttagctgttgctggtctattcttaacaatgattgttcgtacaatttctgttgctattattcacattatggataaagaagctgaaaaaggtaatttccgcggtattgaagtttggcaatttattgccttactattacaaggtttacgtatcgcattaccagctgcattcttattagttattccaacaagtgctgtacgttcattcctagaatcaatgccagcttggttaacagatggtatggcaatcggtggtggtatggttgttgccgtaggttatgctatggttatcaatatgatggcatctcgtgaagtatggccattcttcatcattggttttgttattgctgcagtttctcaattgacattaattgctattggtgctttaggtattgcttttgctttaatctacttagtattagaatctaagggtggttcaggtaatggtggttcaagcaatactggcgatccacttggcgatattttagatgactactaa

SEQ ID NO: 2371 - DNA, 993 bp, Unknownn
  isolated from saliva, unidentified
atgaaaagattaatagcaacgattattgcattagcagtatttttaggagtagcttttaatgtagaaaaaaagcaagaagaaagtaaaaataaaatgcctacagtcgctattttacaaactttaagtcatccagctttagatcaaatccatcaaggaatagtggacggattgaaagaagaaggttttgtaaatggtaagactatgaagattgattaccaaaatgctcaaggggatcaaagtaacttaaagacaatgagtgatagatttgtgcaggaaaaagcatcagtacttatcggaattgctacacccgcagttcaatcactagcaaatgaaaacagtaagattcctatcacaatgggggctgtaagtgatcccgttggaactggtttggtaaaaactttagaaaagccaggtggtacagtttctggagtaatgcacaaagaacctgttgctgctcaagtgaagttgattagagaattcatgccggacttgaagaatatcggggtaatttacacatccagcgatgattcatcaactgccgaatataaggaatttaagaagttagctgaaaaagcaggaattacagttaaaacttatacaataacttctactaatgatattgatcaagtatctgcaaccatggcaagtgaagtgcaagctgtttatgtaccttctgataataccgttgcttctggtttctctactttagtaaagaatactaatgcgaagaatattccaattttcccaggtgttgactcaatgattaaaggtggcggtgtagcaactgttagtgttagtcaatacgaattaggaaaattaacaggtaagatggcagctcaagaacttaggggtaagaatccagcaacaatgccagtagaaacagtgaaaaaaggttctacagttatcaatcaaaaacaagcagataagcttggtttgaaagtaccagcaagtgctataaagcaagcaaatgagaaaggggaaattataaaatga

SEQ ID NO: 2372 - DNA, 732 bp, Unknownn; identical to SEQ ID NO: 1391
  isolated from saliva, unidentified

SEQ ID NO: 2373 - DNA, 378 bp, Unknownn
  isolated from saliva, unidentified
atggttcagtcaattaatacaaaagtagatttaacaatggcaggtacgtcttatatgggattatctgattatggaaagataatgataggtgataagggatttgaattttttaatgatagagatgttagaaaatatatccaaattccatgggaagaagtggatgtagttatagcttctgtgatgtttaaagggaaatggataccacgctttgctttgagaactaaaaaaaatggtatgtttactttttctgccaaaaattctaaagaagtattgcgagcaattagagaatatgttcctgcagatagaatggttcgttcattaactttcttccaagttattaaaagaaatttaaagaacttatttaaaaataaaaaataa

SEQ ID NO: 2374 - DNA, 879 bp, Unknownn; identical to SEQ ID NO: 1532
  isolated from saliva, unidentified

SEQ ID NO: 2375 - DNA, 549 bp, Unknownn; identical to SEQ ID NO: 1403
  isolated from saliva, unidentified

SEQ ID NO: 2376 - DNA, 1200 bp, Unknownn; identical to SEQ ID NO: 989
  isolated from saliva, unidentified

SEQ ID NO: 2377 - DNA, 438 bp, Unknownn
  isolated from saliva, unidentified
gtgacaaatttggcagaagaaagaacacttatcttagttaaaccagatggagtttcaagtcgtcatgtaggtgaaattatcactagaattgagcgcaaaggatatgaaattgaagctttaaaggttgtatcagctacagaggatcaattaaaacaacattacaatgataaggttgacaaaccatattttccagatatgttatcttacatgcaatcaggtccaattgtggggatagttgcggcaggtacaaatattactaaagcaatgcatcgaatggctggtaatacaaatccaggagaagctgaatttggaactatccgtggagattatgggcgagaatggccttataaacatatccaaaacgtggtgcatacatcagatagtgtagaaagtgcgcaacgtgaaattaaaatatggtttccagaatttaatttttag

SEQ ID NO: 2378 - DNA, 849 bp, Unknownn; identical to SEQ ID NO: 1266
  isolated from saliva, unidentified

SEQ ID NO: 2379 - DNA, 852 bp, Unknownn; identical to SEQ ID NO: 1054
  isolated from saliva, unidentified

SEQ ID NO: 2380 - DNA, 1299 bp, Unknownn; identical to SEQ ID NO: 1512
  isolated from saliva, unidentified

SEQ ID NO: 2381 - DNA, 891 bp, Oribacterium sinus; identical to SEQ ID NO: 940
  isolated from saliva, Oribacterium sinus

SEQ ID NO: 2382 - DNA, 1377 bp, Unknownn; identical to SEQ ID NO: 666
  isolated from saliva, unidentified

SEQ ID NO: 2383 - DNA, 501 bp, Unknownn; identical to SEQ ID NO: 717
  isolated from saliva, unidentified

SEQ ID NO: 2384 - DNA, 2616 bp, Unknownn; identical to SEQ ID NO: 442
  isolated from saliva, unidentified

SEQ ID NO: 2385 - DNA, 1488 bp, Unknownn; identical to SEQ ID NO: 1225
  isolated from saliva, unidentified

SEQ ID NO: 2386 - DNA, 1470 bp, Unknownn; identical to SEQ ID NO: 1214
  isolated from saliva, unidentified

SEQ ID NO: 2387 - DNA, 969 bp, Unknownn
  isolated from saliva, unidentified
gtgtccaatcatgccgctgcacgagcacacacaaatattgcattaattaaatattggggaaaaaaagatacagagtttattctacctatgaataattctttatcactaactttggatcatttctatactgatacttcagttacttttgattcaagttatactaaagatacttttattctgaatggaaaagaaattcctaatgaaaatgtgcataaatttttaaacatcgttcgagaaaaagctggtatttcagaattcgcaaaggttaactcaactaatcatgttcctacaactgctggattagcatcttccgcttctgcttttgctgcattagctgctgctgcaagtaaagctagtggtatgaatttatctcgtcgcgatttatctcgtttagccagacgtggatcgggatcagctactcgctctatttatggtggttttgttgaatggcaagcaggtgataatgatctaaattcttatgctgttccatttattgaaaatgtgtcttgggacataaaaatgattgcagttgttataaatagtaaacccaaaaaaataacttcgcgtgctggtatgcaaactgttgttaatacttctccttattataattcttggataaaagaggctaaccgctctatcccattgatgaaagaagctattagcaaacaagattttactactatgggtgaattagccgaagaaaatgctatgaagatgcatgctttaaatttaagcgctcatcctcattttagttatttttctcctgaaagtattcaagttatgaatcttgtagaagaattacgttcaatgggaattgaatgttattacaccatggatgctggtccaaatgttaaaattatttgtctaggaaaagatactgctagtatcacttcctttttacaaaaaaatcttcctaacactgaagttttggtttcttcagcgggaccaggtgtacaatatcttgattaa

SEQ ID NO: 2388 - DNA, 2001 bp, Unknownn; identical to SEQ ID NO: 748
  isolated from saliva, unidentified

SEQ ID NO: 2389 - DNA, 1248 bp, Unknownn; identical to SEQ ID NO: 1050
  isolated from saliva, unidentified

SEQ ID NO: 2390 - DNA, 936 bp, Unknownn; identical to SEQ ID NO: 1051
  isolated from saliva, unidentified

SEQ ID NO: 2391 - DNA, 801 bp, Unknownn
  isolated from saliva, unidentified
gtgtttgattatgattttatgcgttatgcatttattgcagggatttttattgccttaatttcttgtgtgatgggagtctttgtggttgcacgtcaaacttcttttttcacgcatacattatctgaaatcggattttcaggagcagcatttggagtttttgcaggtatttctccattgacagggatgctaatatttacgatgacatctgctatttttgtcggatcatctggagaaaaggtaggtagacgagaagcatctatttcagtgttctccggcctattcttagggttaggtatcttatttttatctttgtccgataagcaagcaagttatgcaactagcatcttatttggaagtattgtaggaattgatattaacaatttgtacactttaattggactaagtgtcattttgttagtcgtcgtcagtgcacttttcagaagactagcatataattcttttgattcccaaggtgctgaatataatcaaagatataatcagattgtttcgattgtatttttgttgttattagcactaactatcagtatcacagctcaaatcgtaggagctttgttgatctttgttttattaacaattcctgcttctgccgctaagtactttgcacatacactttggaaaatgatcggtctaacttttatttttgtattagtcggaatctggttaggtttatatctaagttttgttacagactggccagtaagtttctttattacagttatcgaagcactattttatggggctgccatcgttaaggaaagaatgtccgcttctagattataa

SEQ ID NO: 2392 - DNA, 1950 bp, Unknownn; identical to SEQ ID NO: 1530
  isolated from saliva, unidentified

SEQ ID NO: 2393 - DNA, 2361 bp, Unknownn; identical to SEQ ID NO: 1000
  isolated from saliva, unidentified

SEQ ID NO: 2394 - DNA, 984 bp, Unknownn; identical to SEQ ID NO: 1144
  isolated from saliva, unidentified

SEQ ID NO: 2395 - DNA, 858 bp, Unknownn; identical to SEQ ID NO: 1031
  isolated from saliva, unidentified

SEQ ID NO: 2396 - DNA, 588 bp, Unknownn; identical to SEQ ID NO: 1112
  isolated from saliva, unidentified

SEQ ID NO: 2397 - DNA, 1419 bp, Unknownn; identical to SEQ ID NO: 1046
  isolated from saliva, unidentified

SEQ ID NO: 2398 - DNA, 522 bp, Unknownn; identical to SEQ ID NO: 595
  isolated from saliva, unidentified

SEQ ID NO: 2399 - DNA, 744 bp, Unknownn
  isolated from saliva, unidentified
atggagattgcatatttaagtgatttaggaaaaatgagaaaaaataatgaagactatgttggaaaatttgtcaataaagctggagcagtaatggtaattgtggctgatggattaggtggccataacgggggagaagtagcttcagaaatggcagtatcccatctaggctattactttagtgaaacaagttttttttctatttctcaagcaagtacttggctttctaaaaaagtagatgaagaaaatagtttaattttaaaaaattctcttcactataaagatttacgtggtatgggaacaacattagtagtagctatcatatttgaacaagaatttttactagcacatataggtgacagtaggggatatattttagaaaaaggaaatcttactagggttacagaagatcattctctagtcaatgaattaataaaagagggtgaattaagtccagaagaggctgagcatcatcctaaaaagaatatcatcacacgatctttaggaatatcgaaaaattcagaattagatgaagaattttttcaaattactaaaaatagcattttgatgttatgtacagatggtttaactaatatggttgaagatacgaagttagaacgtttattaaatatatctgaatctttacctgataaatgtcaaagattggttgatgaggctaatagagcaggaggaaatgataatatttctgtattacttgtgtcgtttgatgaagaggtgaaatattaa

SEQ ID NO: 2400 - DNA, 1035 bp, Unknownn; identical to SEQ ID NO: 1431
  isolated from saliva, unidentified

SEQ ID NO: 2401 - DNA, 393 bp, Unknownn
  isolated from saliva, unidentified
atgttagagaattggttagaacttcaaaaattcacaaaacaagtaaataccgaattggaacgatcactaagtcaaatggtaccagcagtaacagtgaatgaattttatgtgttacattttttagaacaaaatgcgggacatgacttacgtgtgagtgacctaagtcaaaaattggatttaagtcttagcgcaacttcaagaatgttggtgcgttttgaacaaacttgtaatgttattacgcgaaatcagggacaagaagataagcgtagtgttaggattaatttaacggcagaaggtgaaaatgttctgtcagaagccaaacaaagaattgatgcagttttgagtaaatatgaagaaaaattagttaattttgggggaattaagaatgactaa

SEQ ID NO: 2402 - DNA, 471 bp, Unknownn; identical to SEQ ID NO: 969
  isolated from saliva, unidentified

SEQ ID NO: 2403 - DNA, 834 bp, Unknownn
  isolated from saliva, unidentified
atgaaattaaccatgagtaaaattaaaatgatcgcaactgatatcgacggaacactagttgatgacgctaaaaatctttcacctaagacaatcgaagtcttaaaaaaagcaagagctgatggcatttatgttgtcttatgtacaggtcgtccattaagtggcgtcgctaatctcctaactcaattaggtttggataatgacgataatttcgtaattacacataatggtgcccaagctgttagtgctaaatctggtaaagctatcttcaaacatttattagacttttctgatttcaaacatcttgacgctattagtaaggaattaaaagttaatatgcagacaattactactgattctcaattgtttgttacttctcctgatattaactattattctgttttagatactttctatactcatatgcaacttagatatcgtcctgtaacagaagtacctgaagatatcgaaattgctaaaattatgtgggctgattatccagaaaacatcgataatgccctacctaacttgcctgaagatttgctagataaatttgattgcatccgtagcgaaaaatggttctttgaatttatgaatcctctagctacaaaaggaaatgcagctatcgaattagggaagcatttaggcattgatgctagcgaaattttaactgccggtgaccaaaataatgatctttctatgattgaaaaaggcggatttagtatcgcgatgggaaatgcgattgatacaattaaagaaaaagctgattatgttactgatactaacaacaatgatggtttagctaaagctattgaaaaatttgtttttgaagattaa

SEQ ID NO: 2404 - DNA, 885 bp, Unknownn; identical to SEQ ID NO: 696
  isolated from saliva, unidentified

SEQ ID NO: 2405 - DNA, 231 bp, Lachnospiraceae bacterium
  isolated from saliva, Lachnospiraceae bacterium
atgaaaaaattgactaaatcaaatgataaagttttaactggtgtattaggtggctttgcagaatattttggagcagataaggctctagttagaattattggtgctgcattgatgatggtaactggattcttcccaggagtatttctttatattattgcagcagtaataatgccagaaaaaacagacaaagataatgacgacgtaattgaaggcgaatttcacgagaaataa

SEQ ID NO: 2406 - DNA, 780 bp, Corynebacterium kroppenstedtii
  isolated from saliva, Corynebacterium kroppenstedtii
gagggaatttatatggcatcggtaaaacctaaccaatctgttattaattcgtttaaaatacttgaagcaatttcaagttctgctagctatgttggagttagtcaattaagtaaaaaaacatcattacctaaaacaaccgtttttagattacttgagactctacattatttaggtttagttaaacaaaatgataaacaggaatatatgttaggaagagcattcttaaaatatatcgatagggttaaaaatcaggaagatttagtgagtgtatctacaccatttttaaaagaatttgcgtctgaaattggtgaaactattaatctaggtattctctataatgatgaagtcatctaccttaaaagtattagaggagaaagatttacatttagagttcaattattaccagttgctccattatataatagttctctaggtaaaattttcttatctactttctcaaatgaagctttagaagattacattaataaaactaattttgaaaaaacaactataaatacaattgtagatattgataaatttaaagaagaaataaataaagtaaaagaacaaaatattgcctatgataatgaggaagcagaatatggtttaacttgtgtagctctaccaattactaaatcaaataaagtaattgctgccattagtgtttctggtcctacatcaagactaaaaattaagggacttaataaaataattcaaactctgcaagatactgctgatagtattaatcatgcgattagtacgatcgatgatataaattaa

SEQ ID NO: 2407 - DNA, 480 bp, Unknownn
  isolated from saliva, unidentified
atgttcgaaataattttaagtgaggtgctttgtgtggcaattatggatgcacaggaaataatggatatgattcctaatcgttatccgatctgttacattgactatgttgatgagctagtacctggtgagagaattatcgcaacaaaaaatgtaacaattaatgaatcttttttcagaggacattttccaggaaatcctgtaatgccgggagttttactaattgaaactttagcgcaagctgcgtcaatacttattttgaaatctccagaatttgtaggaaaaacagcttatttaggttctataagtaaagctaaatttagaaaagttgtcagaccgggcgatgttttaaaattaaatgtcgaaatgaaaaagaaacacgagaacatggggatagtagatactcaagttatcgtggatggaaagaaagcttgtacggctgaattaatgtttatcgttgcggatagagacaagaagttgtag

SEQ ID NO: 2408 - DNA, 699 bp, Unknownn; identical to SEQ ID NO: 1070
  isolated from saliva, unidentified

SEQ ID NO: 2409 - DNA, 1299 bp, Unknownn; identical to SEQ ID NO: 1055
  isolated from saliva, unidentified

SEQ ID NO: 2410 - DNA, 606 bp, Unknownn; identical to SEQ ID NO: 1122
  isolated from saliva, unidentified

SEQ ID NO: 2411 - DNA, 594 bp, Oribacterium sinus; identical to SEQ ID NO: 295
  isolated from saliva, Oribacterium sinus

SEQ ID NO: 2412 - DNA, 1452 bp, Unknownn; identical to SEQ ID NO: 869
  isolated from saliva, unidentified

SEQ ID NO: 2413 - DNA, 528 bp, Unknownn
  isolated from saliva, unidentified
gtgattcaaattcgtaagttatacacacgccgagatatgttcgaagttgggactcagcttacttttagagactcagacaaaaaaattatctactttctttcgggccatcttggcggacaccaaggccgaatagatctttttgatattcagggaaagttattagctaaagctcgtcaaaaatcgctaggtttttttccaaaatttatatttttggaagatggccattatgctggttctcttagaaggtattatggtattaatcatgatatgttattcgtaaaaaaattaaattggtttatttttggtaatctctttacttttaactataaggtttttaaaggtagagactgcattatgaaaattcatgaagtaactcttccagacggcggtaattatttagaatttgaaatctcccataaagaatatgaaccattatgcttatgcatcgcttcaattttagactattgggctaaaatgcgtaatccttcacattctaatcaaactgaactaaataataatcttaacgtt

SEQ ID NO: 2414 - DNA, 687 bp, Oribacterium sinus; identical to SEQ ID NO: 1474
  isolated from saliva, Oribacterium sinus

SEQ ID NO: 2415 - DNA, 837 bp, Lachnospiraceae bacterium
  isolated from saliva, Lachnospiraceae bacterium
atggaaaaagcagtttcattaaactttatttcagttccaagtgatcaattacaactagcaaatgtaggacgctcagatacattgagtggacataagtatggaccagcagttagaccatattaccttatccactatatcttagctggttctggaacatttaaaactgatcaatcaatctacaaattacatgctggacaaggttttctaattgaaccaggacaagaaacgacctatattgccgataaaaatacaccttggtcttatgtgtggattggcttttctggtaattttgctgatcaacttatgcagcaaattccactaaatcaacgtgaaccaatcttcagtttaaatgatcccaaacgtttaattgagttagttaatttattgttattaaagtcagttaattcaacaacaaagaaattactcaatcttagttatttgctggaatttttgagtattatttccaatgctacaattatatctcgtgagtcaaccacttctatttctgatgtttatgttgagaaagctatttctttagtcaataaaaactttcctaatatctcagctgcttcattggcacaaatgatcggactagatagaagttatctgggtaagagatttaagaaagtaacaggaatgacccttcaaacctatttgaaaaattataaaattacacaagcacgacatttaattgaatcaacaaatctttctttgcttgaaatttctcaaagatgtggctaccagcgagttgactccctggcaagaacttttaaagctacctatggtttaacacctagtgacttcagactacaacaaaaagagcttctaacattatga

SEQ ID NO: 2416 - DNA, 834 bp, Unknownn; identical to SEQ ID NO: 893
  isolated from saliva, unidentified

SEQ ID NO: 2417 - DNA, 927 bp, Unknownn
  isolated from saliva, unidentified
atgtttttaggaaggaaatttttatccatggaaaataaaaagaagttttggacgataatgattattatttcctgtactttctggggaatatctggaatttttgctaaattcatttttaacctggatagaagtaatacacctatatttgtaagtcaaataagaatgattataagtggtttagtgatactatttttcagttggttaaataaggataagcctatgaaaatttggaaaactaaaaaaagtagttttacaattattatgtttggactattaggtttaattccagttcaatactgttattttgaagcaataaaatatggtgatgcttcaatagctactattcttcaatttataggtcctttttttatactgttttacttaacaattgtaaaacgtcaagcacctagaagaattgaagttatttgtacgattattgcatttattggtgtatttattcttgctacacatggaaatataaatcatttagcaataactccacaagttttgttttgggggcttttgtcagcgattggagtagctactaatactctgattcccaagtcattaattcatgaattttctccaactgccgtcacaggctggggattactaattgcaggagttggattgtttattatccatcctcacgttagtgctagcattttagcaccacaagctattgtgccattattatgtgtattagtaattggaacaattattccatttcaattatttactagtgctttacgctatgttaaggcaacaactgcaagtatgttagatgcatttgaacctatttcagccacaattggttctattttagtttttaatatgcatttctatttagctgatatgataggttcagttctaataattttggctgttatcttattaaactggcaaccaaaaggaaaaatccagtaa

SEQ ID NO: 2418 - DNA, 336 bp, Unknownn
  isolated from saliva, unidentified
atgagatatcaatataaaccacgaaaatcgtttgaacgaaacttagcttatcttgcacagcttgatgtaacaattattgatgaagtaaaagatgctatttttattctcctcgatggcgacatacttcccgatgattttcatgatcacgaactagaaggaaactatactggctatcgagaatttcatcttcgtgatactcccaaagggcagcaaccaactgaaacaaatgacattgtagttatctataaagtcaacaatcaagatttagtactcgttgctgttaatattggttctcataaaaaattattccatggtcgttatcataagaagcgttaa

SEQ ID NO: 2419 - DNA, 1131 bp, Unknownn; identical to SEQ ID NO: 1468
  isolated from saliva, unidentified

SEQ ID NO: 2420 - DNA, 606 bp, Unknownn
  isolated from saliva, unidentified
atgtctcgttatacaggtccttcctggaaagtatctcgtcgtttaggtttctctttatctggtacaggtaaagaattatctcgtcgtccatacgctccaggtcaacatggtcaagatcgtcgtggtagtctttctgaatatggtttgcaattgcgtgaaaagcaaaagttacgtatgacttatggcttaacagaacgtcaattctcaaacttgttcaagagagctggtaagattcgtgaaggtaagcatggtgataacttcatgattcttttggaacgtcgtttagataacgttgtttaccgtttaggtttagcatcaactcgtcgtcaagctcgtcaattagtaaatcatggtcacattactgttgatggcaagcgcgttgacattccatcttacgaagtagaaccaggtcaagtaatttctttacgtgaacgttctaaggacttacaaatcgttaaagaagctcttgaagctgttgttggtcgtgtaccattcgttaactttgacgaaaacaagatggaaggtacattagtacgtcttccagaccgtgaagaacttgacgcaaatattgacgaagcacttgttgttgaattctacaaccgttaa

SEQ ID NO: 2421 - DNA, 1413 bp, Unknownn; identical to SEQ ID NO: 1290
  isolated from saliva, unidentified

SEQ ID NO: 2422 - DNA, 1956 bp, Unknownn; identical to SEQ ID NO: 1525
  isolated from saliva, unidentified

SEQ ID NO: 2423 - DNA, 852 bp, Unknownn
  isolated from saliva, unidentified
atgcagctatttgatgaattaaaaacaattagtaaaaagcatattaaggctaacaaaaaagctggagaaaaagttccttcgggattatggatttcttgccctaaatgtcaacagtctatatatcataaagatttaggtaagtataaaacatgtccaaattgttactatgggtttagaattcatgctcgtgagagattagaatggttagtagatacttttcaagaatttgatacagatttagaaactaaagatccgttaaattttcctggatataaagaaaaattaattaaagcgcaacaagacagtaaacttaacgattcagttttaactggaatagcaatgattgatgatgttgaatttgctttaggcataatggatccatacttcattatgggctcaatgggaactgtgactggcgagaagataactcgtttgtttgagagagctactcagaagaacttgccggtaatattatttacagcttctggtggtgctagaatgcaagaaggaattagttccttaatgcagatgagcaagatctctcaagcagtcaaggaacattcaaatgcaggtttattgtacataactgttattacagaccctactacaggtggagtgacagcaagttttgcgatgcaaggagacataattctttctgaaccaagagcattattgggatttgcgggtaaacgtgtaatagaacaaactattcaccaaaaggtaccagatgatttacaagatgcagaaactgttttaaagaatggatttattgataatattattaaacgtgaagatcaaaaagaaaaattagcatggttggtaaaaattcattcaatgaaaggagctttttag

SEQ ID NO: 2424 - DNA, 1746 bp, Unknownn; identical to SEQ ID NO: 1397
  isolated from saliva, unidentified

SEQ ID NO: 2425 - DNA, 957 bp, Unknownn
  isolated from saliva, unidentified
atgtcagctaaaataggagtattaatcccatattttggaaagttaccaaattattttgatgcatggtatcaatcagcaactcagagtaaaaaggtagattttattttttatacagattgtaagatagaatcgacacaaaatattattgtgcataattgtagttttatggactttcgtaacaaaattcagagtaaatttgattttaaaattagtttagaaagggcatataaaatttgtgacttccgtccagcatatagctatatttttcaagaagagctagaaaaatatcaattttggggatattgtgatttagatcttatttttggtgatattgataaatacttgtcagatgaacttttatctgaaaatttcgtaatcggcaaatatggacacttttctatatatcaaaataatgaagaaataagatatctttttatggatgatggagtatatccagaaaaaaattatcgagaagtattccaaaacaacgatgccttctactttgatgaatttggaggaatgatgttaaagaaatctagaaatgggtataaaacttatccattgaaaatggctaatttcttacctatacctccatattttaataatcgaggagaatcggtatatataaagtggagtaatggtaaggtatatacagtttctaaagataatcatttagaagaatatttttatgtacattacagtaaaagaaaatttaattttcataagagtaaccagagctcgaaaataattataacacctagcgatatttacatgggatatgataatttacatattaaactaaaaaatgctaaattaggcaaattttactactacaaatatatcctaagaaggatatatagccatcgtagtaatattagaaagttaattcaacgaatgatttggagccgtgatttgaaaaagtatgctgatagccttaatgataaggaaaatttttag

SEQ ID NO: 2426 - DNA, 909 bp, Unknownn; identical to SEQ ID NO: 927
  isolated from saliva, unidentified

SEQ ID NO: 2427 - DNA, 282 bp, Unknownn
  isolated from saliva, unidentified
ttgagtcgtagtttgaaaaaaggaccttttgtcgatgaacatttgatgaaaaaggttgaagcacaagctgatcaagaaaagaagtcagttattaaaacatggtcacgtcgttcaacaatcttcccaagttttattggttatacgattgcagtttatgatggtcgtaagcatgttccagtttatatccaagaagatatggttggacataaattaggtgaattcgtgccaactcgtacattccatggtcatggaaatgacgacaagaaaactggcgttagatag

SEQ ID NO: 2428 - DNA, 717 bp, Unknownn
  isolated from saliva, unidentified
atgagattagataagtttttaagtcaaacaggaaagttcacaagagcggaagcaaaaaaggttataaaggctaagagagtaaggttaaatggtgaagttgtcaaagacggaaagataaaaataaacgaagactcagataaaatttttttagatggggaacttttagctttgaataacaaagaagtatattatatgttaaataagcctataggagttgtatcagctactagggatgataaagataagacggtaattgatttaataaattttcctggaagaaaagaagatttatttcctgtaggtagactagataaggaaacaacaggattattaattatcacaaatgatggaaaatttgctcatgatattatttctcctaaaaaacatgtatctaaaacatatgaagcagtagttactggaaaaatatcagaaaaagaggttaaaatattttctcaaggcatggaattagccaatggggataaattacagcctgcacaacttgatataatatcttattctgagaaggatgatactagcaaagttagagttattattcatgaaggaaaatatcatcaggttagacgaatgtttggagcagtgtctcaaagagtgttagaactagatagagtaaagataggactacttgaattggatgatactttggaaagaggagaatatagggagttaacagaagaagaattaaatttaataaaataa

SEQ ID NO: 2429 - DNA, 1884 bp, Unknownn; identical to SEQ ID NO: 1424
  isolated from saliva, unidentified

SEQ ID NO: 2430 - DNA, 672 bp, Unknownn
  isolated from saliva, unidentified
gtggaagttaaggggatgatgaatatgatccaaattacaactattaagccaaaggggttctatgaaagatatgtaaaaagatcgcaagcttttctacttagtttgattgcgataattatactttcaccaattttgctaattacatatttattagtaagagtaaagtttggaaaacctgccatttttatacaaaaaagggtaggtaaagatggaaaagtatttgatttgtataagtttagaaccatgactgatcaaagaggtgaagatggaaaattattacctgatgaacaacgtttgactagttttggtaaaaaattacgtagtacaagtttagatgaattaccagagttgtttaatattttgaagggtgatatggcattggttgggccacgtcctttactagtgaagtatctacctttatataatgatgaacaagctcggagacatgaagtaagaccaggtttgacaggttatgctcaagtaaacggaagaaatgcaattacttgggaagatcggtttaaattagatgtagagtatgttgataatgttacttttctcaatgactggaagataattttcaaaactattaaaacagtttttaagagagaaggaatatcagaagaaggttcagcaacaatggacgaatttaaaggaaatggacatagagtatga

SEQ ID NO: 2431 - DNA, 1008 bp, Unknownn; identical to SEQ ID NO: 1164
  isolated from saliva, unidentified

SEQ ID NO: 2432 - DNA, 882 bp, Unknownn; identical to SEQ ID NO: 701
  isolated from saliva, unidentified

SEQ ID NO: 2433 - DNA, 972 bp, Unknownn; identical to SEQ ID NO: 1433
  isolated from saliva, unidentified

SEQ ID NO: 2434 - DNA, 1272 bp, Unknownn; identical to SEQ ID NO: 959
  isolated from saliva, unidentified

SEQ ID NO: 2435 - DNA, 585 bp, Unknownn; identical to SEQ ID NO: 1450
  isolated from saliva, unidentified

SEQ ID NO: 2436 - DNA, 486 bp, Unknownn
  isolated from saliva, unidentified
atgcaattatacagattagttattgatggagctttagtatctgacgaaagcgacgaatacatttatataattcatatttcgtatccatcatatgcatacttacctgatcaaaacatgccttcgattcctgcaaagtcaccagctttacaaactatcatcagtcctgtccagtttgaaattgaaaatggtgatttttcagaacttttcgtttacttaaatattattcctaacagtttaatacctagacctcgttttaaattagacctattaaaaaatccggatagttattcaatcactaaacatgaaatgaaattttataacaatcctgatttcgttgagaagtacggtcgtcctcgttatgatgtcaatccaattcctgtcaattacaacgtttcattggcagaaattttacctgaactagaacatggcgattttttaggaaattatattagtattcgctgggaattagtttctcacaggaattaa

SEQ ID NO: 2437 - DNA, 411 bp, Unknownn
  isolated from saliva, unidentified
atgataagagatataaatcacgatgttaaaattctttctaaaaaaagtacacctgcttcaaaaaaagatatcgcaattgttcaagatttagttgatactttaacctatcatcgtgatcattgtgttggtatggcagctaacatgattggtaaaaataaatgtattattgcgtgtcaattcggtcctttaattgttgctatgattaatccagtaataactaaaaaatctcaaaaatattctacttctgagggttgtctttctttaactggtgagcgtgaaaccacccgttttaataagattgaagttagctacttaaaccaatcttttcaaaaagttcatgctacttttgaaggctttaatgcacagattatccaacacgaaatagatcactgtaatggtatcttaatttag

SEQ ID NO: 2438 - DNA, 351 bp, Oribacterium sp.; identical to SEQ ID NO: 716
  isolated from saliva, Oribacterium sp.

SEQ ID NO: 2439 - DNA, 795 bp, Unknownn; identical to SEQ ID NO: 743
  isolated from saliva, unidentified

SEQ ID NO: 2440 - DNA, 918 bp, Unknownn; identical to SEQ ID NO: 1199
  isolated from saliva, unidentified

SEQ ID NO: 2441 - DNA, 606 bp, Unknownn
  isolated from saliva, unidentified
atgaaatattttactgcagatacacattttttccataaagagttgatacatgatacacgatttgctaatagaatgtttttttcagtaaatgatatgaataatacaatagttgaaaattggaatagtgttgttaatgataatgatacggtttatcatttaggagatatagcacttataaatagtaaaaaagaagatttaaaaagagtattggaaatattgaagaaattaaaggggcaaattgtatttttgaagggaaaccatgattcaagagcattatttaaatttatagataaaaataatgttattttacctgatggaagaatgaaatttacttttatagatgttggcttaattttaaaattaaatcattatcaattatttttaactcattatccattattggtaggaccatctaaaaatagagttaatgttcatggacatattcaccattccagtgtaaattcaccgtggaatattaatgttggagttgactcagcagatatagattatttaattaataaactaccatttggaacacctatatcagaaaagaatttatttaagattatagaggctaagttaatagatcataaaaaaagatggtag

SEQ ID NO: 2442 - DNA, 756 bp, Unknownn; identical to SEQ ID NO: 786
  isolated from saliva, unidentified

SEQ ID NO: 2443 - DNA, 1140 bp, Unknownn; identical to SEQ ID NO: 1458
  isolated from saliva, unidentified

SEQ ID NO: 2444 - DNA, 2937 bp, Unknownn; identical to SEQ ID NO: 1364
  isolated from saliva, unidentified

SEQ ID NO: 2445 - DNA, 2835 bp, Unknownn; identical to SEQ ID NO: 1384
  isolated from saliva, unidentified

SEQ ID NO: 2446 - DNA, 1404 bp, Unknownn; identical to SEQ ID NO: 1344
  isolated from saliva, unidentified

SEQ ID NO: 2447 - DNA, 2145 bp, Unknownn; identical to SEQ ID NO: 857
  isolated from saliva, unidentified

SEQ ID NO: 2448 - DNA, 753 bp, Unknownn; identical to SEQ ID NO: 942
  isolated from saliva, unidentified

SEQ ID NO: 2449 - DNA, 519 bp, Unknownn; identical to SEQ ID NO: 971
  isolated from saliva, unidentified

SEQ ID NO: 2450 - DNA, 1383 bp, Unknownn; identical to SEQ ID NO: 1489
  isolated from saliva, unidentified

SEQ ID NO: 2451 - DNA, 597 bp, Prevotella melaninogenica; identical to SEQ ID NO: 1230
  isolated from saliva, Prevotella melaninogenica

SEQ ID NO: 2452 - DNA, 1647 bp, Unknownn; identical to SEQ ID NO: 1379
  isolated from saliva, unidentified

SEQ ID NO: 2453 - DNA, 1065 bp, Unknownn; identical to SEQ ID NO: 827
  isolated from saliva, unidentified

SEQ ID NO: 2454 - DNA, 537 bp, Unknownn; identical to SEQ ID NO: 1520
  isolated from saliva, unidentified

SEQ ID NO: 2455 - DNA, 879 bp, Unknownn
  isolated from saliva, unidentified
atgtattacaatgcagctctagttttagaaggtggtgcaatgcgtggcctctatacttctggcgttctagatacatttttggaacatgatattcaatttgattgtgttattggagtttctgcagggtctctaaatggcgctaatttcgtttcaaaacaatatcaaagaacttataatgtaaatgttaaataccgtaaagatcatgactatatctccttagcacgcccttttaagcatgaaagtattattaacttagatttcttatttgatgatcatggattagattggcataatttcgataataaagcctatttaaagtctgaaactgattttattgttgtagctacttctctagaaagcggaaaagctgtaacgctacgtaatccccaacctggtcaagatttaattgatgccttagaagcttcttcatctatgcctttcatctcaaagccacataatacttctaaaggactttgtctagatggtggtattgctaactctatcccttttgatatcgctcaaaaaatgggttttcaaaaaattatagttgttcgtactcgcccacgtgattatcgcaaaaagcctactagttttgctttaaaacgcctctacagtaatagcttcaaggaatacccagaattcgttaaaacggctatcagacgtcctgaaatgtataaccattctgttgaagttttaaataaacttgaacacaacgacaaaattttttgtttagcacccaatgatccagttaaagttggtaggcttgaacacaatactaaaaagatgactgaactctataatataggtagaaatgatgctgaaagtaatcttgaagcaatgcttaactatcttcaaaaaagtgaacccctatatgactaa

SEQ ID NO: 2456 - DNA, 681 bp, Unknownn; identical to SEQ ID NO: 1414
  isolated from saliva, unidentified

SEQ ID NO: 2457 - DNA, 219 bp, Unknownn
  isolated from saliva, unidentified
aaggaggatttttcatttatggaacaaggaacagttaaatggtttaacgcagaaaagggcttcggttttatcacacgtgaaaatggcgatgatgtatttgtacatttcacagctattcaaggtgaaggttacaagactttagaggaaggtcaacatgtaacatttgacgttgaaagtagcgatcgtggtttacaagctgctaacgttgttaaagactaa

SEQ ID NO: 2458 - DNA, 741 bp, Unknownn
  isolated from saliva, unidentified
atgacagatttaaaagtagatgttacagatttaaaaaagaattatggtagtaatcatgtattaaaaggaatcaattttaaagtaaaaaataatgaagttgtagtcttaattggaccatctggctcagggaaaagtacgttgttgagatgtctaaataaattagaagaacctacaagtgggtcaattatcattgacggacatgatataagtgatcctaagactgatatagataaagcacgtgaaaatatcggtatggttttccagcacttcaatctatttaataacttaacagtaggtgaaaatattactttggcaccagtagagcttggaaagttagaaaaggaacaagctgaatttgtagctaagaatttactagaaacagtaggcttagctgataaatatgatgcaatgcctgcttcattgtctggtggtcaaaagcaaagggttgctatagcaagagcattagctatgaaaccagatattatgctatttgatgaacccacttcggctctagaccctgaaatggttggagatgttcttgaagtaatgaaagaattagctaaagatggaatgactatggttgttgtaacacatgaaatgggatttgctaaagaagttgcagatagagttgtttttatggctgatggccatgtgatggaagagggtactcctgaagaggtatttgataatcctcaaaatgaaagaactaaagcatttttagacaaagtaattaatgtctag

SEQ ID NO: 2459 - DNA, 831 bp, Unknownn; identical to SEQ ID NO: 511
  isolated from saliva, unidentified

SEQ ID NO: 2460 - DNA, 1674 bp, Unknownn; identical to SEQ ID NO: 1278
  isolated from saliva, unidentified

SEQ ID NO: 2461 - DNA, 408 bp, Rothia dentocariosa
  isolated from saliva, Rothia dentocariosa
ttgagtgctgtaaaggatctttatactggagagattataagttgggtggtaagtaaaactaacgacaatcctttagttatgaaaacaattaaggcagctattgaagctaatccaggagtaactctaattttacacagtgatcgtggctttcaatatacatcaaaagaatatgttcgtgaagtttcaaaagcaggaattacacgtagtatgtcacgagtcggacgctgtattgataacgcaccaatggaaagtttctggagtcattttaaagatgagtactactatgatcatacttttataacttatgaagaattagtgtccgggatcgctagatatattaattattacaacaatgagcgttatcaatggaaactaaaaagcctgactccagcagaatgccgaaattag

SEQ ID NO: 2462 - DNA, 1842 bp, Unknownn; identical to SEQ ID NO: 1092
  isolated from saliva, unidentified

SEQ ID NO: 2463 - DNA, 966 bp, Unknownn
  isolated from saliva, unidentified
atggcgattttgagcttctatttatcaaattacatgcgtgaaaaatatttaggacatgtaatgttagtgcttgcgccattatttgataatttctttctatatactatcaacgatattcctgcagcagcgatgcttaattttgcttgggaaggtgcactattactaattatatgtgaaatcttcattagaattgaagcactgccactgatctaccgctgtacattagaattcctaattgttaaccaaattccaccattggtatattttgtattgcctggtaaatatcatgcgatgagtgcaacatattttacatttgcatcaataatagatgtaaccttagggacgttattaatgtttgcagtggcaaatgtttacgttaacttcctaactaagcaatatgaagaattgagaatggcaagatatgatgtatctcatgatggactaacaaacttgttaaattatgattcatttcatagtcatatgaatgagttatcacaaaagagcagtagacatcaaataatttgcatcttagatattgatgattttaaaaagtttaatgatacttatggtcatcttgagggtaatgatgtattggtttattttactaaacgtttgtttgctgaagttaaggctcattttggtgaattagcttcagtatatcgttttggtggagaagaattttgtgtttctgtacatggagtaacagttgaagattgtctagagatgacagataaactagctgaagaattacgaactaaagattatataacagcaaccggtgataaaattacagtcacattttctggaggaattgccctaggatgtgataagaaagatatcaaaactgttttaagagaggccgataaagcactctattacagtaaacgacataaaaaggggagtgtaacctgtgctaaagatttggaaaagaagtctactgatactgatatgcctcttagctactaa

SEQ ID NO: 2464 - DNA, 1686 bp, Unknownn
  isolated from saliva, unidentified
ggaattatggaaactggtctaactgtaagacaacagcaacaacttttacaagaacgcgaaaatagttggcaacatgcaacacagagattagaagttcttgaaaagttagagaaaaagccgtactttgctagaatagatttcactgagaatgatggtaagcaggaatctatttatataggattaggttcgtttgcggataccccagaccattttatgatttatgattggcgtgctccaatttctagtatttactatgatggtaaattaggagaagtaacatatgatacacctgatggcccacaaacagcagtattaactctaaaaagacagcttatggtagaagatggcaagatcataactttatttgacactgatgaaactgttggggatcaaatgttattggaagttctagacgaatcttctgacattaagatgaagagcattgttactacgattcaaaaagaacaaaataagattatcagagatactaagtctgacttgctatttgttcaaggtgctgcaggttcaggtaaaacatctgctgtattacaaagagtagcatatctattgtatcgttatcgtggaaatttgagctcgagtcaagtagtattattttcaccaaaccagttatttaatgactatattgatcaagttctaccggaactaggggaacaaaatatggttcaaatgacttactatcaatattcacaacgtcgtctacctaagatacatgtagagacgttacaagaaagatttgatgaagataatcagccattaagaagaaaaatttcagctttaaaaagtagcttaacaatgtttaatgcgacaactaattatagtgattatttaaatactgctggaatgagatttagagatataaaatataatggagaaatcttcttctctaaaaaagatataaagaaaatttactatagttttaatagtaattacaatctacgtaatcgtttgtctgctactaaagaaaagcttattaagattttaaatagtaaggtaggagaactagctaaacaagataatgttcaaaaacagatacaggatttaagtagagaagaacttaatgagttatatggtgatgaaccacgtaactttgttaatggcgatcaagagcttaaattcttagctcgcagttatgttatgaagcaattacgtccagttcaaagagcgattgtacgtaatagatttttgagtattaataaacaatttgttcattttatgcgtaatattccagagttagttgatttatcaaaatttgatttaactctagatcaatggaataatgatgttgatatgacagtcaatcacttgaaaaatcataagttaacaatagcagatgtaactatttacctatatttatatgacttgattacaggaaaacgtggcgaagtagatattaagcatgtttttattgatgaaattcaagattatacagcatatcagttagcatatttaaaatttggttttccacgtgctaaatttacaatgttaggtgatttaaatcaggctattttcacgaaagaaaacagtcatacactgttggatgagctaggaacaatgtttgataaagataaaataaaagttattcaattgacgcaatcatatcgttcaactcaacaaataacagattttactaaagaagtattagtgaatggagaaaaagttacatct

SEQ ID NO: 2465 - DNA, 699 bp, Unknownn; identical to SEQ ID NO: 628
  isolated from saliva, unidentified

SEQ ID NO: 2466 - DNA, 501 bp, Unknownn
  isolated from saliva, unidentified
gtgatttttgtgaacaaaagtctaaaaaatgttttaattgctggaactgcatcgggaattatttctggtttagttaaattaggttgggaaaacattatgccacctagaactcctgaacgcgatgaagttaatcctccacaaacattcctacaacaattgggagtaccggcagagataacacaatcaacttataaatattctggtcatagaatgccatgggctagtttcctaattcactttggattttcagtaacttttgcgacaacatatgcattagcattggaaaagaaaatgaattggttaactaagaaacaaggtattccatttggtgtagctatgtggattgctttccacttggtaattatgccagctatgaagactattccaagtgctaaacgtcaacctttagaagaacacttatcagaagtattgggtcacattttctggatgtatactaatcatgaagtggctaaagaaattttagatagattagataaatga

SEQ ID NO: 2467 - DNA, 684 bp, Unknownn; identical to SEQ ID NO: 1058
  isolated from saliva, unidentified

SEQ ID NO: 2468 - DNA, 1617 bp, Oribacterium sp.; identical to SEQ ID NO: 949
  isolated from saliva, Oribacterium sp.

SEQ ID NO: 2469 - DNA, 918 bp, Unknownn; identical to SEQ ID NO: 1406
  isolated from saliva, unidentified

SEQ ID NO: 2470 - DNA, 1011 bp, Unknownn; identical to SEQ ID NO: 933
  isolated from saliva, unidentified

SEQ ID NO: 2471 - DNA, 783 bp, Unknownn; identical to SEQ ID NO: 1358
  isolated from saliva, unidentified

SEQ ID NO: 2472 - DNA, 369 bp, Unknownn
  isolated from saliva, unidentified
atgagtttaggaattacaattgtttctcacgtttatgaagttgctaatggattgccaagattgttgactcaggtagctaaggatgttcctattacaacagctggtggaactgaagataatgatgttgggacaagtatggaaaaaatcatgaatgcttttgaagaaaatgatgctgatgaaattttgtctttctatgatttaggaagtgcaaaaatgaacttagagatggcgattgaaatgacagataaaaaagttcatctctatgatgttgctttaattgaaggagcatatacagcagcaacacttcttgaagcaggagtagatttacaggaagtagaaaagcagttagaaccactaaaaattaaatag

SEQ ID NO: 2473 - DNA, 963 bp, Oribacterium sinus; identical to SEQ ID NO: 1486
  isolated from saliva, Oribacterium sinus

SEQ ID NO: 2474 - DNA, 627 bp, Unknownn; identical to SEQ ID NO: 56
  isolated from saliva, unidentified

SEQ ID NO: 2475 - DNA, 558 bp, Unknownn
  isolated from saliva, unidentified
atgggcataataatcgtaatagcattgattgtaattgttgttgctgtatatatatcaatgtacaacggattacaacgtgcaaaagtaaatactgatgaatcgtggagtcaaattgatgttcaattgaagagaagaaatgatttgattcctaatcttgtagaaactacaaaaggatatgcaaaacatgaaagagaaacattgtccaaagttgtagaattgagaaatcaaatggtggcactgccagcagatgttgatccacaaaagaaaatggaattatctaatcagttgacagactctttaaaatctatttttgctttagctgaaaattatccagatttaaaagctagtcaaaacttcactcaattacaagaagagttaacaaatactgaaaataaaattgcttattcacgacaattatttaatagtagtgcagctgtatataatcaaaagttgcttactttcccttctaatgtagttgcgaagatgcatcattttacaaaagtaaattacttggaaattcctgctgaagaaaaggaagcaccaaaggtatctttttaa

SEQ ID NO: 2476 - DNA, 1296 bp, Unknownn; identical to SEQ ID NO: 1388
  isolated from saliva, unidentified

SEQ ID NO: 2477 - DNA, 378 bp, Unknownn; identical to SEQ ID NO: 1251
  isolated from saliva, unidentified

SEQ ID NO: 2478 - DNA, 1749 bp, Unknownn; identical to SEQ ID NO: 913
  isolated from saliva, unidentified

SEQ ID NO: 2479 - DNA, 1566 bp, Unknownn; identical to SEQ ID NO: 1183
  isolated from saliva, unidentified

SEQ ID NO: 2480 - DNA, 1014 bp, Unknownn; identical to SEQ ID NO: 1498
  isolated from saliva, unidentified

SEQ ID NO: 2481 - DNA, 960 bp, Unknownn; identical to SEQ ID NO: 764
  isolated from saliva, unidentified

SEQ ID NO: 2482 - DNA, 636 bp, Rothia dentocariosa
  isolated from saliva, Rothia dentocariosa
atggagggaaaaataatgaaacaagtagcaaaagatttattaagtattaaggctgtaactttatcaccagaagaaccttttacatgggcaagtggaattaaatctccaatctattgtgataacagattaacaattagctatccagaagtaagaaagagaattgctaaaggaattgctgatattattagagaaaagtatccagaaacagaggttattgcaggaactgcaactgctggtattcctcatgctgcatggattgctgaagaattaaatctacctatgatttatgtacgttctaagccaaaggatcatggacgtggaaagcaaattgaaggtgttttagctgagggtcaaaaagtagtgttaattgatgacttattatcaacaggtggaagtgtgttaaaagcagttgatgcagctaaaaacgaaggtgcagatgtattgggagtatgtggtattttcagttatcaattaagtaaattagacgataactttaaggtatataatttatcatatgctacattgacaaattatacagaactgattgaagttgcagaagaaaatgactacattgaagaaaaacaaaaagaaatcttacatgcatggagaaaagatcctgaaaattggttaaaataa

SEQ ID NO: 2483 - DNA, 1293 bp, Unknownn; identical to SEQ ID NO: 850
  isolated from saliva, unidentified

SEQ ID NO: 2484 - DNA, 1281 bp, Unknownn; identical to SEQ ID NO: 1531
  isolated from saliva, unidentified

SEQ ID NO: 2485 - DNA, 3024 bp, Unknownn; identical to SEQ ID NO: 1053
  isolated from saliva, unidentified

SEQ ID NO: 2486 - DNA, 321 bp, Unknownn; identical to SEQ ID NO: 1211
  isolated from saliva, unidentified

SEQ ID NO: 2487 - DNA, 639 bp, Unknownn; identical to SEQ ID NO: 1022
  isolated from saliva, unidentified

SEQ ID NO: 2488 - DNA, 1458 bp, Oribacterium sinus; identical to SEQ ID NO: 788
  isolated from saliva, Oribacterium sinus

SEQ ID NO: 2489 - DNA, 1287 bp, Unknownn; identical to SEQ ID NO: 733
  isolated from saliva, unidentified

SEQ ID NO: 2490 - DNA, 2829 bp, Unknownn; identical to SEQ ID NO: 1464
  isolated from saliva, unidentified

SEQ ID NO: 2491 - DNA, 732 bp, Unknownn
  isolated from saliva, unidentified
atgcaacgatattttgctgattctaagattacaactgaatatcaactcacaccagaaatttataaacatgcaattaaggttttgaggatgaaagttggagatgcttttgaattagttgatgatgcagaagttgtccataagatggaaattacaaaaatcgaagatggaaaagcagaagcaacttcagtcgaggttattccatcagatgtagaacttccatcaaatgttactattgcttgtggaatatctaaaaatgataaagctgattggatagtacaaaaaggtactgaaatgggtgctactaaatttatcttttttataggtgattattctgttgcaaaatgggatagaaaaagaagtagcaagaaagtacaaagattacaaaaaattgcaagaagtgcagcggaacagtctcatagaaccaaaattcctgaagtaacttttgtagaaaagctgaaggatatagattttgaaaaaaatgatgctagaattgttgcatatgaagagtcagctaaaaaaggtgaaagtggaaacttgtttaagattttaaataagaaacctagcgatatcattgctatttttggtcctgagggtggaatttctccaaaagaaatagaatttttagaagcaaatagctttattttagctggtttaggtccaagaattatgcgagcagaaactgcaccattatattttttagcaagtttatcatttgctttggagttaagttga

SEQ ID NO: 2492 - DNA, 1209 bp, Unknownn
  isolated from saliva, unidentified
atggataaattattctttaactgtaacctttttgatggaacaaatacaacattattcaaagatgcctggtttgtggttaattcaaaaggtcgaattagtaattacggtactagtgagcctcctcataatatagttaagaaaatcgatcttaatggaaaatatgttatgcctggtctaattaacgctcatacacatattatgatgaaccctataaccaataaaacagaatacttaacagaaacagaaataactgttcaagcactacataatttagaattactactcaaaagtggtcaaacttatatcagagattgtggttgtgcttttaatgttgacattcagcttgctcgtttatctcaaaataatggattgtttaactttaaaattcctgaaattatgccgtctggtcgtcctctttcaatgactggcgggcatggtgactttactgaaggaattgacggttgttctacttggggttacttgactgattcacctaatgaagttcgtaaagctgtacgaaatgcttttaaacttggagctaaaaatattaaagtgatggctactggtggcgttatgtcagcaactgaccaaattgacgatacagaattatcattagaagaacttaaaatggctgttactgaagctcactctaaacatatgactgtagcggctcatgctgaaggtggagttggaatccacaatgctgttatggctggagttgattccatagaacatggatcttacattagtgatgaagatattactattatgaaaaaacaaggaacttttcttgtacctacattaattgctgcatggactatcgctgagtatggagaaggtaaattgcctcagtatatgttagataagactaaagcttttattgaagaatactttaaaaatatcgaaaaggctatcaagaatggtgttaaatttgcttttggaactgatgccggaactccatttaacaaatttgaagaagcaccttacgaacttcaattattagtacaaaatggtgctactaattttcaagcacttcaagctgctggaaaattatcgtctgaattactaggaattgatgcggattatggaaccttagaacttggtaaatttgctgactttttagttctggatgataatccattaatcgatgtaaaagcagtacaacaaaataataaacaagtttataaaaaagggcatcgaatgttctaa

SEQ ID NO: 2493 - DNA, 1110 bp, Unknownn; identical to SEQ ID NO: 1116
  isolated from saliva, unidentified

SEQ ID NO: 2494 - DNA, 1764 bp, Unknownn
  isolated from saliva, unidentified
atgaatttagcagcactttatcacaggccagatagtgaaatggcatatttagtaaagaaagatgactttcagattaggttaagaacggggacaaatgaagttgaaaatgtaattttatattatggagatccatatgacgttaccataaatgataaaaagaagcagatttgggaatatcaagttcaagaaatgaatctacaagcttcaacaagcctttatgattattggcaattaaatgtgagcgttccactaaaaaggttacaatacttttttaaaatcaaatttagaaatggcaaagaatttttatatgatgatagacatatttggagttattctaagacacatttagagaatagttctggttttagaatgccttatttccacgaaatagatcgcataaaaacgccagattgggtgaaaaaaacggtttggtatcagatttttcctgaacgctttgctaatggtgatcattcaattgatcccaaaggaacattgccatggggaagtgaaaagcctagtagaacaaatttctttggtggtgatcttcaaggggtaatcgatcatttagattatctggaagacttaggaattaatggaatctatttttgtccgatttttgctgcacattctaaccataaatatgatacgatagactattttaatattgatcctgcttttggcagtaaggaaaaattcaaagaattagtagataaagcacacgaacgtggtattaagataatgttagatgctgtattcaatcatatgggggacttttccatgcaatggcaagatgtcataaagaatggagaaaaatcccgctttgccgaatggttccatattaataaattcccagtatcttatgatgaaattagtctggaacaagcagaaaatttaacctatgaagtttttgctaagacaccacatatgcctaaattaaatacagctaatcctgaagtgcaagattatttgttagaaattgctagatattggattgaacaatttgatatcgatgcttggaggttagatgttgctaatgaaatagatcatcacttttggaagaagttctatcgagaaactcataagttgaaatcagatttttatgttgtaggagaggtctggcattcagctcaatcttggttagatcaagctgaatttgatggtgtgatgaattatccatttactgatgcaattattgatggaattattttgaataagatcaatattacagatatgaaggatacacttataaataatttaatgaaatatcgggatcaaaataatcaagttatgttaaattcattagatacacatgacacagccagaattttgacgctagcaaagggtgataagaataaagtaagacaagctttagtatttatgttcatgttgacaggaagtccatgtatttattatggtactgaaattggtatgactggaggaccagacccagattgtagaagatgcatgatttgggataaaagtcagcaagatttaagaatgttcaattttatgaaagatttaattgctataagaaaaaagtattcaaaagtattaaattatagtaatataacatggagtttagtagaaaagggtaattatagtgttgagttaatacgagaattacctgggtgtaaagtgcaatcaatttttaattttggaaagaataatatagatgtaaaagtggatggaaagaaaattttagcaagtaatattggaaaaaatgaaatcgctccaggtggctttataataactgttactgactaa

SEQ ID NO: 2495 - DNA, 627 bp, Unknownn
  isolated from saliva, unidentified
ttggaaggaaaatttgtaacatttgaaggtattgatggttcaggtaaaacaagtgtattaaaaggtgttatagaacatctaaatgataagagaatagataattatatttggactagagaacccggtggaaatagaatatcagaagctatcagaaagatcattttaaatgttgaatacacagaaatggatgcaagaacagaggcattactatatgcagcagctagacgacaacatttagttgatacagtactaccagctttgaatgaaggaaagctagttctatgtgatcgttttgttgatagttctgtagtatatcaaggagtagctagagatataggtgtagagccagttattaaattaaatgagtttgctactgaaaatcttaaaccagatttaactttatactatgatgttgaaccagagataagtttgaagagaattagcaataatcgtcaaaatcaagtagatagattagataaagaatctatggacttttatcataaggtaagacaagcatatttatcattagctgaaagcaacaaagaaagaattaaagttattgatgcaagtcaaaatttagataaggttatagatgatacattatctattttaaataattttatgtaa

SEQ ID NO: 2496 - DNA, 1008 bp, Unknownn; identical to SEQ ID NO: 348
  isolated from saliva, unidentified

SEQ ID NO: 2497 - DNA, 1017 bp, Unknownn; identical to SEQ ID NO: 755
  isolated from saliva, unidentified

SEQ ID NO: 2498 - DNA, 1461 bp, Unknownn; identical to SEQ ID NO: 815
  isolated from saliva, unidentified

SEQ ID NO: 2499 - DNA, 1275 bp, Unknownn; identical to SEQ ID NO: 639
  isolated from saliva, unidentified

SEQ ID NO: 2500 - DNA, 726 bp, Unknownn; identical to SEQ ID NO: 615
  isolated from saliva, unidentified

SEQ ID NO: 2501 - DNA, 690 bp, Unknownn; identical to SEQ ID NO: 794
  isolated from saliva, unidentified

SEQ ID NO: 2502 - DNA, 1092 bp, Unknownn; identical to SEQ ID NO: 863
  isolated from saliva, unidentified

SEQ ID NO: 2503 - DNA, 1344 bp, Unknownn; identical to SEQ ID NO: 1481
  isolated from saliva, unidentified

SEQ ID NO: 2504 - DNA, 255 bp, Unknownn; identical to SEQ ID NO: 649
  isolated from saliva, unidentified

SEQ ID NO: 2505 - DNA, 969 bp, Unknownn; identical to SEQ ID NO: 722
  isolated from saliva, unidentified

SEQ ID NO: 2506 - DNA, 1062 bp, Shuttleworthia satelles
  isolated from saliva, Shuttleworthia satelles
ttatctattatgaaagaattatcaaagtacaaaatgggggagttttggaataagctactatctgctgttgcaatggctatcgtagtagctgtaactcctggagcaattatttcaccttttatcacaggactagccaaacatagtgctttttgggaaactattttaaacgcttccaacttaagcatgtatatagtaccggtagctgctggcgtactagctgctggtgaatttggttttaatcgaattgaaaaagctagtgttgctctagcttcactagtgggaagtggtgctgtcgctttcgacaaaggatcatgggtcttagtaggaatgggcgacttgattaacaccattcttgttattgcagtagctattgtagcagttttcttaactagagattttgttggtagtttctcaataattattgaaccaatcctatgtggaacaattgttggttctctaggtttatggagttatacctatgttcacatgatttcaacaggtgtaggttctgtattgaatgctattactaaattacaacctattctaatgtgtacattaattgctatggcattcgccgttatcatagctaccccactttctactgttggtctagcatatgcaattggtattagtggtatcgctggaggcgccgcttctgttggtgtaacttcttgtttcatgatcgttgctattgctacattcaaagctaatggtaaaggggtttccctagcaatgttttggggtggcgtaaaaatgatgttagcaaattttgttgaacatcctagaatgtttattcccatagctatagttggcgctattactggtttcattgattcattcttaaatattcaaaatggatcagcagaagctggctttggtcaacctgttggacctatcgattcattccaatacatgtcaggaaacacaggtactaacatattaatattattattaatttactacattttaccaattctaatttctttagttgtttattggataattagaaagttccctaaactttataattctaacgactggaaagttgatattgataagtaa

SEQ ID NO: 2507 - DNA, 1980 bp, Unknownn; identical to SEQ ID NO: 1329
  isolated from saliva, unidentified

SEQ ID NO: 2508 - DNA, 600 bp, Unknownn
  isolated from saliva, unidentified
gtgagtaatctagatttagaatatgcagagggaatttttcctggaacgcgagaagaattgataaaaaaagtaaaagaatcagtaaaagagtcaagatttaaacatatacttggtgtagaaaaatcagcaatcgaattagctaagcaaaatgattatagtatagaaaaagcaagtattgctgctctagtacatgattatgctaaggaaagaacagcagaagaatttaaaaaaacaattttagatgaaaatttatctaaagatttgctaaattggaataattttatttggcatggtgtagttggtgcagaaatcattaaaaatgaactacaaattaaaaatgaagaaattttaaatgctgttagacgacatactgtaggtgatgttgagatgacaactttggataagattatatatgtcgccgattacattgaagagggacgcaattttccaggagtaaagctagctagaacaattgctaaaacaaatttagacgatgctgttagttatgaaactaaacatgttttagaatttttgttaagtcaggataaagttatctaccctaaagctatactaacttataataaatgggtagcagagtaa

SEQ ID NO: 2509 - DNA, 1140 bp, Unknownn; identical to SEQ ID NO: 1155
  isolated from saliva, unidentified

SEQ ID NO: 2510 - DNA, 450 bp, Unknownn
  isolated from saliva, unidentified
atgacaaactcacttctctcacaacaattagatgcattacttacaaatgaaactaattttattgcaaatttatccaatgcttcagcacttttatatcaatctttatctgatattaactgggctggtttctatctttatgatgaaacaaacgatgaattacatcttggaccctttcaaggaaaagttgcatgtatgcatattaaaaatggctctggtgtttgtggcactgcactgcaacaacaaaaagttttacgcgtagataatgtccacgaatttgctggccatattgcttgcgactcagcaagtaactctgaaatcgtggttcccctaattaaggatgataaaattattggtgtattagatattgattctccttccttatcccgcttctctcctgaagatgaagttgaattagtcgaattttccaaaactttattaaaacacatataa

SEQ ID NO: 2511 - DNA, 339 bp, Unknownn
  isolated from saliva, unidentified
gtggcgattgaaaaaactaatagaattaatgctttatttgatttttatgaaccattgctaacacctaaacagatgacctacataggattgtattatcgagatgactattctttaggtgaaattgctgaaaattatgaagtttctagacaagctgtatatgataatataagaagaacagaaaagatattagaagaatacgagagtaagttacatttatataggaacttccaactacaaagtgaagaattagataatttattgaagtatgttgaaaaaaattatgcatatgacaaagagttattagcaagaattaatcgtttagaaagtttagaagaataa

SEQ ID NO: 2512 - DNA, 567 bp, Unknownn
  isolated from saliva, unidentified
tgctcaacttcacagatagaaggaaaaattatggaatttgaagaaaaagtaaaaaaagtagaacatgtttttgatggtaaaataattgatttagatattgaaacggtagaactcccaaatggtaaagaagccaaacgagaaattatccgtcatcaaggtgctgttgcaattattgcaattactgacgaaaataaaatggtattcatcaaacaatggcgagcacctttaggccaggtaactctggaagtacctgctggtaaaatagaacctggtgaggatccaaatgtaacggcagttagagaattaaatgaagaaactcgctttgaagctgataaattagaatttatcaatactttctatacatcgccaggttttgcagatgaaaagatgtacatgtatcatgctgtaaatctaaaaccagttaaggatgaactaccacaagatagtgatgaatttcttgaattagtagaattatcactacctgaagtagaacaagcaattgcggaaggcttaatctgtgacagtaaaacattaattgcagttatgtactggaaattaatgcaatag

SEQ ID NO: 2513 - DNA, 888 bp, Unknownn
  isolated from saliva, unidentified
atgaaaaattttagttacgaagtttttagtgaagttgctagacaaaaaacatttattgctgctgctaaacaattacaagttacaccttcagcaattagtcattcaattaatagtttagagaaagatttagggttctcactgtttgttaggagtagaagtggcgtaagacttacacctaatggtcaaagggtattaccgcttattcaagatattttgaatgctgaggctactttaaacgaagaggctgctctaattaatggcttaaataaaggacgtgtaagaataggagcatttagtagtgtatgcattaattggttgccagacataataaataaatttaaaaatatttatcctgatatagaagtaacggtttggcagggaaattttaatgatgtcgttgaacaagttaaattagggatacttgatataggttttagtgcattgccgattgaagaaaatttggaagttatcccattatataaagacccaatatattgcattacgccacaagactttaaacttcataggggaaaatcaattacaagagatgatataaagaacgagaaatttattttacaacaaattgattatgatagagataccaaaagagctttggatacatataatgtttctgttaattcattacagtacagtatagatgatgcttcgattatagcgatggtagaaagtggtttgggactaggaattttaccagagcttgctttgcaaaatttaagtggaaatgttaacagatatgtttttagtgaacatttttatcgaacaatatgtttagtaactcatcagaagaaacaacaaactccatctgtcaaagcctttgtatctataattaaaaactatattagtgataggtatggagatattaattag

SEQ ID NO: 2514 - DNA, 657 bp, Unknownn; identical to SEQ ID NO: 1510
  isolated from saliva, unidentified

SEQ ID NO: 2515 - DNA, 1164 bp, Unknownn; identical to SEQ ID NO: 921
  isolated from saliva, unidentified

SEQ ID NO: 2516 - DNA, 324 bp, Unknownn
  isolated from saliva, unidentified
ttggatattaatgaacatcaacaatggttagttaaattctatgaaaaaagagattggtttaagtatccacctcaagatcgagttaattacattacagaagaacttggagaattatctcgtgctgttcgtacaatcgaagttggccgcgatcatcctggcgaaaaaatcttaaatcaagctgaaaaagaagataatttaagagaagaaatggcagatgttattgatcaggtattggtattggctgctaaatatgacattaaacctgatgaattacttgaatatagcgaaaacaaattaaagaagcgttttaatatggatgtttaa

SEQ ID NO: 2517 - DNA, 543 bp, Unknownn
  isolated from saliva, unidentified
atgaaactagataatgaaacgatagtacatcgttatggaaaagccttatttgaacttgctgaagaaatgaaaataagaaataaatttcattctgaattgcaagaatataagaaggtactccagaatgaaccacagttaaaagtctttatgagtagtaatcaaattagtcctgaagctaaattgaagattatggaaattttgaagaaagattcttcaaagttaatgactaatcttttagatatgctctatgactatggtagaattactagtttagaaggcattattgatgaatttgacagattaaatgacgaattcgaaaagacagtgcgtgcatcagtcataactgctatcgaattagatgaagaacgcaaacaaaaactagcatcttcatttgctaatgttgttggtgcaaaaaaagtcattattgaccctattgtcgatcctgggattataggtggagttattttaaaatctgaaagctatatctatgatggatctattaaaacaaaaattgcacgcattaaacgtctattattaaaatga

SEQ ID NO: 2518 - DNA, 834 bp, Unknownn
  isolated from saliva, unidentified
atggagggaataataatgaaatatggaaatttaattaaatcaattgcagcatttgttggggtagctagtttgggattagcatttaacgttgctcgtccagcacaagctagtgcagataaaatttcagctgctacaagtagtgaattgaagcaaaaaggaactttaacaattgggttagaaggaacttttgctccatattcataccgtaaagatggaaaattaacaggttttgaagttgaacttggtaaggatattgctaaacaaatgggcttaaaagcaaagtttgtaccaactaaatgggatggattaattgaaggtgtaaatactggtaagtatgatattgttttgaataacgttacagttactaaggaaagacaagctaaatttggtttttctactccatacatctactctcactttgctttgatttctaaaaaaggcagtgggttgaacacattaaaggatattaaaggtgtgaaaattgctagtggtacaggaactgacaactctgtagtagctaagaaatttggtgctaaagttgttccttctagtgaattttcaacttccttagacatggttcgtcaaggtcgtgtaaagggaacaattaactcaatgtctgcatggtatgcttacaagaaagatggtaagaatgtcaaaggacttcaagctaaagatgtttccaaagatgaaaagccagctaagatcagtgctttgatggctaagaagaatacagacttgaagaaagatgtaaataaagctttgaaacaattacgtaatgacggtacattaacaaaactttctaagaagtatgttggtggcgacattactaagtaa

SEQ ID NO: 2519 - DNA, 957 bp, Unknownn; identical to SEQ ID NO: 1370
  isolated from saliva, unidentified

SEQ ID NO: 2520 - DNA, 1659 bp, Unknownn; identical to SEQ ID NO: 1163
  isolated from saliva, unidentified

SEQ ID NO: 2521 - DNA, 897 bp, Unknownn
  isolated from saliva, unidentified
atgcttaaaatcactaatcttaacaaaagttttggtagcaaaaatgtactaaaaaacatttcattttctgctcctgctggtaagataactggatttattggcaaaaatggttcaggaaaaacgacaaccttccattctattctaaattttatagattacagtggtaatattactttcaataataaacgtattgatgaaaatagttatgctaatatcggatatttaccggaagaacgcagcctaatgcctaaattaacggtttattcccaggttaaatatttagcaaatttaaagggtatgtctactactgaagtaaaatctgaactaccaaaatggttagatagacttcaagtagttggtaaaatgaatgataaaattaaaagtttatcaaaaggaaaccagcaaaaaattcagttaattgcaacattaatacataaacccgatctaattattctagatgaaccattcagtggcttagatccagttaatacagatttgttaaagcaagtaattcttgctgaacaagagcgcggagcaacaattattttttctgatcattctatgaataacgttgaagaactttgcgataacgtaattatgataaataatggccttaaagttctagatggatcgattcaagatgttagagaaagttttggattaacgagaattttcgtacgaactccaatgactgaaacagaattagcaaatctaccacatgttatttccgtaaatctaaccaaaaatggaagttatcgtttagtaattgatgatgaacaagcaggaaaagaattgtattctttattaactaaaggtgaatacattagaactttcaatcaagaagcacctactttagatgaaatttttaaaatgaaagtaggtgagactattgcataa

SEQ ID NO: 2522 - DNA, 858 bp, Unknownn; identical to SEQ ID NO: 892
  isolated from saliva, unidentified

SEQ ID NO: 2523 - DNA, 1059 bp, Oribacterium sinus; identical to SEQ ID NO: 1257
  isolated from saliva, Oribacterium sinus

SEQ ID NO: 2524 - DNA, 1098 bp, Unknownn
  isolated from saliva, unidentified
atgcgattattaatttctggtggtggaacaggaggccatatctatccagcactagcattgatagaagctattaagcaaaaagaaccagattcagaaattttatatgttggaactcataagggtttagaaagtcgtattgttccttcagcaggagttccattaaagacgattaaaattcaaggtttcaaacgctctttatctttggaaaattttaaaacagtatatctctttttaaaaagtgtgcatgactgcaagaaaattatccgtgatttcaaaccagatgttgttgtaggaacaggaggctatgtttgtggtgcggttgtatatgctgcagctaggatgaaaattccaacttttgttcatgagcaaaatagcgttgctggagtaacaaataaatttttaagtcgttttgtagataaggtaggaatatgctttgaagatgctagaaaagattttccagcatctaaagttgtttttactggtaatccaagagctcaacaagttgctggtatgaaagatactggtagattagaaaaagaatacaagctaagaaaagatttaccaacagttatgatttttggtggttctcgaggagcagaaggaattaatgctgctgctctaaaggctattccacaatttgctaaaaaagaatatcaggttttatttgttactggtaaagttcactatgataaaataatgactaaagatgaagctaaaaacttaccggataatgtgagaatagagccttatattgctgatatgccagcaattttacctgaagttgcaagtattgttggtcgtgctggtgcaacaagtttagcagaaattacagccttaggaattccgactattctaatcccaagtccatatgtaacaaatgaccatcaaacaaagaatgcgacgagtttagttaataaagatgcagcattgatgattaaagaaaaagatttaactgcggatactttagttagaaatatcgatgaaattatgaatgattccgataaaagattacaaatgggtaaaaatgccaagaaagctggaattccagatgcagctaaccaagtaatcaaagtactagaagatataatgcataaataa

SEQ ID NO: 2525 - DNA, 2226 bp, Unknownn; identical to SEQ ID NO: 1263
  isolated from saliva, unidentified

SEQ ID NO: 2526 - DNA, 1338 bp, Unknownn; identical to SEQ ID NO: 1140
  isolated from saliva, unidentified

SEQ ID NO: 2527 - DNA, 2418 bp, Unknownn; identical to SEQ ID NO: 737
  isolated from saliva, unidentified

SEQ ID NO: 2528 - DNA, 678 bp, Unknownn
  isolated from saliva, unidentified
atgagtgaaatgtctaaaatatggaaagtcctgcaatgggtaatagtggttgtcttgatggttgtagggttagctttaatttttaacgagcaaattaaaagctatgtgattaaccacatgagtcaaactgctattagtaagccggttgatactaagacaaaacataaaggaaattttgactttgaaagtgttaaagccgttgatattaaaggagtcagtaaagctactcaagatgatacagctgcaattgggaaaattgcgattccaagtattggtttaaagcttcctattttctatggattagataataataatttaatgcgtggagctggtaccatgaaggctgacgaaaaaatgggagctgaaaacaactatgcgattgctggacaccatatggaagatcctaacatcttatttggacctttgagtaaggctaaaattggcaaaaaaatatatttgactgatgagaagaaagtttatgtatataagataaccaagaaagcagttgtagacgaaactcaggttaaatggattgatgatgttcctggtgaaagcttggtaacattggtaacctgtgcttcaggtacagaaggagaagtcaatcgaattatcatccaaggatcattggtaagtactgagacagcaagtaagagtaatttgaaatattttaacgattaa

SEQ ID NO: 2529 - DNA, 741 bp, Unknownn
  isolated from saliva, unidentified
atgagtaacaaaaagatgattgaagtacaaaatcttcaaaagaagtttggagataatctcgttcttaaagatatttctgaatcggtagaacaaggtcaggttatttgtgtaatcggtccttctggttctggtaagagtacctttttaagatgcttgaatgtgttggaacgtccaacaggtggtaaggtaatttttgaaggaaaagacttaactcatatttctgaaaaggaattagatagcttacgtgaaaaaatgggcatggtttttcaaggttttaacttattccctaatatgagtgtattggaaaacattaagttggctccaatgaaagttaagaacgttgatgaagtacaagcagaaaagacagcaaaagaattactagctaaagttggattggctgataaagcaaatcaattcccagatagtttatctggtggtcaaaagcaacgtgtagcgatagctcgtgctttggcgatggatccagaagtaatgctatttgacgaaccaacaagtgcgttagacccagaaatggtaggggaagtattaaaggttatgcgtgacttggctgattcaggaatgacgatggtagttgtaacacacgaaatgggctttgctaaagaagttgccgaccaaatctggtttatggcagatggctatgtacaagaagtaggaacaccagaagaagttttcgaacatccaacttctgaacgtgctaaagatttcttagctaagatcttataa

SEQ ID NO: 2530 - DNA, 876 bp, Unknownn; identical to SEQ ID NO: 842
  isolated from saliva, unidentified

SEQ ID NO: 2531 - DNA, 510 bp, Unknownn; identical to SEQ ID NO: 779
  isolated from saliva, unidentified

SEQ ID NO: 2532 - DNA, 867 bp, Unknownn; identical to SEQ ID NO: 899
  isolated from saliva, unidentified

SEQ ID NO: 2533 - DNA, 849 bp, Unknownn; identical to SEQ ID NO: 1071
  isolated from saliva, unidentified

SEQ ID NO: 2534 - DNA, 639 bp, Unknownn
  isolated from saliva, unidentified
gtgctagttttgccttctagatctgaaaaatttggcaaaagaaaacatcaacagaattttttcaaatttctactgatacttgtcgtaattgccattggtggttacaagttactttttaattatgctaaaaatacagctagtcaaaatgttaattcaagcagttccagtgttgaaactgttgttactcaccaagcttctaaagtagattggcaaagtccatctgagaaaaaaccatatccagatgttaatgcctatcctgatatgtggattaaagtttcaactagcaagcatcgcgtctatcttatgaatgataataaagttttatataccatgttatgttctactggctccaagggtcaagaaacacctaaagggacttttgaaattcaagctgagcgtggtgatcatttctataatgctcagtctggtgaaggtgcaaactattgggtatcttttaaagatcacggaatttatcttttccatacagttccagttgatgctaacggcaattatgtcgtttccgaagctgaacaattggggaaatcaagtaattctcatggttgtgtacgtttgtctgtcgcagatgctaaatggttttatgaaaatattaaaacaggaacaaaagttgttgttgaataa

SEQ ID NO: 2535 - DNA, 486 bp, Unknownn
  isolated from saliva, unidentified
atgacagtagttttagctagggttgatgaaagattagtacacggtgttacagtaaatcaatggaaccgagaattacatcctaaaagatatatggtagtagataatgaaattagtaaaaatgaaatgataaaggcaactatgagaatgagcaagcctgcaggaacaggaatgtcaatcattgatgaagaaaaggctataactaattttaataatgggaaatatgattcacatgctgttttcattttggttaaagaaccggagacattattaaatatgatcagaggtggtgtgaaaataccagcagttaacttaggagctatgtttgaagaaaacgataggaaatcttttacttccaggattgctatggacgataaggaaattgaagatttgaaaaaaatccaagagttaggtgtaaagatatatgcacagtatacgcctgatgatgaaaaaattctgctagatgatttattgaagaaaggggaataa

SEQ ID NO: 2536 - DNA, 1698 bp, Unknownn; identical to SEQ ID NO: 1261
  isolated from saliva, unidentified

SEQ ID NO: 2537 - DNA, 558 bp, Unknownn
  isolated from saliva, unidentified
atgatttcagttaacgaatttaaaaatggtttaactattgaagtagatggtgaactatggcgtgttgttgaatttcaacatgttaagccaggtaagggatctgcatttgtacgttctaaattaaagaatttacgtacaggtgctgtacaagaaaaaacattccgtgcgggtgaaaaagtaaatcaagcacaaatagatcgtaaaaagatgcaatatctatatgctgatggtgataactatgtatttatggatacaaatacttacgaacagcttgaattaccaggttcacaaatcgaagaagaacttaaatatatgaaagaaaacatggtagtaagtatcatcatgtttggtacagaaacattaggtgttgaattacctaatacagttgacttggaagttaaagaaacagaaccaggcatcaaaggtgatacatcttcaggtggttctaaaccggctacaatggaaactggtttagtagtacaagttcctttctttgttagtgaaggagacgttttaactattaatacaagtgacggtacttacatttcacgtgcttag

SEQ ID NO: 2538 - DNA, 1713 bp, Unknownn; identical to SEQ ID NO: 877
  isolated from saliva, unidentified

SEQ ID NO: 2539 - DNA, 1155 bp, Lachnospiraceae bacterium; identical to SEQ ID NO: 1126
  isolated from saliva, Lachnospiraceae bacterium

SEQ ID NO: 2540 - DNA, 1143 bp, Unknownn; identical to SEQ ID NO: 757
  isolated from saliva, unidentified

SEQ ID NO: 2541 - DNA, 3075 bp, Unknownn; identical to SEQ ID NO: 592
  isolated from saliva, unidentified

SEQ ID NO: 2542 - DNA, 930 bp, Unknownn
  isolated from saliva, unidentified
atgaattataaaaaaatagtattgttgtggtcattggttgcaattttaatcggagctattactttaactactattaatagtaagaaaaatataagcaaaagtaatgaagttcagctaaagaggactagaaaaaatgttaaggctgtaaaagtttctaaaattaagcttgtaggattgggagattctttaacgtacggagttggagatcaaactaataagggtggatatgtacatcttattaaagaaaaaatagaaaagaaagaatctataaaagtagttaccaaaaattatggtaagactggggatagaagtgatcaaatattagcgagacttttaaccaagaagaatattcaaaaagatatcaagaatgctaatgtgattacaatgacagttggtggtaatgatctaatgcaagttatggagaaaaatttttcttcaatggcagatgataatatgcaaccagttgtagaaaaatcggcaaagaattatcaaagtaatttacaaaatttaataggaaaagttagaagtttaaacaagaaagcacccatttttttatttagtgtatataatccattttatgtatattttcctaatattacgcagatgcaagattatactaataaatggaacaaaattgctagacaagttactttggaagaaaacaaagtatattttattgacataaacaaacaactttcaatggggcaatatgtaaatttacctaaagaagatttggtgaaaaaatcagaaacagatttagataaaaaatcaggtaaacaattagaaaatattttattaaatacaaaagaaaagaatgactatttatctgaagatgatcattttcatcctaatttaaaaggatataagtatatgacaaataagttatttgatgaaatgaatagacataaaaatacatggttggtgaaataa

SEQ ID NO: 2543 - DNA, 1392 bp, Unknownn; identical to SEQ ID NO: 709
  isolated from saliva, unidentified

SEQ ID NO: 2544 - DNA, 1815 bp, Unknownn; identical to SEQ ID NO: 1471
  isolated from saliva, unidentified

SEQ ID NO: 2545 - DNA, 2586 bp, Unknownn; identical to SEQ ID NO: 1245
  isolated from saliva, unidentified

SEQ ID NO: 2546 - DNA, 2193 bp, Unknownn; identical to SEQ ID NO: 1149
  isolated from saliva, unidentified

SEQ ID NO: 2547 - DNA, 1203 bp, Unknownn; identical to SEQ ID NO: 719
  isolated from saliva, unidentified

SEQ ID NO: 2548 - DNA, 702 bp, Unknownn; identical to SEQ ID NO: 1256
  isolated from saliva, unidentified

SEQ ID NO: 2549 - DNA, 954 bp, Unknownn; identical to SEQ ID NO: 1138
  isolated from saliva, unidentified

SEQ ID NO: 2550 - DNA, 1200 bp, Unknownn; identical to SEQ ID NO: 685
  isolated from saliva, unidentified

SEQ ID NO: 2551 - DNA, 345 bp, Corynebacterium kroppenstedtii
  isolated from saliva, Corynebacterium kroppenstedtii
tttggggtgttattaattatggaatttaaagttagtgaagaagcaggacgtaaattaatcgaagaaatgcgtcttgaaaagggcgatagaataaagatatttactaaaatatacggtggaattccaacagtttttccaagttattatctagggattatgttagataatgatgaaactgcaggagttgaagaagtgatagatggtgtatctttctatttaatgccaacagatatgtggttaatcgatgattatgatttacatgtagttctagttgatggcgaagtagaatataaattcactaaaccaggtgaagttgatgctgttagtggagcttctaaaaaataa

SEQ ID NO: 2552 - DNA, 2214 bp, Unknownn; identical to SEQ ID NO: 1135
  isolated from saliva, unidentified

SEQ ID NO: 2553 - DNA, 555 bp, Unknownn
  isolated from saliva, unidentified
ttggatgtccgttttctgcattttctctctgaattatttttggaggtgaatatcatagcagtcgataaaatggttaatgaaggcattcgtgctcgagaattaagattgattagtgacaatggtgaccaattaggtgtaaagactaagcaagaagcactaaaaatggctgaagatgcaaatcttgacctggttttagttgctcctaaagctaagccacctgttgcaaagatcatggattacggtaaatatcgttttgaacttcaaaagaaacaaagagaagctcgtaaaaagcaaaaagttgttaatatcaaagaagttcgtttaagtccaactattgatacgaatgactttaatactaagatgaagaatgcacgtaagttcttatctaaaggagacaaggtaaaagtttccattcgttttaagggacgtgcaattactcataaggatattggtcgtgatgtccttaatcgttttgcagaagcaacggaagacgttgcaactgtagagtctaaagcaaaaatggatggtcgtagcatgttcttaatgcttgcacca

SEQ ID NO: 2554 - DNA, 1227 bp, Unknownn; identical to SEQ ID NO: 689
  isolated from saliva, unidentified

SEQ ID NO: 2555 - DNA, 399 bp, Unknownn
  isolated from saliva, unidentified
atgcgttatcgtataggaatgataattgaaggcagaataactggtattcaaccatatggagcttttgtcagtttagataatcgtactcaaggattgatacacatttctgaatgtcaccatggatatgtagataacattcgaaattttttgaaagttgggcaaatggtaagagtcatgataatagatatcgatgagtatactgggaagataagtttatcaataagatgcttggaaaaagcttttgatttttctagagaaaaaagacgcccaggatttaatcatcgaaaatattggactaataagcatgttcaagaagggttcaagcctatttctaagagaatgtctaagtggataaacgaggcattagaagatattgaaaaaaataaaaaaaactattga

SEQ ID NO: 2556 - DNA, 1263 bp, Prevotella veroralis; identical to SEQ ID NO: 948
  isolated from saliva, Prevotella veroralis

SEQ ID NO: 2557 - DNA, 996 bp, Unknownn
  isolated from saliva, unidentified
atggaaaaaaataatagcaatggtactgttaccttttaccctaataactatgaaaatagtgaggaagatgtacactctttaagtactaaaggaagacttctttcatataacaatcaactaaaagatagtttacataatggattgaagttcacagagttattggatgaacttatagaaactacggattcccaaaatttattaagagctgcaatggaactgactctatttcaactagatacggcttatttagtttttcctcaacaatatagtcaatctgattattatttgatctttttaaatagattattacagttacatcaaaacgaacaggttatactacagtcatccgatagaaatgatgaattgtatcatgaatttccagggataaatcaaaatggctacttcacttttagaatagataatacagaagaaggtggggcttactatactgaaaaaaatacaggtgaaattttgttctatcttaacttccaaagaagaattttacatttcaatagtagagctatcactaacttattagttgttgattatagcaagacatacaattatgaaactgtgaagaagtttgagatgtatttaatggctttaggagaatatttcaaaaaagattatggatttgatgtggactttaacattatggatccttccaatagtacattctatcaatttggtaatacaggtattcctcaagcggctctagataaattatttattcaagctgcgagagaaaactttatgttaataacaggcttgcataatgaagctattttgaaactggataatggtgttgaagttacaatttatgataaatcaatagaagatagtagtgctacattaaataagtggggattagttgttacagatgatgatcataaagtatcttggtttgatttactgttccaatatgatttcattcgtacatggtacttagataatttaagtagtttagaaatacaatctaatcctttatatttctaa

SEQ ID NO: 2558 - DNA, 1434 bp, Unknownn; identical to SEQ ID NO: 1088
  isolated from saliva, unidentified

SEQ ID NO: 2559 - DNA, 1662 bp, Unknownn; identical to SEQ ID NO: 1310
  isolated from saliva, unidentified

SEQ ID NO: 2560 - DNA, 417 bp, Unknownn
  isolated from saliva, unidentified
atgacgtataaagagcaatcttctgtaccatttttacaaaaatatcttacatctcaaccatttaaggatattttgagtcaagtttcattttcatatggacattctgtaatatctattaaggaagttggatattataaatttgttgaattttttatccgcaaattagcacacttttccacttattttgttatgggtctaggattttatatgacattaaaagataatttaaagaaatggcaagcaacatttttctcgtatttagcagcggttggatatgcaggaatcgatgaatttcatcaaatgattactggagatagaacaccttcttttgaagatgtcatgttggatggaataggtgctttgacaggaattataatcacgatggttatattatatttttttagaagaaaaaaataa

SEQ ID NO: 2561 - DNA, 381 bp, Unknownn
  isolated from saliva, unidentified
atgttcttacaaaagaaaaagactaagctttatgaaacagaagttatagaaattggtgaagaagctaagaatttcaaggaaattaagatggttatcttatttggtgaaggggctccagatgcacttagaccatcctgctacatcattaaagtaaacgaattatctggtgaaataaaggcaggtatgactttacaaattgacgatgaaaaatataaaataacagcagtaggtaacgaagttcaaactaacttgaagaacttaggtcatatagccattaacttcacaggggataaaactgctacattaccaggatcaatgtacgtagaagaaaaggaataccctaaaattaatgaaggtacaaagattgctattataaaataa

SEQ ID NO: 2562 - DNA, 828 bp, Unknownn
  isolated from saliva, unidentified
atgcttaaacgtataggattatcaaaatcaggatattatagacataagtctaaaggattgagtaaatcaaaagaacgtcagctaaaaatcaaggatcttatcatggaaatatgggaagaaagtcagcacctttatggtgcacccaaaattacagctaaactaagaaaaatgggcatacaaatttctgaacgtactgttggaaaatatatgaaagaactaaaaatacgtgcaaagtactgtaaaccctttactgtaactactagagattccaaccttaataataaattgaaaaacaccctagatgaacaatttaatcctgaagcacctgatacgatttggtgcattgatacaacttatattccaactaaagaaggatttgtatatctaactagtatcatggatttgttttcacggcgtataatttcttgggatttatcaactacattggagaccacaaatataatatctcttataaataaagtgaaagctactcgtaagagtaatccaaaaattattcatagtgatagaggtagtcaattcacctctaaagagtattgcgaaataacagctggaattacaagaagttattcaaagaaagcttatccgtgggataatgcttgtattgagtcttttcacgctataattaagcgtgaatgcttaaatgaatataatatcagttcatataataaagctagacgattagtattttcatatatagatggtttttataatacggtgagaattcatagccattgtggctacatatcaccattagaatttgaacagacatactttgataaagtacaaaaagtaaataaagcagcttaa

SEQ ID NO: 2563 - DNA, 1590 bp, Unknownn
  isolated from saliva, unidentified
atggcacaagaagaagttactttagaaagatcattagataatgcagctaatgtattacgttcaaaaatggatgctaatgaatataaaaattatacgttaggcactattttctataaatatctatctgatagtatgctgtattatgtagctgaattattggaagaaaaaaatattagcttagaagaagctcagaaattatatgaagaaaatcaagatgatcagtatttaattgaagaattagatattaaatttaattatgtgatagaagctaaaaacacttatacaaatatattaaaatctataaacaatcatacctttcaggttagtcaattaggcgatgcttttaatagtattgaaagtcaaggaaaagaatttgaaggtttatttgacgattatgatttgtattctaagcgtttaggaaacactgcacaaaagcaatctgatacaatttcagaagtactaagtgcaattggtaaattagaaattgttaaaactccagaagacactttaggaaatgcatatgaatatttaattaaacaatttgcatctgaatcaggtaaaaaggctggtgaattttatacaccacaaaaagtatctagattattagcaagattaactttagttgataaggattatacagatggaatgactgtatatgatccaacaatgggttcaggttcattattattgaatttccgtaaatatgtggaacattctgaaagaattacttattttggtcaagaaattaatacttcaacatataacttggcgcgtatgaatatgattttgcaccatgtagatgttgttaatcaaaaactccgaaataatgatactcttgatgaggattggccagttgaagaaataactaactttgatgcggttgtaatgaatccaccatattctcataagtggtctgccaatgctggttttaaagatgatccacgtttttccgcctatggagttttgccgccaaaatctaaagctgactatgctttcttgttacatgggtattatcatttgaaacatagcggagtaatggctattgttttacctcatggaatattgttcagaggagcagcagaaggtaaaatcagaaagaaattgttagaaaatggggcaatagacgcggttatcggtttaccagctaacttgttctataacacaagtattccaactacgatcgttgttttgaagaaagataagcaagatcgcgatgtattattcattgatgcttcaaaaaattttaaaaaagttaagacacaaaatgaactacgtgacgaagatgtagaaaaaattcttacaacatataaagagcgtaaggatattgataaatatgcccacttagctagttttgatgagattaaagaaaatgaatttaacttaaatattccacgttatgtagatacttttgagcctgaaccagaaattaatttagatgaagtttcaaaagaattaagagaaacgaatgagaaaatcaaagaaaatgaaactgaattgattagtatgctaaaagatttaacttctaaagatgagaagattatgaaaggcttaaatgacttcataagtgtcttagaagaggatgtgaaataa

SEQ ID NO: 2564 - DNA, 2100 bp, Oribacterium sinus; identical to SEQ ID NO: 1262
  isolated from saliva, Oribacterium sinus

SEQ ID NO: 2565 - DNA, 1380 bp, Unknownn; identical to SEQ ID NO: 634
  isolated from saliva, unidentified

SEQ ID NO: 2566 - DNA, 1467 bp, Unknownn; identical to SEQ ID NO: 1200
  isolated from saliva, unidentified

SEQ ID NO: 2567 - DNA, 1137 bp, Unknownn; identical to SEQ ID NO: 1057
  isolated from saliva, unidentified

SEQ ID NO: 2568 - DNA, 1131 bp, Unknownn; identical to SEQ ID NO: 1432
  isolated from saliva, unidentified

SEQ ID NO: 2569 - DNA, 1059 bp, Unknownn; identical to SEQ ID NO: 1372
  isolated from saliva, unidentified

SEQ ID NO: 2570 - DNA, 603 bp, Unknownn; identical to SEQ ID NO: 654
  isolated from saliva, unidentified

SEQ ID NO: 2571 - DNA, 1641 bp, Unknownn; identical to SEQ ID NO: 1291
  isolated from saliva, unidentified

SEQ ID NO: 2572 - DNA, 267 bp, Unknownn
  isolated from saliva, unidentified
gcaaaggagcgaaatgaaatgaaacaaggaattcatccagattaccatgaagttgttttcatggactctgcaacaggttataaattcttatcaggttctacaaagacatctgaagaaacaatcgaatgggaagatggcaacacatatccattgatccgtgttgaaatctctagtgattcacacccattctacacaggtcgtcaaaagtttacacaagcagacggacgtgtggatcgtttcaacaagaaatacggtttcacaaactaa

SEQ ID NO: 2573 - DNA, 1398 bp, Streptococcus mitis; identical to SEQ ID NO: 1377
  isolated from saliva, Streptococcus mitis

SEQ ID NO: 2574 - DNA, 1428 bp, Unknownn; identical to SEQ ID NO: 1229
  isolated from saliva, unidentified

SEQ ID NO: 2575 - DNA, 1353 bp, Unknownn
  isolated from saliva, unidentified
atgaaagtagatataaatgatgttaaaaaatttgtaactgacgaactaaatactagtactaaatatctagaaatcccaagtgtctcagcacaaggacgtggtatcaaagaaaccgttaaatatcttattgattggtttaaagatctaggagctgaccaagttataacttttgatcaatataaaaacccagctatttttgcctcctttacaggcaatagccccaaaactgtcttattttataaccattacgatgttcaaccacctgatccactagatgaatgggaatctgatcctttcaaaccaacaattcgggatggtaagttatatgcacgtggcatttgcgatgataagggtgaattaatgtcgcgcttagctgtagttcgttacttcaaagaacatggtggtcttccttgtaatttaaagttttttattgaaggtgaggaagaaattggcagtccaaatatagagaaatacgcctcagatgctgcaaaatatctcacttgcgatgccgttatttgggaaggcggcggtaaaaatgaagcagagaagtttcaaattattgctggtactaaaggaattgcctcatttgaagccaaggtcactacagctgagtctgatgcacactcttctttagcaccgtatcttgataatgctgcttggcggcttgttcaaggtttatcatcattatatggggctaatcgcaatatcaaggtagatcacttctacgataatgttcaagcattatccccatatgcagcagaacaagttaaacaacaagaagcaagctttgatgcagcaactgtaataaacgcttttggagttactcaaggaaaactttctgtaaataatcccttttcagcagtaatgactgaaccgactattactattaatggcctttcagctggttacgaaggaactggtgtcaaaacggttataccacgacaagctactgctaaacttgattgtcgtttagtccctggacaagatcctgaaactattgtgggttatcttcaagatcaacttgttaaaaatggtttccctgatatcaaattacactttcttctaggggaagatgcttaccgtactgatctagaagatcctttcattcagttaagtagccgtattgctacagagatttatggacctgataaagttgccctaattcctaatcaaccaggcggtgggccaatgcttccatttttcaaaattacccaagcaccattaatggggattggtgttcattacgctgcaagtactcctcatgcacctaacgaaaatatccgtatttctgattatgcgcaagcatctggttatcttgctcgtttgttggaagaatttagtcaacaagcataa

SEQ ID NO: 2576 - DNA, 429 bp, Unknownn
  isolated from saliva, unidentified
atggaagattgcattttttgtaaaatcattgctggtgaaattcctagcacaaaagtctatgaagatgatgaagtattagctttcctagacatttcacaagttactcctggacatactttggtagttccaaaaaaacatgtagctaatatttatgaatacgatacagatttagctgctaaagtttttagtcgtattccaatgcttgccagagctattaaaaattctaatcctaatattttaggccttaacatccttaataataacggtgaagttgcttatcaatctgtgttccattctcatatacacttgattcctcgttatagtaaaaaagaaggatttggccttagatttgatgataattcttcaaaatatgatagtaaaaaacttcaagaaattgctaatcaaattgcttctaaggttgagaaataa

SEQ ID NO: 2577 - DNA, 444 bp, Unknownn
  isolated from saliva, unidentified
gtgaacttattaatcaatatcttattcagctatcttgcatctgtaggctttggagtacttttaaatattcctagaagggccttaaatggttgtggaattattggagtattaggttggatggtctatttatttattaagcaccttgatttaggtaatatgttagctaatcttttagctgcatttgcaattggagttactgcgattatttttgcacgtgtgaaaaagatgcctatgattctttttaatattcctagcttagtaccattagtgccaggtggacaatcttatcgtgctattcgctattttgctttaggaaataactctttagcaattgaatatttagtacaagtagggatgatagctggagccatagcgatgggattctttttagctgaattagtaggtcaggtttactttaagataaggactgtaaaagaaagttaa

SEQ ID NO: 2578 - DNA, 804 bp, Unknownn; identical to SEQ ID NO: 1527
  isolated from saliva, unidentified

SEQ ID NO: 2579 - DNA, 1494 bp, Unknownn; identical to SEQ ID NO: 866
  isolated from saliva, unidentified

SEQ ID NO: 2580 - DNA, 612 bp, Unknownn; identical to SEQ ID NO: 516
  isolated from saliva, unidentified

SEQ ID NO: 2581 - DNA, 1194 bp, Unknownn; identical to SEQ ID NO: 965
  isolated from saliva, unidentified

SEQ ID NO: 2582 - DNA, 1326 bp, Unknownn; identical to SEQ ID NO: 655
  isolated from saliva, unidentified

SEQ ID NO: 2583 - DNA, 618 bp, Unknownn; identical to SEQ ID NO: 878
  isolated from saliva, unidentified

SEQ ID NO: 2584 - DNA, 906 bp, Unknownn
  isolated from saliva, unidentified
atgggatttagaaatgtgattataacccagcattctaagttatcatattctaataatgcgatgatagtacaaaataaagatgggattaatcaaataccgctagtagatatggatatattacttatctcaactactcaagcagttattactagtgcattagtaggtaagttggcagaatctgggattaaagtgatttttacagataataaaaatgaacctgtgactgaaacagtaaattattatcctaataatagatcgttaggtacatatttacagcaatacgaatggaatgaccatgtaaaggaaattttgtggacaaaaattgttagaagtaaaattattaatcaaataaaggttcttaaaaattatcaaatagattgtcaagatttgaaaaatgaattagataagttggaaataaatgatatgaccaatcgtgaagccgtagtggcaagaaagtattttgaaaagctatttggcaataaatacagtagaaaagattttacacctatgaatgcggcactaaattatggatattcaattttattatcagctgtaaataaagaaattgtttctgcaggttatgtaacatatttaggaattcatcatcaaagtcaagaaaatatgtttaactttggatcagatttaatggaaccgtttagaccggttgtagattattggttggcagataagaattttctagattttacaccagacattaaatatggattagttgatttattgaacttagaaattaaatacaataaaaaacaaatgctgttaaagaatgcaattgctaagtatgtaagagatgtaattgaatacttaaatcaagaaactgttgaatttgacatggaggtagaatttacgaatgaggtaccgaataatgcgattaatgataatgtttga

SEQ ID NO: 2585 - DNA, 2631 bp, Unknownn; identical to SEQ ID NO: 1330
  isolated from saliva, unidentified

SEQ ID NO: 2586 - DNA, 768 bp, Unknownn; identical to SEQ ID NO: 1192
  isolated from saliva, unidentified

SEQ ID NO: 2587 - DNA, 2079 bp, Unknownn; identical to SEQ ID NO: 1264
  isolated from saliva, unidentified

SEQ ID NO: 2588 - DNA, 753 bp, Unknownn; identical to SEQ ID NO: 950
  isolated from saliva, unidentified

SEQ ID NO: 2589 - DNA, 2025 bp, Unknownn; identical to SEQ ID NO: 4
  isolated from saliva, unidentified

SEQ ID NO: 2590 - DNA, 777 bp, Unknownn; identical to SEQ ID NO: 1421
  isolated from saliva, unidentified

SEQ ID NO: 2591 - DNA, 804 bp, Unknownn; identical to SEQ ID NO: 1308
  isolated from saliva, unidentified

SEQ ID NO: 2592 - DNA, 741 bp, Unknownn
  isolated from saliva, unidentified
atgacgttaaaggttaagaatttagtaggtggttattcccaaataccagtgttgaaagggattgattttagtgttgataatggcgaattggtgggcttgattggtctgaatggtgctggaaagtcaacgacaatcaatcatattatagggttattacatgctatgaagggttcaattgagatagatgggataaccattgatgaagatgcacaagcatataagagtaagattgcttatattccggaaacgcccattttatatgatgaattaacgttaaaggaacatatagagttgacgatactggcatataatctggataaagatgaagcttggaaaaaggcaaatgagctattggaaatatttaggttacagaataaattggactggtttccggccaacttttcaaagggtatgaaacaaaaggtaatgatcgtatgtgcctttattactaaggctaagctctttattattgatgagccgtttttgggattggatccattggctacagatgatctattaaagctcatagatgacgttaaaaaggaaggatcggctgtgttaatgtctacgcacgtactaggaacggcccaagagtactgcgatcgatttgtaatgatcaatcatggagaattgaaggcaagtgggacattggaagaattacgagctcaatttaataagcaagacgcttccctttctgagatttatttgagtttgactaaaggggaaaaggccaatgaataa

SEQ ID NO: 2593 - DNA, 1404 bp, Unknownn; identical to SEQ ID NO: 1062
  isolated from saliva, unidentified

SEQ ID NO: 2594 - DNA, 2418 bp, Unknownn; identical to SEQ ID NO: 1366
  isolated from saliva, unidentified

What is claimed is:

1. A method for obtaining a probability of a subject having a disease wherein the disease is rheumatoid arthritis, comprising:
    obtaining sequences of DNA extracted from a sample that is collected from the subject, wherein the sample comprises at least one of a fecal sample, a dental sample, and a salivary sample;
    calculating a relative abundance of a biomarker based on the sequences of the DNA, wherein the biomarker comprises a DNA sequence in a genome of *Lactobacillus salivarius*; and
    obtaining a probability of the subject having the disease based on the relative abundance to thereby determine that the individual has the rheumatoid arthritis,
    wherein the biomarker comprises at least one of the following metagenomic linkage groups (MLGs);
    the MLG corresponding to the fecal sample that consists of MLG ID NO: 2169;
    the MLG corresponding to the dental sample that consists of MLG ID NO: 16600; and
    the MLG corresponding to the salivary sample that consists of MLG ID NO: 4643;
    and wherein:
    the MLG ID NO: 2169 consists of SEQ ID NOs: 1-593;

the MLG ID NO: 16600 consists of SEQ ID NOs: 594-1536; and the MLG ID NO: 4643 consist of SEQ ID NOs: 1537-259, the method further comprising administering to the individual at least one disease-modifying antirheumatic drug (DMARD) to treat said rheumatoid arthritis.

2. The method of claim 1, wherein the DMARD is selected from methotrexate (MTX), *Tripterygium wilfordii* (thunder god vine) Leflunomide, prednisolone, hydroxychloroquine, and etanercept.

3. The method of claim 2, wherein the DMARD is methotrexate.

\* \* \* \* \*